United States Patent 8,781,750 (CELL-TYPE-SPECIFIC PATTERNS OF GENE EXPRESSION) - sequence listing, part 42

SEQ ID NO: 37754 - DNA, 448284 bp, Homo sapiens
ggaactgtcaggcaccgcggggacgcctttccgagcgcccggctcggcgcggcgcgggggcgcgcacgccgcccagcttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccaggtacctggactggggctggtgcggggaggttggatcccgagtcgcacaggtggcgtggagaactgtggtttaaatatggccaggggactcgcctcctcttcctatggagaaggcccccgttccaaagatgcccttctcatccccatcacgctgattccctcaagaacgagcccccaaggccagaggcgtctctttctccatatctggcccatcccctggttcctgtaaaccccgagtattagttccttgttgcctgatgaggggaatcatacagtttggaagaggggagagtgtccctttttaagacgtcccctagagtggggtggtcattcttcgggtctgagctaacttgtttttctcgaatgttgccccttgggggaaattgcttccccagtgtaacttccctcgtgcgctgtatgacgtcgacgtgacgcagcaggatgccacccctttccgttccatgacgtcagcagggcacatgtttccgtgtttgtcatctcattttaattgcaagaacctggatggtgctttagacgtctttgtaatccccaggcctctcatcaaaggaccttttgtaactttattttggggtagcagacccttgcaaaaattgtaattttgcattttccttttgcaatacgtcaaaatcaggaaatacaaattgcagtagtagtattcaggggactctgaccaccgtaaatatttgtatatctggggtgtattatagtgctgccatgcgtaagagttactaccggtggtgactccctgtccatgtacccggttcactgcaccaaaggaccagtgtttttggctaagtgacttctgattttggagtcattgtgttccactccccaccccccgccctttttttttagagaagtcacacctcctcatggttgaaatagattttaatactgcgtgaaaccttgcactgttaaaacatagtattatggctgccctggaaatagaattcattccctcaggtgtcatcctaaagtcacgaccgttgctgaattagaatgtattgttgtcacttagtatggtttggcttctagagcaaggctgttccctttaacatttgactagtgaatcactcagaccaggttcagcagtaggtcagcaatagtccagtttgtttttagtggtaaagcaatcatttgtttaaatttttactttttgtctgttcacattttataagatatacgctttacaaaatcaccttgatgcttttctctttggtgatagaagttatcaatgtttatttgagagaaagatgggtatagtggacttggagaatccggatttggattctgatcctccagcttccaacattcaacaagttattttattttgctgagctttaattttctatttgtcaagtttctttagcttccacttgtcaaatgggaacaattattgttctcagggaacagagttggggaaatgtaaatgaaattacagatagagatgagtaatataatgcctgataatgggtagataggtgtctagaatgtgttggttctgtttccttcttttgtagaagcaagagataaagtaataatgggtactgtggggaaaaacacagaagaacaattcggtaatataggtgagacccttttgcttttttataagataggtatatttgtacttagcatatgactttgataagcatcccttcaagaattgtgacatagacatgaaggtggaaatgttggcgaatagaaaaaaataggcttcaaaattatgatgtggattagtatactgttcagaatcaaattataataattacccatattatctgcaaactgggaattaaaattccttactacctcaggcttgtgaagatcaactgcagtaatatatatggacgctccttgtaagtgataaaatgtttaaaaaagtacatgatttttatgattggtagtacagtgttagatgtttagtcttactttgaaatgagagactagtcggggggcggtcatctgttaagcggtcagaagaagagcttgttttatatttacaaaaaggatgattttagaactgaagtatgaatataaaggtgttaatctcgaagatacttctggttgtcatcactatatagggtcaaagtgttcttattttttgagctatcaaattagcaaataaatttattacttactatctgaaataataaactgaaacaggttttaattttcaacatttattttagcaaggacttgtaagttttcatgtggtataatgtatgaaaactagaaccagagcatcatttactggtaacttgctggaaattaattttcttttgatgtggcattattctttaaaattgaggaaggaaacgatcatttgaatcgactttttcctctgaaggaagaggctttcatttagaaatctattaagaagaattcgtgtactccctcccccagccctatgagtttccagataatttagatatgatgtattggttctacttttgtggttttaagtgtaaggacttagtgccttaaagtcaaataccttaagatccatgttagtctgtgttgcttgatagctgcatagatgtatgttttcataatttaattgtcaagtagatttttgttatatctcttccttggatcttgttatatctattcccctaccaaattctggggagggggcacattatcttctctccatactgaaatatttctctaacttttgtccccttactcatttatttattaaaaaatgtttattgagtgtttagcatgtgccaggtatttctgttaaaccctggggattcaaaacatagaccctgcagggaagagatcacgtaagcaggtagttatactacactgtggacggaaaggtattaagaaaggtgtatcagcagtaggccgggtgcggtggctcacgcctgtaatcccagcactttgggaggccatggtgggtggatcatgacgtcaagagattgagaccatcctggccaacctgatgaaaccccgtctctactaaaaatacaaaaattagctgggcgtggtggcatgtgcctgtagtcccagctactcggaaggctgaggcaggagaatcacttgaacccgggaggtggagtttgcagtgagccgagattgcgccactgcactccagcctggcaacagagtgagactctgtcgcaaaaaaaaaagaaaaaaaaagaaagatatatcagcagtaaataatttctagtaagtaatagcttcaagcaggtcagcctgttgtagagttttatacggtattatccatcaagtttttactccttgtggggacacacagggagagattgctaactcagtgatgtgtgtgtttttgtgttgggatagaggattgttagcgagggctccttggactcagctaaggtagaacgagtgagatagagtgggaccactttgagtagagtgtggcagtgtagaaatcagctttgggaaggaaaagggaattgtatttcaggagttccttctgttcctgaaaagcagtgatgtagtcccagtcctgagtagctgagcagcagtgaggtggtttcttctggaggatcattggaagaggctgcgctagagatgggaaatgaattatttattcatgcaagaggaactgctgtatgctgtccagttttcaggcagagtgttgtatctagtccatttgtaagccctgatcattattctttccttctgctttcagtggtgatttacaagtcaagttaaaatgtccccagaagtggccttgaaccgaatatctccaatgctctcccctttcatatctagcgtggtccggaatggaaaagtgggactggatgctacaaactgtttgaggataactgacttaaaatctgggtatgtaccagaatgaattcagtcaatgtaccagaaccaattcaacctttacctaatgacagcccttccttaccagactcataaaaattgactgccacagaaacccaccaagtcatcatctcatcatatgttgattcagttggttttgttcagttcttgacattttatgtttcaggttattttatttgtgttgtggaccattgttttatgactagaatgttcatgtctttttttctgttttttctttgtgaagagcatgccgtcagagttttaaaagtgtgtttttcattcattggcttgttttcttattgtgtttgctgcagtccagcaacaaacatattctgaatctgataccatttggtaaactctcttaatgtgaatattataatagctagccaaaatgggtcatttctcacaatggggttgaaacagcaagatctcacacctagaaatgttgcattaaaaaacagattttttttttcctgaaacaaatttagatttaccaaaaagctacaaaaatactacaggaaattagcattgttataatattgttaattgttctacaggtcttatttgaattttgccagtctttccattaatgccttttttgttccaggatccaatcatcatgtctccttagtctccccaacagtgacagttcctcaatttttctttgcctatcatgaccttgacacttttaaagagtactggctacttattttgtaaaatgtgcatccacatgggtttgtctaatgttttcttttcattagagtgaaaaatatgtttttttcccaagtgtagtacagatgtgttgttgtaccatcctcaatgcatcagatcagggaatatatgatatccatatgcctttttactactaagttaactttgataacttggttaagtgatcactataaagttaactgatttttctccttgtaattagttaagtactgtattttgctgagtgatgctttgagactttgccaatacccggtttctcatcatccttttgtccattaatttcagcatccatggatgattcttgcctataactattactactctggtgcttgtctaagtgtgctttttctctttttctcattcctccccgtttattaatttgaattctactgtaaagaaacactcttccttctccttcagttatttatttattcagttatttacttatgccagtatgaatttttaggtatgtattttcctctgtgggttataaattaaatattattatcatttattttgttggtcagttgctccagctttttgtcattgggagtgctatcaagtggcttttgggtccttttgacatatccccatcatttttgagtcctttcttactagaaatgttgcctttttttttaagatggaggaaatttcactggactctgggatttgtgggaagcataggtattggacactagggcaagtttgcaggggccatgctcaaggtaccttcttggatatggcatccacaaatgaagctgttgatatggacaaagatgcagccaggaatctcactgacctggtacagggcgtcctgaagaagccaccgtggcttgagcaggggcagctagctttagaatgagtggggctcctcaggcacacactgtactactattgtctagtctggtcagtatagataacaaagatgatggctggggtaggggcagcctagattccaggtggtagagttgttcctttcaagggcatccacttttgccatttcccatctctctccacttaggtgcacctggaatcactgggccagggccccaggccccagtctggcagccagatgtaccaatagaagcctagtctctgcagaaactcttctctaagagttagatccatcacacacttgaaccctaccttggttgggctggttccaggtgggattaagttgagccagcattcaggctagtggctagggtatgtcaaagtttccccttcttccactggtaggtctcattatctattgtgtccacctcctccatgaagttcttgtacatcttgtcatagaggatgcacaccatattttcctcttcactaggctccagcaactgggccagcagcttgtgcccagctgggtctggagcagcttgtgcccaactgggtccacattgctcagctgggtccgccattgcttcccaggtgacagggagctcgtggtctctgtgaaagatctctggtgatggtcatatcagtgtctctgtgggtagtacttttcacacatgtccaccatgatgtcacatgaagctgatttttcaaggtcctcggtctgcaccctctctgcatcccgtagtctggcaggaggcaaagcaatgtgcatgtcattgtcttgtcacagtgaatggtgcccttgtgtgtctccattcatgatggtgccatgaggttgctgtgggatcatttgggtaacaggatggactctgagacaaccatgcagtgctgggtttggaggggtgttagcagtggtggcagcagcagtaaaagcagaaatgttgtattcttgattctctttctgctttctccttgttagactgttttgccttttgccatctacacaccttgctgttgtttgaccaagctaaagacttgggtataagaatactgagttaacgttctttagtggtaagataaaaaactaagacacttctttggaatagtaggatgcttttgaaaacatctgatattatcttcaatttcattaatcaaatacttatggagcatttactatttactagccattttgctagtgttaggttagctgcttttttgttgaggcaagaggatttggtagaaagaactctggtggagttgatcagaagacagttttaacttttttttttttcttctaaaagttaactatacacattaggggatttataaatcaactctcatccttagataagccagggattggaaagtgactttttagggtttttttttgttgatttttactggtttagaatttttgccatttagtcaagcagcaggcctggtgctcagacagacttccccagcttataaatggtggtaggaagtggggattctgaaatagagactgtatataggattcattcagtctgaatttccacattattatagacaatctagataaagattggagcctcctaaattacaaaatgctttctttagatggactccatctgtaattgaagtcatcaagatcagatctcaagagggtattttccagtttccctcactgtaatttttggcctgcagaaagtagagtgatgtacttcctttactgtgctcatttcttctcagtttgtggttttgactttgatttcctctttctgggatctttaaatcagtatatttttcttctgggtctgagaataaaaagattttcaaatggatcactggatatttcagagtaactcttcaggttttcccacactttcatgtttctttccttctttgattaaaaataacatctttatgtctgcattgtgctcatctctttttttctgtgtttttgaaggtttaaaactgttggtcttttcataagttcctttggttcatcaagattgtgcctaatcctattttcttttccttcccacctcaggtcttctggacctagcctatcttgcattttactgctaggaacaaacacattaaggattttcttcttttattggaatggggtgagcttggagaaaagaaggcatttcagatgtccattgatagtcttaagtctgtgtagccagaggcagttcccattttctcactggatctcaattttttatccataaaatgaacaatcagattagatgactgaggtttttgcaggtcaaaagtcctgcaaaaacaactcaaatgtccatcaggtgatgaatggataaacaaatttggcatatcaaaaatagaatattatttaaccataaaaagtagtgaagtactgattcatagtacaacatgatgaaccttgaaaacattgtgctaagtgagagaagctcattacaaaaggtcacatagtatgtgattccgtttatgtgacgtgtctagaataggctaatccatagagacagaaagtaaattagtgggtgccagaggctgggggaatcagaagtgactgcttgagtgagggatttctttttggagtaacaaaaatgttgtaaaattagatagtggtgaaggttgcatagctttgggaatagatgaagaatgatcaaattgcacacttcacagtgattttatggtatgtaaattacatctcagtaaagctgtcattaaaaaaaaaaaaccaaacaacctgagctgggcacagtggtacatgcttgtagtcccagctacttgggaggctgagacaggtggatcacttgagcccaggagtttgagaccagcctaggcaacatagctagaccccttctctaaacaaaaataaagaaaaaaaataaaaccaacccatcaaccaggaatgttcattgacctgaatatataggacatagaaataaatctttcttttttagcatgtcacagacattcttttcagaggtaatgaagacctgacaggggcctgatggctagtggactggtgactggtatatgtaaagtgatatcaacctgaaattcttactctttctatcagtatcctgagaaaccagttacgtttttcagcataaagtcttgttgcttctttttcacagattcccttttgggtgttctcaaattcctgaatgtttagttgaagatttaagtgcaaatagtgggatctgatgacaaatttgaaatgaatccactagtcctagtgttttttttttttttcgtgacagagtttcgctcttgttgcccaggctggagggcaatggcgcgatcttggctcctcaacctctgccttctgggttcaagcgattctactgcctcagcctcctgagtagctacagcgtccgccaccatgcctggctaattttttgtatttttagtagagatggggtttcatcatcttggctaggttggtgtcaaactcctgacctcaggtgatctacccaccttggcctcccaaagtgctgggattacaggcgtgagccactgtgcctggcctagtcctagctttttctggattaactgcctgaaaaatatgtgatatggcatttaatgacatttaatatgtatggaatttactttcgttagcttcaaaaaagaaataaaaatacctctacccacattcataaaatgatgtgaaagaccttgttaatctggaacattattgatgccttttatgtagtacttgtctgaaagattcagggaagttctttagaagttcattaacaattccttcttcaatccttccatcagccgaagtgtgaatttctcgtttctgtaacaaaacaatgacagagttagggaaaagaatggcttctttttggtgtgtcacttttggcattcctttcttttagatcttcagcagacacagttatgagtggtaggatctacatgtctaatttctattaactcgaagaggtataccctataggacacagtataaataaaagtataaaacaaggagacaatttttaaaggtcacaagaaccagtcttattacatgtagccagttggccttgaagagataaggtctaagttatctatattctagatctggttcataggagaaataggcaagaacctaatcgaagcaagatttcttttttttttttttaaatagcaattcatatatatttctcttatgttatctagatttttctaccttacttaataagactgtgtatgtttctaaactccattgctagacccatcagtatcttaagggccaagttcttgtttaatttatgtttatacctccttaagatctatcttcgtacttttcacatgtaatgtagtaagtaggatttgaatggatgaatgaatgagttagatgttttccttgagaaactacttgttttgggtatcagagtggtttgttcttgtggtttggaaggatttttattggcctgatagtgtattgcttactttctgttatgcataattctttttaatgacattccctgaaatgagttgacatttttgaaattatagtaggccgggcgcggtggctcacgcctgtaatcccagcactttgggaggccgaggcgggcatatcacaaggtcaggagatcgaggtcatcctggctaacacggtgaaaccccgtctctactaaaaatacaaaaaattagccgggcatggtagcgggtgcctatagtcccagctactcgggaggctgaggcaggagaatggcgtgaacccgggaggtggagcttgcagtgagccgagattgcaccactgcactccagcctgggcgacagagtgagactctgtctcaaaaaaaaaaaaaaaaaaaaggaaattatagtaaagtgtattatctaatactggatttactcttgcaggtaaaatacagactgagatctgaagggaccaaattattaattttagagaattattccatgagcttactgtttattagttctttgctctgtgttaatttgatcacaagcatgtgctatttgtaagatgccatattttgtcatttttagtgatttttctaatcttgaaaatgtctaagtgtctgttcagcattctggaatgatgcctggcaaatacaacagtgaggaaagcagagagggctcactgcaacctgtggcagctgagcctcagtatcttttttcagcatattgcagtgactcaacctcactggcacatggctgtgtttggggcatctgctgtgacatctcatccgcccacaactacctattgcatttttttgtccatgttctgaatttcattacttagttaaaaatagatactcagtgtaagtacttgattactaaatagacagaacacttttaaaggatgagtgctgtaagctttgaagactgatctcagtttggctgcatgagtctctctaactggcaatctgaatcttcattagccttgtgtctggaaggaagctgctgccctgggaggcaatagtttaatttttgtctatggccataccaccttgattgcgcccaatctcgtctgaagatgggcagtttttaataatttagatttagttgttcacttaacttttctgtacttttccctgatctcattcccctttttccccacgcctgtcttcatactttatgtattcattatacataaatatattcctcaacagtattattttgcgtgtttaaaaagtttgtacaaatgatatactatatatattcatctatatcttgcccattttacttagtataaagttaatgagatttatctgtgttgatatttacaggtttggttctttcctttgtgctgatattttgtattccattgtgtgaatatgcccttaattttaaattcattcttctgctgattgactgttacactgtttaaattatttttttgacaaagaatgccacagtgaacattctctcacatgtgcacaagaaaatatgtatgagaatattttctgggacagttttttaaactgagtgtatttacccattagtggttgtaaaatcaattgagtgagtcacccaacattaaaaaatgaatgagaacaaaatggaaactctcaaaatgtgtcacagtaagaataagcactgttttgtgaattttcatttcggttaaataagtaagtatgtgtatactgggtcataatgaaaatatgtgtgatgatcaaaactttgaaagctacccatcaaaggtatattcctagaaatagaattactagctcttaagatgtatacatcttctattttattagatattgccagattgaatcattttccttccatcagaaatgagtttctactattctgtagcctcaccagtacttgatattgtcaaacttatatttttgccaagctgatgagatgcgacctggtatctcattgtggtgaaaagtcttttaatatgcttattggcaattcagatttcttcctttgggatatcctttgttcgtcttttaagtggattgtttgtatatttctatagattttaaagcattctttgtgtattttggatactgatcttttggtaattacatgtattacaaatatctgcacaaagtctgtggcatatattcttattttagtgcccctgacatccaagagttttgattttgatgaagttatattctacagtattttcttttttagatttgaatatatgtgcctgtgtgcacgtgtgtgtgtttgtgtgtgtgtgtgtgtgtgagagagagagagagagagagaaagagagttttaagaaatctgggcctatccaaaagtcacacatctttctttacgaattttaaagttttcctgtttccttttttggtctttaaatgggaatttattttttctgtaatatggagtgagatagagatattgtctcccccaccccccccaccgtatggataattggttgacctagcctcatttattgagaaggccatccttgcccatggatgtcaagtttatatcacacatgggcctgttgccaggctttctgttttggtcagtcagcctcactgtccttgtgccagttccatactttcttaactattacagtcttgtgaaatgtcatgatagccagtaggacaaattccccccttccatcttgttctaattcttaaaaattgtcttgcttaaccctgtgttctacatacgtttttgtaacctcatttaaatagttgtatactgtttcattaggaaacataccataatttagttaacaaaaaaacttctttttaattaattgagaaagagaaatgaagagagattaccctgatgagaggcaaattgagaattgaaggttagagaagctctctctgaggaactgagatttaagttgaatcatgaaatagatgaatatactagtccccccttctcattaggggatatgttccaagacctcccctagtagatgcctgaaacctctgatggaactctgttgccgtcagtcagaacacgtttatgttggtgtcttccacccacaaatttaatgccttttctgtttcaactgagcacgtagcatacgctgtagctgttatttttgcaatttgaggtgcaaagcaaaactagcacaaatttctttttccttcttcacaatttcatggatagaagatttgttcttatgttaggtcttagcaacatcagcatatttttttttaattccttattaagtcaagaacatttacctttttccttaaaggaagcactttatggcttgtcgttagtgtatctgaattgccagcatcactactcttgtgctttcccgaagcactttattcagtaaaataaggattacttgaagtcaagcactgctgtaccaaggcagttgatctgatcaccaagacagcgactaagtgactaacgggtgggtagtgtagacagttatgctggacagagggatgagtcatgtcctaggcgggacagagttggaaggtgtgagaacaatctcagaacagcatgcaatttaaaacttatgaattgtttctggaattttccatttagtattttcagaccaaacattgcgttttcttgaccaagggtcagggtaggccaagggtaactgaaatcacagaaagcaaaaccatagataaggggggactactatacatcaaaagtcttaaatttgcatacttcttggcccagtaattaaaattttgctgatacataggaatatatgcatccatatgggcacattttattttatggtcccagagaaagacctccagataatcaatctggcagtcctccaataaaaaggccagaatgctgcctgataacactacagtgaagctcagtcgttgacaacacccatgtataaagggcttcaaattttcatgttagagatgcattctttaacagaaatgcacagccaggaatcatcagtctgaggaaagccatcaacatgaaagacagagagcaaaacagagacaatgcaaggtacagaagaatttttttaaagctataattaatatccttataaaaataagagaaaatactgcattcatgaaactatgacaatatgtctgttgggccaacttctgtacctgcccaaattatcaatcaaatttaaaactagacattttcagactttcaagaactcaaaaaatttatatccttttctccctttcttaggatgctagtggaatatatgctccaacaaagcaagaaggtaaaacaagaaaataagtgattcaatacaggaagggaagacctaaaataatagctatatggcagacctagaaagcagtcaatacaattaaagcagttcttccatactgcgtgcttactgttaactttattactagatgttttatcatttagctgctattgtgtaggaattcagttgtttattggcatatatgaaagcaaacacagaagttagattgaggtagaatcagaagatacatgggaaaatttactcaatagttcaacaatcttttatcagaacacttaagatgactttggagaaaagaaaaatagccaggaccagaagaaataaaataaagcaagatttggctggggagggtcaggtgtgggcagaagctggaagtcagattggataggggttggaacacaggaagccatctttagaggggttgtgtggcaggataatgtgatggtaagcatgtgggtttttcagtcagtgaggtctgagtttgtatcctaactctgcttacagcttaatgacctttgataggtctcataacctttcggtgcttcagttttctcttaaatggggatggcattaatgaccttattaagtagttatgggggtgaaatgagataattcatataaagcacttacagtagtgcttggtcataatgttcacgttatggtgggtgatattattgtatgttgttatatataataaataatatgtggtatgatatattattatttcactgtgttattgttgtcacattgttattttagaatcagggagtctataaagagtgtccatgcaagcagtataacaggaactattgaataagacccaggcaagcagagcaaaacaggagctcactctcatctaacaaaactcagagaaatcatgtagcagaaatggatgggagatccagagatttttgattctgagacagccttctttccttgttcattgctttttgcaaatctacggaggtaggagaaaaatcaccatggcttcctctgaccctgcaggtggatgaaacttagaatatttgattaggttgaaaaatgaatgggcatgaagatgccagctgttttagcagatagaacttaagagtttttaacagtcattagagattgaacactgattgtcttgagcggatacatgcaacagttgttaacagaggggtgaagaagcctcttaagatagataatgcagggagttctgtctgaggatgaagggcataagcggtgggctgttgaactctgctagtgtgggcagtgtgtggggtcatagatgtgcaagaagtttggctggaactttgggtgtttatctaggtaccagaacatctggaaactcagtgaacagtgcatggtgttgatattttaagtgttttactgagggcaggatgtccatcaggaagtattccttgggattgctaaccagaaggaaacacaggttcctcttactcctcatatcccagcccatattcttttctaccctgggtagttagctgcctgtctagactttttgtgatcataatagtataatacagtaatataaataattttaattaaacagtttatgagccttttaacattacaaagtgctcttgcatatggtgttttatggccttttgtattttgtgcttaagattgtaagtggtggtgttggccttaacccaatgaagtctgaaatcactttgggaactttggctaggcttccagagtctggggtagtaagtgccaggataaattggggtctgagattttaggtggttctgatcttgggcttttcatgccctccaatgacttcactttagggtgacttcatttggtatggaggttgatgtaggggaagaagtgaagggaggtagccagtctaatgtgtaaagaaaagtgggtagaaaattcatctagtctattcctggctccactttacattgttcaaaggaaaaaaaaaatcacttccactgttgtcttttgtcccctctattgtgtacaatttttagatagtatttttggattagtttttgttttattaggatgacaaatttacaaaatgctttgagtttggaagacaggtgagggttttttttagtacaggttaatatgcatatacatttgttttagggctccaaattaattattcttataccatcactcatatgttaaaagtctccttatgcttgcatagaaatgtagaacagcctcttttcagctgccatgttacttgaatagttttattttttggtgccgtgttgcttgagaattaattttgtaatcttccatctcagggccacatttcctcagtaatttggttatctttctaatggcatgttatgaaagttaagtttatcccactgaccttgcttctcttgactttttgaaaaatacatcttttttttttttgttttccgagaagattttttatctcaacctttgctcttgccaatttattgataacaaaccttgaatcaagtggaagttttggagagcattttgatgttccgcttttaagtaggtgtaatgccctcagaatgattttttttcatctgtggactcctgaatttttcatttaaaaaacattattttaaaatttttgtgattcagtaattaacatgttgggtcaattttgggcttggcacattatgttttataatgtggtaaaatatacataacataaatttacaattttcattatttttaagtgtacacatctttggcattaagtacatcacaaatgtggcatttggagacgtatatctccaaaacttttttcatcttgcaagctgaaactctctaccattaaacaacaacttccatttctcttttcccccagctactggcagccaccattctggtatctgtctctgaatgtgactactttaggtacctcacttgatgtaagtgagtcatgcagtatttacccttttgtgactggctttcttcacttagcataatatcttcaaggttcatccgtgttgtagtgtcagaatttacttttaaaggctagatagtatttcaatgtatgtatatatcgcactttgtttatccattcatctattgatagacacttgggttgcttctatctttggctactgtgaataatgctattaatatgggtgtacaaatacctgtttaaagtccctgttttcagttttttgcgtatatacccagaagtagaattgctagatcatatgataattctgtttaattttttgaggaaccgctatactgttttctttctgtttttaaaaataatttcaacttttattttagattcagtggatacatatgcaagtttgttacaagggtatattgtgtgatgctgaggtttggggtagaattgaacctgtcacatgggtagtgagtatagtactcaataggtaggttctctttttttaaaaacaatttttttttttgagctatggtctcacgggtctcactctgtcatccagtttggagtgcagtgatatgaccacagctcactgcagcctcaacctcctgggctcaagcaatcctctcacatcaagtctcctgagtagctgggactaaagcacatactaccacacctggctaattttttgtattttttttcgaaatggggttgcgccatgttgcccaggctggtctcgaactcttggactcaagccatccacccaccttggcctctcaaagtgctggattacaggcgtgagcctctgtgctcggccccagtaggtagtttttcaacccttggctccctcctttcctcccctctcttggagtccctagtgtctattgttcccatgtttaggtccatgtctacccagtgtttagcttccacttataagtgagaacatgcagtatttgattttttgtttctgtgttaattcacttaggataatggcctgcagctgcatctatgttgctgcaaaggatgtgatttccttctttttttatggctgtgtgctatactgttgtccacagaggctgcactgttttatattcccaccagcaagacacaagggttttaatttctccacatcctcctcaacaccaacacttattactttctgtttttctttgtttttgtttttgttttcatagtagtaatcctaatgggtgtgtagtggtatctcacagtggttttggtttgtatttccctaatgtttactgatgttcagcatcttttctttattattattgttattattttttttgagacagagtctcactctgtcacccaggctggagtgcagtggggcaatcacagctcactgtgcagcctccacctcctgggctcaagcaatcctcccacctcagcctcttgagtagctgggaccacaggcatgtgccaccatacctgggtgatttgtttattttttgtagagatagggtcttgctatgtcacccagattgatctcgaactcctgggctcaagcagtcctcccactttggcctcttaaagtgctgggattacaggcttgagcatcttttcatgtacttcttggccatttatatatcttctttggagaaatgtctgttcaagtcttttgcccattaaaaaagtttttttttggtattcattgtatgatttctttttgggttctgaatatcagttccgtctcagatagatgtatgatttgcaagtatcccatcccattccataggttgcctttttactctgttgataatgtcttttaatgcgcaaaagtttcacttgacaaaatttgaggtacttcttgtatgttctccagttggttaaatttctctagcctgcccctctgttagcatcatctttctgtgctttcttccctagaaaggtcagaaaaggctctggtgaaattgagccagacctttgtatcactagtatctccttctgtggcaaaggacacccatttaccaatgcacctgcttctcccatagtagaagccttttgactgagaattagagacttataaaatatcactcattgttatgattatggtagtagtgtataggacatgctatgacattggttaacataagcagctctatattggcaggaaggacagtaatataacaatagctgttatcattaataatttttcattgtaatgtaagtgctttgaaacgttttgttgcatataatccttctaataatcccttaaggcagatgaggtaactgaaactcaagtaagttgcgtgacttgttcagggttgcatagctaagccattccatctataacagttctcccttgttcttttctgtatcagaatctgtcctattgccaatttcaagcttttatttattgtttgtttgttaggcctgtctcccttagtagaggagacaaggccattatctggcataacagctgtgtctccaccacctagcataggacctggcacaataagtataaaactgtggatctgacagtaatgtcatggttccaggttcaggggtgtatcacagttgtctcctaggttgaaaaaagtcattagaaagcatcagagaaacaaaaaaggttagttgttgctacttccctcccctaaacattaaaggtttaaactaattgatttttaaatttaaaaactttttattgaggtatagtatacattcagaaaagtacactgaatcataagtaagtatataatgcattgaattttcacaagctgaacagacttgtgtaactagcacccaaaacccagaacattatcagcaccttgtacgtcctctttgtgctcccatctagtcactgacccctcttcccatgaaaggataactgctatcctgacttctaacaaaataggttaatatacttttaaaaatatatatataaatggaatttatactgcacaaaatggcattttgtgtgaggcttcgtttgttcagcgttatgtttgtgatattctatattgttgcagatagttgtagatcacccatttttctggctgagcaatgagagttccattgtgtaacatgccacggtttatctactgtacttttgaagggcatttgggtagttcctaattgatatggtttgggtgtgtttccacccaaatctcttcttgaattgtagtttccataatccccacctgtcatgggagggacccggtggaaggtaattgaatcctgggggtggttacccccgtgctgctgttcttgtgatagtgagttctcacacaatctgatgattttataaggggcttttcccccttttgctcggtacttctccttgctgccaccacgtgaagaaggatgtgtttgtttccccttctgctgtgattgtaagttccttgaggcctccccagccatgctgaactgtgagtcaattaaacctctttcttttataaactacccagtcttggacatgtctttattagtagtgtgggaacagactaatacactagtattatgaatagtgccattttgaatagtgccattgtgaacattctattacatgtctttttgcaaatgtataatatgtatacatgtttgaaccctctggattttaagttaagaactattcataaatagaataaatattttaaaattctttcagttccatattgtatgtaagcaaaggagaaggttagggagggaagaaagaaaggggtggatttgaagggaaagaaggaagacagagaaaggacaataaggtaggaagaggaaatcaggggagaagaaaagattatagaaaaggaagggtagagaaaaatggaggcaagcgtgcagctgtgggctcctaaataaaatgagatactgaaactaaatccttatcacaatcttgagcatggacttcaaggtatcattacttcttgaaatgcaaatctctcttcaagcctcatcagttcctctcagaagctgtctgacctgtagttcatccatttctctctctcagtactgtcagcactccatctcttttcctaaccagtcctaactagactcttcataactgttctagatctgatctgttttccactagcagccatttatatgatttgaaacaaatctaataataaaaaataaaaaccagatcatgttgagatagaataggaataggacgtgcctcctccaagtatttttccttttcttcttcttttcacaaaacctacaccactactttgcctacactatacccactaacccccaagcttttagccactcaaagaaaagagccattcttctgtgctgtcacattgtttaaccatgcctaattccagaaactggccttaggagatacaaacattgaaccaaggttgtggagtctcagtctcccaccttgggaaagaatgctgaacaattactagggtatggaaagggaatacaatttcattgttggaactggggcagaaattaaacacatatagttattttaagtctgtcactgatttgctttttgacctacattcgcagactccttattctttttttttttccattattaaagttattgaggatttggaagcttgaatgactttgcaaatcttaactaaaactagtgatataattcttggcattgtggcataatttcttacagcacagcacaatgtatttaatttttaaagaatagtatttatcatgtttttgcatcataaaagtatcttttggaattgtcattggcaggtttttataaatatgtttattatatctatctttgtatgtatttacttaagaaattaaaagagtatgtaagtcagaaaaggattctgagaaccaatatagttcaaatggaagattggaattataggtagattggcaggaattcaggacgcgagagaccattactttagatgatctctttagaaggcctgggatttaaaactgagccatactacctttagaagttccaaaggatagactgccacagattatgccagcagtcatgttgcaagattggatgaccccttcaaactggcttgtcaaatttattaatatcttcttgcaaggaatgaatccaagaatatgttggagctacatctggatggaaatgaaatagtgttacaggttctgagcagtcagacagataacctgatgataaattttgggcagtgaactatattgatgttgctgtcaacttagtagagatatcaaaagaacacttggaaagaaataaattaatgtttgttactgttgtgggaaaaccaagatgaatagggagattagaagacatcaaagtaaagcagcttatcttcatatccaaggaccttcagcatctaaagattcttcagaaaagtgtttttcaaactctttgatggaagaacagattaaaaaaaatgtagctggtcaccagctgatacttttgtaaaatataaaaatgaattgctagaagagtgaaatgaaaaagacatgaaatacaaggcttgactcttttattagtagattcatcagatttattcttacacattgctgtaaaagttttaaaattcttatctcattttctgtacttttcttattatggattagtaataatttacagaccagaactggtccatggacctgctctctttgaatagcacgattctagaaagatttctgcattctaacagtccaggagttggccttcttaagaattctatctcagaggggcaacagtagtatgttattgataagtaattcctaactacatgttagataattggagatactgttttttaaaacaaatatggtagatggttatacaaataaaaactattctgaagataactcaaattttcagttagttggatcagtaaaaaatcagaggacattgttactttgtccatgctttacatatatatacacacaccaaagaatggcttttgggtaaggagagaatttacacgtatattttatacgtataaaatgcacataaaatctacacacaccaaagaatggcttttgggcaaggagagaatgtttataatacaatcttcttttgtaaacactcttatttctgtacattttaaagatcacctttttttgatgtttgcttcttaaagctgtaatgtagttatattttctaagttgaacgtcttaaacactatgccagtgatttgggtaacacttcagtttttctctaattgtaactgatgaagatttttaatgactatgataggcacattgccaatttttgttacattctcttgttacaagaaaatatcatttaccatttcaactttgtttcatgtggttcatggtagaattcatttcttattaaaaacttaataaagaactagtgttagctttagtagtcatattaaagtataacattgttttaatctacaccagaattatagaatttcaggaatggaaagcattacactctaatgttaaccatatgatctatgaaccccttctaatgcttctctgccaagtgactgttcaggctgtctgtaagtatctctagtcatgtggaagctccatgagtcccaacacagctccctgggcagctaatactgttacatagtgcttttctacattgacctgaaaccctttgccttgccacttctagctcttgtcacaatatagaacaagcttaattgatcctgcatgttagtgaagatagctatcatgtttgatagttctttcttctgtaggctaacatgtagcctttgctgctatcatggatttgtgtccttccctgtcttttttggcttcttctgaatgtgatccagttagtctctatacttcttaaagtgtaacacctagaactgaatgaagtgttcaaggaatagttttgaccaagtgtagggttgagtatttttatcttcattttccaggaagctaccttctgtgagattgtactggacagagctgtgggttacaaaccactgatagctgtgacctttaggtgtgttatgaaatcattttagagggccttgatttacataaaaaacagaagagaatggaacaaaagtacacgtcatgtaataaagctaagtatcattgcttaacaattttgttttcaatttatatatgaacacgtacacagatatatgtacacatatgcatatataatattactctgtacagatatctctactgatggtgatataaaatggtgatataaaaatttcttattatgtgtcaaaaaagtttgaaagcctctggcctagactagatgcttcctgtccttgtttctctgatggctctgtctagtctctgcttgctctgcagccaatttacatgccccatcttgatattcttctctttgtttccctgtaaatttctgctgtgtaacatgagaggcatgatgggctccattagatttgctttaggacactggaaaattattttactgctctgattaagtcttttcatggttggacccccatgagaatttttgtctgtggaatgaagaaatgaagtagcccggtgaagaggtgaggaggtcaattgaggtttttagctcagaaaattattgccccagtgaagtaaagggtttaaggaaaatagtgtttgagatagactctcctcctccttattttttggttttgcaatttgtacttttgaatactcgtgacagcaagtgctctctgtgtgccaggaactgttctaaatactttatttatgtgcaccaagtcagtggatcctcataacagctctctggagcatgactgttatccttattttacaaatgagaacactgaagacgagagagattatttaacttgcacaaggctttagaatttatagtgtataacagtagcatctcaagcgcaatctaagaacgaaatcctttcaaactacctaacaaccaaaaatacgtggatggcacacttatcccattaccctgtagttccagatatgctcatatagcagatgctaagtcttttcataatcatttaaatataagaatttgaagatataaaaaacgttttttttctatctttagaaagcacttttcagtaacaggaaagggaatcctttaatgacacttcagaatctattaattcttccttttcctttcttccccactcttctttatctaattctctatttttggctctaccctgtcatcagtttcctactacaattctctctctctactttttcattttctttttgtttcttctccccatctccctatctccccatctccactggttttccatctattctttcctttactctgcttttgtgctttccatattcattcaaatttatttttttagataggttaagcatgtactgagcaccaagtaagtgtgaggcattgttgagatacaaacataaataaagcatgtagcatgagagctaatcagggtgagatcaaagctctgctagtacattcccttgagaatcagagctattggagcatgccaaggtaaatactccttaggccttccctatatggatcaggaatgtctatgggatttagataaatagtatgcaaataatataaaatatgagccccagagttcagagaataggcagcatttaggacatgttttggatcaaggcataaaaacagtggcctaaaaagtttacaggaatattttcattggaaaattagtagtgtttagtataaaaattacttcttataaaataacactgtacattgaatgtatgaaaatggtatttaagttggccttggccctggggatctcttatataacatttactaatatgagtaataattaccagcattcccacagttgaaatagcaaacagtccaggacatttctgtaacttgtttgaccttgtccactccagctctaccttgctcacttgcagtatttatgaaatagctttcaggtacttcctgtgtgccagcaggtatgctgctggacactgagggatccagggtttaatgcattctctttcttcttagagttttcagtctagcagtgcctgtctcttaggttttgcccttacttaaagacaattgcccataactatttctccttcccctcacttggccagatcctatgcattcttagaggccagttgtattccagtgaaccttccttggttacccaagctaaaagtggtttctctgctctcttcgctcctattgtgtttattttctttaaccactaatttggcaattaatcatgttaattgctttgtgacttgtatctattgttgtcttgacttgttatttaaattgtgttgtgtgactttcatagtttgatttttgtcttctgattacaagttcttgagaatagagaatcctttgtgtaactcttatagcaataatcactccaaacttttttttttttttttttttttgtgacagaggcttgctctgttgccaggctggagtgcagtggcacgatctcggctcactgcaacttccgcctcctgggttcaagcgattttcctgcctcagcctcccaagtggctggggctacaggcacgtgccaccacgcgcagctaatttttgtatttttagtagagatggggtttcaccacgttggccaggatggtcttgatctcttgacctcatgatttgcccgcctcatcctcccaaaatggtggaattataggcgtgagccaccacgcccggcccaaagtgtttttttaaattatgcaccctgtcttagtcagtttgggttgccataacaaaataccttagacttggtaatttataaacagcagaagtttattgctcacagttctgatggctagaaagtccaggatcatggctctggtagattgtgtctggtgagggcccgttcctcatagatgatgccttctctgtgtccttgcatggcagaagggaaaaggggcagacgagctccctcaggcctcttttataaggacgctaatcctatttatgaggcctccgttttatgacctagtcagctctcaaaggccctacctcttaataccaacacattggggattagattccaataagaattttgaggggccactaacattcagtctatagcacaccccaaattattttattgtgtacctctgctacatgcatatttacttataaaaatatatttatagattataaaacatacataaaatataagctaaaaatgatataaagataaaattaacaacactgtaaaaataatttatattacttatattgtggtattttcacctgccatacctgaaaaagaaatctgaaaaaatatgtagatactaatggaagaaatgcttttgtcgtaaattaagtgtccagaaatgtgagggtctgtctctgaactctttattctgttttactggtttgtctatttttgtaccaacatgagtattttaattactaacatttatagtaaattttgaaatccagtattgcaaatttcctaccaaagtttttcttactgtggtaaaatacatgtaacataaatttactattttaatcatttttaagcatacagttctgtggcattaagtatatttacattgtagtacagtcattacaactatccatcggaaactctgtacccattaaactatagcttcctatttccctctctcctcagccccttacaactactgttctactttctctgactgtgaatttgactactttagatacctcatgtaagtggaatcatatagtctttgtccttttttgaccagcttatttcacttagcataaggtcctcaagatgtatccatgttgtagcatgtgtcaaaatttccttcctttttaaggctggataatatgccattccattgtgtgtgtgtgtgtgtatatgtatagtattgtatatatatataatgtatagtactacattttgtttatccattcatccatggatggacacttggattgcttctaccttttgtttattgtaaataatcctatcaagtttttgttcttcaagatcatctgatctattctaggttcttggcattccatttgtattttagaatctgcctttcagattgcagatcaatttagggagaacttacaacttttcattatgagtctttttttttctcactccgtggctcaggctggagagcagtgatgtgatgatggctcactgcagtcttgacctccctggctcaggcgatcctcccacctcagactcccaagtagctggtactacaggcacatgccaccatgcccactaactttttggtattttttgtagagacagggtttctccatgttgcccaggctggtcttaaacttttgagctcaagtgatccacctgacttggccttctaacgtgctaagattacaggcatgagccactgtgcccggcctcattatgagtcttttaatccatgaacatgatatctctgttcatttatttgtttacttattttcttcttaataatagctttctgcatagagatcttgcacatctattgtaacatttatttctatatatttgatcatttgatattattttagatggcatctttctaaaagttttattttctgacagttgatggtatatggaaatacaatagacttctatgtatgctctaacaactttgctaaacccacatattcattccaatagtgcatatgaacatttacaaaattttctatgttcacagtcacattttctgcaaaaaagtaagttctgtttcttcttttccaatttttatactccttatttcctccatcctggctaagacctccagtacaatgttgaattaaagtgatgagagttggtattcttgtctcatcctctatctcaaagaaaaaaattttaatgttttgtttttaagtatgatgttgctttaagttttttgtagatagctttgatcacattaaggaagttcccttttatcccagtttatagagagcttttaaaattatgaatggatgtttaatttcatcaaacacttgtacttattaagataatcctatcaatttcctcttattctcttagcagagttaattaaatgcacatattagaaaagaagaaaggttgaaaattaataagctaagcatctatctgaaaaagttaaaggattttttcccgatcctagttagctgttaaaaactgtatgtgagcccatcattcctactgaaaccatattgtaatttaaaccacatttttgttatagggacacctaccaacatttaaaaatacttcctactctaaagtagagttgaagtttatcatttataaatggagatatggcatagaagctgagaataacagttgacgccacatgaactggcaaacacattttcttgaatattttaattttgtaatttttaaaacattctgggctgagtcacttattttggtgatggcattttggaatcctatgctaagaattaaatgtatcattttttctaggagggtctagccatagtttttaggctttagagatagaatgtacttgatgtatcaagaatatcatatgtcatcaaatgcatagccccattcccctgaaaatcaaccgagaaaatctatctgaatgcaattttgtcttcttttaccgattttaatttgtcctttttgcttgtaaaaaggtctaagacttgaccttgtggatttggtctggccagtcagatggggtataattatagccctttcaaggctgaatatgtaagattccatgaaccagttcagatgcctttgcagataaaatgctcatgttttagattatttagatagatgttaagataccctttgtcagtcttccagcttctttactgctgcatccagtctagaaaccatgataatttttgaaactgagtaatctatgttagatttaattcagagaaaataaattctaaaagatgaaaatgtagttaatattagttaacagtaatttactgtaatatgtgacttttttttaaaaggtggttattgatctttgagcatattttatttgagagtcacttgttattttaggttgccaaagttgaagacttccttctcagctgatgttaaatattgttggtttagcacaaacgtcactatcaagaaaacaggaagctatgtaggacacatgccaaatggtaaattaatagtcagggtaaaggaaactgacgtagactcagggaaggaaccctggactcatctactttgttctttttaggtggcttgaagaatagaaatggtctaagtcattatttttttccagacagtgtatcaaaaaacagggttagccctattaagccagaaagaatatattttcttatattttgcattattttaaaactgctaatgttttaaaggttgtagaatatcttcatatagctttgttaatctagattagttcttggctgtcactaaaaagcctataaagtatagtaaaatttgcctacttttatttttttatagtgaaaccttaacatttgagtcggatctcagtaactaggaacaaatgataatttaaagaggagtcaaatccaaatttacctttcattatttacttaaactttatatatatagtttgctaaatcagtgaacagtgtcatcattgtagagtctgtgtcaagttacggggggcttgttccctctcttgtagccttgatttatgtgtttacagtttttatacttattactgataaataattttcttttcattagaacgcatgtaatagaacttctttttggcaatattttgtcatcttttacttctcatttttctaggtacttaataaaatatcatttgttgaaaacatttatagttcaccaattatgagatttatagttataaatctttataagccactaattatgatttataattcactaatcataagatattaatctgatggttttctcttaaattattgagagatggtttaatgtagtaattaagaaagtgggccatggaggcagacatcctgggtttggatcccagctctgtcactcactagcaagttacataagcatctacgtgcctcagtgccctcatctgtaaattggggtaataacagcacctatcttggaaggttgctgtaagtttaaatagtttaatataattaaagagcttagaatagtgcctgccacattagtaaatgcccgacaaatattagctgctgttatttgtttattgtggaaatataataattataggtaataacttaaagtttaaattctgagttgtgtgtacagttcttcaaagggaaaaccttccacaaataatcacacttttgcctttcttggaggtgaggatgagcacatcatcccaattccagttaaatcaacagtctttttttcttgttgttgtttttaatcatgaaaagagtacaacactaggagtcaagatatatgcattcattcagcaaacctttatcctcctacatagttgttggagtgttcacctcctggatatcagtgctagacactggagatttaaagatgcctaggccatggagactaagatatggttagcgtgtcctgtaagtggtttccaatcccagagtgccagtgagaccctttgctctttgatgtcatcatctgtaaaatgacagttcttgaacttagtttatgagtgttagtaatatgctaaaatttcatcagtgctggatacttagcactgtgctaggtgctatactaggacttacttaaaaaggagtataacatagcgcttgacactagaatcttatgatctggttgggaaaacaagccacaaggagaaaaatagacaaataatactgggagtcatgtgattaaatgtaaaataagagactcaacagatgagaatgtgcgaaggttcttacgctcagcattttattgcgtcaatgattaactgccatttctgtaataaagtactagattaaactacctcctttgatgctatcaagaattcccgcttgataattcccactttcataatctgtataatgtgagtttaactccctttgttcactcacatgttaaactttaaaatagtgcattcctggtatatttaggtaatttgaaattggtaaaagatatatttttacagcatagtttttatccaaaatcctttctgtactctaacaccaagatatgttttttgttcttgttactgctatattcctagcacttagtgccagacacacagtgaacactgatgaaatatagttgagagacaaatttgaaattatacttaaccgtcagcaattttaaaatatttaaaaataatttttaaattaaaagtgattcaatttggaatactggctttttcaaccttggctctaactatgtgtgaggacaagttgccattctataaatataattttaatgtagccagtagctttttctttactagctttttcatacttgtataaggaaatggctttctagatgagtgaatttccctgctttattagttatctgttactgatttatgacagcagcttcatgggagaccttaagctagaactgcccagccaagccattcccaaattccgacccaaagaaactgtgaaagataataaatgttagaaatgtgaagttttgtgatatcacagtataaagactttcatatgccttacttgaagactgttcatcagtatatcaccctgaattctttccttctgagaaggagtgaagtactttaaaagaaaaagataaaatcaggccatcatagccaagttttcctagtcaaatagaaaagggttgtatttagccttaaaagattttataattgtgtaaaaccgtggctcatgcctataatcccagactttgggaggctgaggcgggaagattgcttgaggtcaggaattcgagaccagcctgggcaaagccctgagaccctgtctcaaaaagaaaaaaaaaaatttagctgagtgtggtggtgcacctgtagtcccagctacttgggagactgaggtgggaggattccttgagcccagatgttcaaggctgcagtgagttataattgtgccactgcactccagcctgggctctagagcaagacactgtctcctaaaaaaattataatagtaaaatagttcatagttcatgttcattataaaaatcaaaacaatgcagaaagcagatgggtgcagtggctcatgcctataatcccagctctttgggaggctgaggcaggaggatcacttaattccaggagtttgagaccagcctgggcaacatggtgaaaccttgcctctattaaaaatacaaaaaattagccaagtgtggtggcatgtgcctgtggtcccagctacctgggaggctgatgtgggaggatcgcctgagctcgggagtttgaagcttcagtgagctgtgatttcaccactgtactccagcttgggtgacagcaagaccgtgtttcaaaaaatttaaaaaaaaatgcagaaaagtaattagaagaatcttgtaaaaatcatttcaaatccggccacattttggttactctccttctgaaatctgtctatgtgtgtagatatacatactttcaagtgtcctttttccataagtggaatcatactatttccatgtatttttaaagctttttaaacattaccatgggtttagaatttaccaaaactccccttagtgctatatgacattggaaagatcacttacttgaagtggggatgggagtgggtaatactccccaaaagcacaatcaagtcaaaatggtaatctccagttagctgcaggccttctgttttgctgagaggaatatacagatttggggccaagagtcaaactcctcaaggcaacagaggaaagctcttttaaacccatgctctttttttttttaggcagagtctcgctctgttgcccaggctggagtgcagaggcatgatctcagctcactgcaacctctgtatcttgggctcaagcgattctccttcctcagcctccctagtagctgggactacaggcatgcacaccacacctggctaatttttgtatttttactaaagatggggtttcaccatgttggccccgctggtcttgaactcctgacctcaggtgatctgcctgcctcagcctcccagagttgttgggattacaggcgtgagccactgtgccctgcccctatgctcttttttgattaacagaaaaacgagcaccctcctcttgtgcaacttgaattttcacagtaaattaaagaacatgaccaaaccaattttagacagaggtaacttaagaagaggaaacagtttaatcttagaagaaacttgaggtacatggcactggcttgtttcctatacacctatttatcctagataatataaggaagatagaatgtaacatatcttaaatgatttgcccaacatttcattggaagacaagctgagtgccacttaggagaaagagacctactaatggcagctttcctctgttcccttgagcactttggctcttggcctcacatttgtagattcctctcagcaaagcagaatccctgcacctaactggagattataattttgacttgagtgtgcttttgggaagtattactcttcatacccctgtcccccattcccacttatgatattggaaagtaagtgatctttccaatatcataaaacacaaaggtgaggttttgtaaatttttcttctatcttttctgtgatgttttagtggcccttatagattggctagcccacccattagcctgactgtttccatagaagatttggttattatctcacactttgaactctccatttccttttccctaaacatgctcctttcctagaagtcttattcaataaatccatttgtctcatctccactgctgttaccctagtccaaggatccatcatctttctttcttttttcagatctaaagtggttattattattattattatcctacctgcattgggttttcagtcccagtgaagactgagaaacctggtgagaccagtaagcatccctggggggtaaacacaagactcatccacattgctcccagctgccctggccttcctacaacccttagaggtttgcaatccctgttccttatagccagctatgtagcgatgtctttccttaaatagtagagactttgggcagcagagctcctcatcccattccaggtagataaccacaccctgaaacactcctctccatgactgaaggtgagaggctgaggggaatggtctctgccctctgtgaccctgttcgttcctttccagcgccattcttgctctcatgcgcctgagtgtgggccttatctgccaggtgggctacactctgctcaactcccacatcacagaacactgtctcctcactgaagactgtgaagtgaatgtttactgaagcagcagcattattactgcaccagagctagaaaatggacaggcaaggatctctgtagatagcagagaagtaggtgataccatctacaaatgcatgttggttttgcaccatcatctttgttgactaaaatggtctcctccctggtctggctatgttcattttatctcttgtggtctttttttttttttctgtacagtaggcaaagtggtcttttaaaaacatagatgtttttactcttctgctaaaaaccctgctttgtgcttggcataaaagctgaatgaattgcaaccacttgcaggtccagtgtgatctgtcccttccttttgcccctctctccctcatttactgtgtcctaatcttttgcccttctctccctcatttactgtgtcctaatcttttgttcttctctccctcatttactgtgctccagccgcattgcccagatatatcaagatttcttccccagatgtaccaagcttgttcctgccttcacacctttgcaccagctgtttgctctgcctggaatgctctttcccagaacttggcatggtgggcccctttgtgttattcagttttcggatttcacctcctccagaggtcctctttgatcttccagtgtaaagtagctcttgcttcagtgcagcaccctgttttattttcctcatagcatttagcaatcctaaaccatctttatgtgtttgtctcttgtttatcgttttcttcttccctcactagaatttaagtaccatgagacggtagatcttctctgtctcgtcagtcctataatcctaacacctagagcaatgcttgataaatcttatctaaatgaaaaaaatcagtgaatgaaacacagagatagagaaatattttttttttcataaaactataatttgttagtcaacacataggaattgtacatatttatggggtatataatgatgttttgttacatatagtgtatagtaataagatcagggtaattagcatatcctcatctcaaacatttatcatttatttgtgatggaaacagtcaatatcctccttctagctatttgaaactatttattattgttaactctagtcatctacagtggtatagtacaccagaatgtattcctcttatcttgctataattttgtatcctttaacaaatctcttcctatcccccttagaaatgtaccttttaatacactgaggttgctggaaccagctgttgatgtagtaagggaggaaggtgacatggcagggcacaaaaacacttaaccagttctggttaaagtatataataaaaagtgtggcccaataatgagtgtaaccattcgggaaaaaaacaatttgtcattgaagaaggagtgagttattcaaacaaactggaatcaggttaatcctgacgatttcctgtacttcgaataacttcagtctttaagctgcatagttagataatttgatccccaagccccaaaaagatccttgattgtgaatggtgtttttcataaatttaaagcattgcagttgaatgcaatagaaaaggaaaaatcttagtgttggttatagggctcataacagcatgctcataatgacatgatgctcattaccgtcattagattgtacttcataatgctagaatttatgtgttttctgtagtcttttaaaataactactgtgttgtggggtagaaaagattacactaaaagggaaatatgatgcctctaaaatgtactctgagaaattttttttatattgaaaggaaaatgagaaagtattcttaaaacctgtgaaatataaaaatttgttaccattcaattactggtgcaacttagttgtttagtttataaactggtatttttattgacccctgaagataatgaggaataatcaacttagtgatttatgttaaacatacccttgttaaagtttctgttttttttttttttttcttttttgatacagagtctcactctgtcacccaggctggagcaaagtggtgcagtcttggctcactgcagcctccacctcccaggttcaaacgattctcctgcctcagccttctgagtagctgggattacaggtgcctgccaccatgcctggttatttttttattttttattttttgagatggagtcttgctctgtgcccaggctggagtgcagtggcaggatctcggctcactgcaacctccgcctcccgtgttcaagcaattcgcctgagttagcctcccaagtgagtagctgagactacaggtgcgtgccaccatgcccagctaatttttgtatttttagtggagacagggtttcaccatgttggccaggatggtctccatctcgtgacctcgtgatccgcctgcctcagcctcccaaagggctgggattacagatgtgagccaccgcgcctggcctaatttttgaatttttagtaaagatggggtttcaccatgttggccaggctggtcttgaactcctgacctccagtgatttgcctgccttggcctcccaaagtgctgggattataggtgtgagccactgcgcctggccactgtctggttctttttcacattcaaatcgttttggggaaaagtaatagtaaatctttaacgtggggtctgagttacttaaagccaaaattttttgaatttatttttaaatgactcttgcccttccaagttgccatgtagggaagttgtacatttatttcaactatgcatccatccgttaaattacttttataggttcttttttagaattgcttcacagccagttttggaattatgaaagaaaattagcctccttgctttcgtttgtaaattaaaactctcatctttttaaaacaaaatgaagacatattactttctcaattgacttcatattaatattttattaacttatgaagcccatgcagctgttatgcagttgaacttatgacttctaagataaaaattatcttgtacagcagatctgtgaagagcaagaaacattgtataactttgtgaaataatagattaaaaaaaaaaaaaccaggccaggtgcagtggctcatgcctgtgatcctgacactttgggaggctaggtgggaggaggatcacttgagcccaggagttcgagaccaccctgggtaacatagtgagacctcctctcttaaaaaaaaaaaaaaaaaaaagccaggtgtggtggtgtgcacctgtggtcccagctgcttgggaagctgaagtgggaggagcttgagcctgagagattgaggctgcagtgagcagagattgcaccaatgcactccagcctgggctacagagtgagaccttgtcttgaaaaacaaaacaaaaagaaaataccaaactgttgagacctggataactaccccccaccttttaaatttgcattttacttgaaattgagtatgcattgtgctttcctgcagatgaaagttatggtgtgccaaatctaaaggaagcactgaacctttgtggaaggaaagaaaaccatctggtaccagaaaaaggctaaaagtgggctcttttttgtactaacagaatgaaagctaagagtccatatttaaaatatgatcataaaactattcttattttacagttcttggcataagaatagacatgtgttttggataatatacctaattttaaaagtcgagatatgcctctttgagaaaagtagttgaagcacactgttgatgtttgtcgttagaacacatgtaagttttattgtgaaataaatgaattatttgttttaggacgagtcttcatgtcttggcttccatgactattaaaggcttttattttgttctgtaagccagtgttttaatctgttttgtataaagatcctgttttgtttagtatcataaacatgtgggtttttaaagtttgtttttaaaaaatcttttctttcttctgtttctgcattttttaaagctgcacatcattgactcctgggcccaactgtgaccgatttaaactgcacataccatatgctggagagacattaaagtgtaagtaaatgatgactattttactcaaaatgtaggttacagtgtcagctattggactttgtgctttagttttcatttccggctgttagttgttatctcctaagatattgttcactagcatttaccacttttcttatctgccattcaattctagtttgattaaaagtaaggcagttggcagggaatacgttgtggttaaataggcatgcacagaaattcctaatatttaggcatgcccggtaatttttatgtgtttttttctctataggcggcttttacgtaatactcaataaagagtccactgctttagaatacctggccatttcgaaacagtttttaggtaggagtggctgctgtccatcactgctgctaacccccctgtggaaccgctgcgccacgacttgtcactgatttatctcctgttgttaccgaagtgtaagagtcctacctcaaaaactcttggcatggcttaggcatatcaacatgttatctcctttatagcaaggatcagagatacaaacggtctacaagggctagattggtaatatagtgagggaaacaggctaggtgtggcaaactgggacgccctgtcacttaaggggagttacctttactgatttattgagagaaggtggacgtctgaagttttacctgaattctgtcagttttagatgttgctactttttcaaaattaaaaacatggagttggccaatattatgcaggctaaactgaatgtgtctgtgggctggcttgagttcctggaccataagttattgatcttggatggatagtatggaagatctgtcattggacttagcccatcagctacagcagccctctagactgtatcagcttttctctgtcactattaccaatactgaacctctagcctagtgtggaaatcacagtggctttggttggttagtgttggtaatctcaccaggaattttctctcttgaacctattcttgtggtgaacagcctattaaggtttttcctattcctaaaaagaaaaataaagtacatggatattaaacatggaacagatgggtaaaccgctttttgaccattggaccagtgtgttttaccattacatgccaggaggggccatgtctctgtatagtattttgtattcttagtactatattctgtagaatcacttgatactaatttatcaaatgcaagattaaatgagaaatgttggacatgctgacttgtcagccttgcattattagaccattttctggaaaccattaaaatataaaataattttacctgtctgaagtagtaggacagattcgactactttttttttgaaaaaattattaactaaatttaaaagaaatgatcaaagtaaataattcatgtggttaaaaacgtaaaagtactggaattttttgatacatgaaaccagtagtcttctctcccagtccagtttcctgagagaatcacttgcagattctaaaaattttcagtttagctctctggggatgatctccatatctttaaataatatacttttgcctccgtttcttgccttatcagttttagacattgttatcttttgacttcctgcgctgatacatgaagcatcagcctgttttccctatgccccttaactctgttttcttttccttcttaatgtagttatatcaccattattggttcctgtgttggttaccctgtagcttaaaaatttttacttactttttttaatggatcactttagacattgtattacacagttaatgaataacccctaagaattcttagtaagtacctggtacctggtacacagttagcttcgttattacttaaggacaatctctaagcaagaatggtgaatacttagggtagtatattctttagttttacattaaccatagatactgtgtcttttgcctctgcattttatgagatgaatatattagcccctgcccttccttcaattcctcttccttcacctcccagcttttgtctttggttattttccttttgcattttcaagattgttaacttactgtccgttctaaatctgtagttgtcttctgtgccttgcctataaattgcttgaacgattgctctggaggcctgttcctgcataattatcactgtgagatttgcctttattacttttttgaatttgaccttgttttgtagaatctatgtatcgtagattctatgttttgtagaatgatttcttgataaacaggttacctacttatcttgctggcacccattctcaaataacttgctcagattctattcctctttctacccttctgttttcctttagcccatccgataattttttattactacagtcacaattaggtatcttaatttctaggaactctttcttgcactgtttctcattctcagcatcttgttcttattttatgaatataggtcctttaaattccttcaaagaataaaatttagagattcaaaaaaaatgttttcttctgttatctgaattattttaattttccctagggattatatttttgtttatcatattttttccctcttttatgctatagtttttcttcaaataaaaggtattcatttctgtttaagatagacaataaaatagtgattgggacttctgagtaggtgagcaaggcttatggaatgtgtggatgaatgatgggccagatgtgagtcaactgctctagctctcctcaaatagtttgttctatttcttcattgaatacctgggcatacatacctgatcaccctgtcattttcagggggtacgtatatagactattccgtgaggagcttttgcttactcttcctgttcttagccctgtgtctcattcttgcctccccttacactggataactagaaacttttatgggtttactaggacagatggcttcctcctcatcagtagcctcttcctcacattattacaggtcaaagctttcctctgccctatcttgtcaagtactacacttccatctgcattctgtctctagcaatttgctaaactttctcatctactgattaactactctcctcccttcctcttcatcttcctgttgtttgggattttatctttctgtattcactatcatttaacgggattggagggggtcttagagaagaaatgagtgtgtgtggtcagtccacagtcttgagacaaaaataatgtgacttcacaggcatctttctagtagcatgggtttatgttaggaagcatttgctgttaccctatatcctctcattactataagctcttcatgggaaacctttaataacatttgtgattagtgtattaggactgtcactcatcatataacataattatattctagcaaattattgttggatatcgtcattatacattggggacttaatttagcccacagtatgctctataataaataaataataagtgaacattgtataatggcaattcttatgctaaaatgagtcaagattctagtgttaagcagctcacagccaaataaaaggaaaaggtaattgatcatggaaactatatttataaaagttcatagaattagaaagatgagttttttttttaaaaaacacatatatatgtatgtatatatgtatatatataacatacacatatatatacacacacatatgtgatcttggctcactgcaacctccacctcccgggttcaagcaattctcctgcctcagcctccggagtagttggaactacaggtgcccaccaccacgcccggataatttttgtattttagagacagggtttcaccatgttggccaggatggtctcgatctcttgacctcatcatctgcctgcttcagcctcccaaaatgctgggattacaggcgtgagccactatgcctggcttgtttttttttttttttttttttttgagacagtcttgctatgttgcccaggctggacttgaactcctgggctcaagtgttcttcctgcgtcagcctaagtagctgagactacaggcacacaccaccatgcccagatcttttgtccttttaataatacagttatccctcaatatccatgggggattggttccaagatgtcctgtgcaagtccctgatataaaagggcatagtattcacatataacctatgcccatcttcctgtgtacaggcaaacctcattttattgtgcttcaacaaggatttttttttttctttgaaattgattgatggtttgtggcaatcctgtgttgagcaagtttatcagggccatttccccaaagcgtgtgcttatttcatgcctttgtgtcacattttggtaatttttgtaccatttcaaactttttaattattatttttttaaacttaaaaatttttgctttctaaatcatgaagcgtttccacatactttttcattattattctgttatggtgatctgtgattgttgactcttgaatgttactattgtcattgtgttgagatgccataacatacatacccatataagatagtgaatttaatcaataaatgtgtatgttctgattgctgtactgatcgtcctttttcctttctccctcttcttgggcctccttattccctgagacacagcagtattgaaattaggccagttagtaaccttgcagtgtcctctaagtgttcaagtgaagagtcccacacctctcactttaaatcaaaagctagaaatgatgaagtttagtgaggaaggcatgttgaaagctgagacaggctgaaagctaggcctcttggccaaacagttaaccacgttgtgaatgcaaagaaaaatttcttgaaggaaattagaagtgctactctagtaaacacatgaattataagactgtgaaaaaattattgctgatatggagaaggttttgtttgaatgaaagatcaaaccagccacaagattcccttaagccaaagcctaatcaagaacaagtcctaattctcttcaattctaagattgagagaagtgaagaagttgcagaagaaaatttgaagctagcagaagttggttcatgagatttaagaaaagaggccatttctatcacacagaagtgcaaggtgaagcagcaagtgctcatacagaagatgcagtaagtaattcagatctagctaagatcattgatgaagtgctacacttagcaacagatttttagtgtagatggaacaggcttatgttggaagaagatgccgtctaggactgtcatagttaagaaggcaatgcctggcctcaaaggatagactgactttctgattagggacaaaggcagctagtgactaatttgaagccaaggatcatttatcattctgaaaatcctaaggcccataagaattatgctaaatctaactccgcctgtgttctacagtagaataacaatcatctgtttacagcacggtttactgaaagccactgttgagaactactgctcagaaaaaatgattcctttcaaaatattattgctcattgacagtgcactttgtcacttgagatgtgttggaaatagcaagagaactagaattagaagtggatcctgagaatgtgactgaattgctacaatgccatggtaaaacttttactgatgaagaaggttgcttcttgcagataagcaaagaaagtagtttcttgagatcgaatctacttctggttaagatgctatgaacattgttgaaatgacaacaaaggctttagaatatttcataaacttagttgataaagcttcgccagggtttgagaggattgactccagttttgaaagaagttctactgttgagtacaattctatcggacagtatcttgtgctatagagaaatttttcctgaagggaaaagtcgattaatgtggcagacttcattgttgtcttattttaagaaattgccatagccatgccgcccttcagcaactaccactgtaatcagtcaggagccatcagcatcaaggcaggaccctgcagtagcaaagagattgtgacttggtggaggctgacatcattgttagcattttttagcaattcagtattttattcttatttgtatttttattttttggtatttttgttttgagacagggtcttgctctgtctcccaggctgaagtgcagtggtgcgatcttagctcactacaacttctgtttcccaggttcaggcgattcttctgcctcagcctcctaagtagctgggattacaggtgcacaccaccatgacccagttaatttttatatttttagtagagacggggcttcaccatattagccaggctggtcttgaactcctgacctcaggtgatccacccaccttcgcctcccaaagtgctgggattacaggagtgagccaccatgtccggccgcaatacagtattttaaaatcaggtattatcccatctcacaccagttagaatggcaatgattaaaaagtcaggaaacaacaggtgctggagaggatgtggagaaataggaacagttttacactgttggtgggactgtaaactagttcaaccattgtggaagacagtgtggcgattccccagggatctagaactagaaataccatttgacccagccatcccattactggatatatacccaaaggactataaatcatgctgctataaagacacatgcacacgtatgtttattgcggcactattcaccatagcaaagacttggaaccaacccaaatgtccaacaatgatagattggattaagaaaatgtggcacatatacaccatggaatactatgcagccacaagaaatgatgagttcatgtcctttgtagggacatggatgaaactggaaatcatcattctcagtaaactatcgcaaggacaaaaagccaaacaccgcatgttctcactcataggtgggaattgaacaatgagaacacatggacacaggaaggggaacatcacactctggggactgttgtggggtaggggcaggggggagggatagcattaggagatatacgtaatgctaaatgacgagttaatgggtgcagcacaccagcatggcacatgtatacatatgtaactaacctgcacattgtgtacatgtaccctgaaacttaaagtataataataataacaaataaattaaaaaaaataaaatcaggtattatcattttattttagacataatgctattatacacttaatagactatagtatagtaaatataactcttatatgcactgggaaaccaaaaagtttatatgactttgctttattgtgatactcgctttattgcattggtctggaaccaaacccagaatgtctttgccttatgtttgtactttaaatcatctttagattccttataatgcctaatacaatgtaaattctacgtagatagctgtgatatggtattgttcagggaataatgacaaaagtctgtaaatgttcagttcagatgcagtttgttttttgaatttttgtttttagagacaggatttcaccatgttggccaggctggtctcaaactcctgacctcgagatctgcctgccttggcctcccaaagtgctgggattacaggcatgagccaccgcacccagcctgttttttgaatatttttgatcaactggtttgctgaacgcatggatgtggaacccacggatagagagctgactgtagccattgtgtaactggagtgagatgatatctcattgtggttttgatttgcatttccttgataattagtgatgttgaacattttttcatatactggttgaccatttatatgtcttttgaaaagtgtctctttaggtcttttactcatttttaattggattattttcttctatttagtggcttgaattctttatatattccacatattaacctcttgttagatgtataatttgcaaatattttctcccattctgtaggttgtctctgcagtctgttgattgtttcctttgatgtgcagaagcttcttagtttgatgtaatctatatatttttgcttttgctttctgtatttttgagagcttttccaaaaaattcttactgagaccaattgtgacgaggcatttctcctatgttttcttctagtagtttcatagtttccgatcttacgtttaactctttaatcctttttgagttgatttttgtatatgatgaaaggtaagggctagtgttactcctcttcatgtggatatgcagttttcccaacaccatttattgaagagactgtcctttctccaatgtgtgttcttggcacctttgtcaaaaatcagttagctgtagaagcgtggttttatttctgggctttccattaattttagcaaccttaaatctattgtatacaagatcagtaaggtcatagtgtttaattaccacaatatttgtgatagaattcagcctcctacaatcaacataatattcgtctttagatgaacaaacacttctcagcaacacacattttaacaaatgtagtattctaatacaaacacacttaattgaaaggttatatagttttacagactcttggaagataactatcacagcaaacagaaaaggtctttgccttttttttttttgagacagaatctcgctctgtcccccaggctagaatgcagtggcacggtctcggctcactgcaacctccgcctcctgggttcaagcgattctcctgcctcagcctcctgagtagctgggactacaggcacgtgtcacaacacccagctaatttttgtatttttagtagagacagggtttcaccatattggccaggctggtctcgaactcctgaccttgtgatccgcccgcctcagcctcccaaagtgctgagattacagacgtgagccactgtgctcggccagctctttgcctttttaaagaaacagacctctaaggaaacctaattatactgtaagaggaaaatgagtaagtatagatttaaattatattctacggtaaataatagataaatattctctaaccttctcctttttgtttccaagcaaagggtaatggctaactcagtgctttgcagtcttaacatttttatataaacaattttttaaatctaaagtttctcattaaatctcattgaaaacttgtggtgtatggtttaaactatagttatttatttatttatttgagaccaagtcttgctctagcaccaggctggagtgcaatgtagcaatctcggctcacttcaacctccacctcctgggttcaagtgtttctcctgtctcagcctcctgagtagctgggactacaggcactggccaccatgcccagctaatttttgtatttttagtagagacagggtttcaccatgttggctaggatggtctcgatgtcttgacctagtgatccgcccacctcggcctcccaaagtgctaggattacaggcatgagccaccgcgcttggccagtttaaactatagttctaaccaacgctgaatcaaagtattcagtaatttactagaacttacagtaattttatttcataacttaagctcaataaagttagagatggagactgttgtgtttattaaattaaatctttagtctctagcacagtaaagatattcaattaaatatttgttgaagaaatagaatgaatgcatgcatgcataaattaatgaatctttagtgttcagattttcgttggttgaagtatgtgttataaagaatgtggcattctgttgtatcagccttttgccaacagaaatttgatctttagaagttatttattatacaaggaatttgtaattggaacattgctcttaacaattcagaaaacaggaagaatgtacagtcatttgcagatttggagtctgaatcaattttatctttatatattttactctgccctctgcaagcagattaatgaaaatagcatgtaactaaacttatttttcaaaatattttatgtattggaaaatagtacttctgtaaatctgtttcattgtaagtaaaggaaactgcagttaatgagaatgagaatgagagatgagagagggcgtatttctactcactaattgattcttacagaattatccccattcaaagttaaataattgaaataaaaaagatcagaagattatagtacattaggaatgatattattgtttcctcaggtcttttactgtgaagagacaattgttggccagtaaaagagttgccaatttgtataagattctattgaaaaatgttaaaggatatcctaagtaaagagaagtccttgaatctcacaattgcagaagacacaactcctcctgcaacatattctattacttaaatgatattggaaatgtgaatcttcagtgatcaagattgatttaaatgaaatacacgttaaggtctaggatggtgcaactgaagtggctgaaaattttccagctatagcagctattcacataaaaagagccatgagtgtcatataaacacctgtttgtaaatatagccatcctagtcatactctgtagcaattaactctagaagaaattattccatttgtgtttttgtgtactgtatttaaatagggcaaagagtgagcctgtttgctcatactttattcccaatctctagttgagtatctggcatttagagaggtttaataaatgtttgtggaaagaatgagccgtgttcattctttggatctgacaacaatgaggtttgataggaagtgacagaacttaattctgccagttctttgaataatgctgtttatgcagctttgaagagagattattgaaatattgtaagttatattgagcaagtctgtggctagtaaatcaaacagtttgctaacattggttttacatttgaaattatctgtggtttaaacaatttattttaatcaggggctgttttattataagaaacccactggaactaacataaattgaagaatttatttgtctttgtaaggaatcaagtaaagcctatgatgcccaagggcagaaaggacagccaggttctcagggactagaaccgggaactggaaggctggtagacatagtcgccagtcagcatctgtgtccatgtttgtgtctttctcctgcaacatattctattgtcactgtattctaaccgcccctccaccccaaccaacccccgacttctgtttctccccacattgggtagaaatgacttcctgagcccctacatgaggactcaattcaaggccaccagagaggttgtcattgagtttaaattcctgggagagaggatctgattggcagcttgggccaagtgaccacttgtgatcaagttatatggccaggatttctgggtcatgtattatcaacctgattagtagaggttagttttaacacaagataagataagcatagcctggcagatacccagaaaggtatctattaccctgtttcaggaattctttctaaagaatttccaaatgaaaatgtagacatttttttgtctttaacaatagagcagccaggcgcggtggctcacgcctgtaatcccagaactttgggaggtcgaggcgggcagatcacaaggtcaggagttgcctggccaacatagtgaaaccctgcctctactaaaaatacaaaagattagctgggtgtggtggcgggtgcctgtaatcctagcttctcaggaggctcagtcaggagaatcacttgaacctgggaggcggaggttgcagctagccgagatcgcggcactgcacaccagcctgggtgacagtgcaagactccgtctcaaaaaaaaaaaaagagcaatatagttgtttatcatctgagaggaatgatggatatttcaaagctgtttgtgacagagtgaagaagtcatgtcaagaaatacccaaaggttttgaagttgatacacttttcctttcagaggaaaaagtcagaaaaaaatcaattgtgatacgaataatatattatcttctatgtcctcagagaagcagtgtaaaattactgttcatttttaaggattccatactatatcactaaatttaaatatatattttttgagaatgattaaaacaaaatgagaacagtttcagaactgttacttaaatggaatgtaccatttaattaaatagtggccaaacagatgcatagatttttacagaaacattgcacataatgttctggagcttctactttaatgaatctacctgaaattcaacttcatttttgatctatgtctccttgagtgctttggctgctgcttttgtgtgtgtgtgtgcttgtgtgtgttttaacacagtgcttccccatctccgatctattacatattaatttgttctagctaatcagcttaataaactgagaatgctgctcattacttatgtagcacaatgcagagacactgtggggcttggcatggatgactgtcaaacagaaactgataaccaaactgatggcgcctggaggacccagtggtgttgcgaagtttgttgttgcatcagctgaaatagatattgagactttattgatttatctcatctataagaattttgcactttctttgctttgttataccgtgctattattttattttattttatttatttttttgagacagggtctcgccatgtcacccagcctggagcacagtggcgcgatcacaactcacagcaacctctgcctccctggctcaagcaatccctccacctcagcctcccagatatctggtactacaggtgcacaccaccacacccgctaatttttgcatttttttttttttttgtagggatgggtttatgccacgttacccaggctgatctgaactcctgggctcaagcagtccatctgcctcagcctcctgaagtgctgggattacaggcatgagccattgcacccggccttggtttcttaatgtaataggctgttctttaattgtttcatagcctgcctaccaaccccatctaagtgaaatattgttggcagggcacctgataataactgttttacttattctttcttaaaaaatttatttatttatttatttatttatttatttatttattaagacagggtcttgctttgtggcccagcctggagtgcattatagctcactgcagctctgacctcactggctcaagtgatcctccaccctcagcctcccgagtagctgggactataggtgtgcatcaccatttttttgtagagacggggttttggtttcacttcattgcccaggtgatcttgaacttctgggctcaagctatccttccactgtggcctcccaaagtgttgggattgcaggcgtgagccactgcaccttgcccataccatacattttgaaccttggccgctaggtccaaaagctggccgttgtgactatagctgttggcatttttgttgggatgacaatgttattttatttaaaatttcttgtactatttaaaataatctgtttggaaaatgttaaccaagtaatctttctgcttccacttccccttcagtattttagtggactgaatctctcagcctggcattcaaggccagtcacagtgtgacattccagcctcccagttagagctcagctaacaacaagccaagtcagaaagctgctctgcaagactgatttgcccattatacttcccaaataccctgccttcctttcctgcttctgcttttgccacactgttttggctttagcaggacaaaccaaggaataataaaatagcctgtcttgtgatgtatttggtttttcattcgcgctcacaaacctgccactctaatggaagtgctctctatttaggaggctccctagaccagttctcttctagtctgcaagaatgcttgcaaggagagtaggagttaaccatttttactatgacttgcaacagttgagctaagtaaaaagttggatgctgtctagggacttagtattttgcatcatgctgagaggcataattttacttttatttttgtcttttaaaaagattcatttacttaaagattgttattatctagcatttaaggtatttttagaggctaattgtggaggcaggtcacctttgatttagtgaatgttctacaaaatgctcattgaaaggcaagtaaagagtgctaattttctggattagacattctctctccttagatattcaggattcctttgtcttggagttttagaatattttattttcttggaattcatgggttagaagaaatatattaggaatagcaactaatattattaatttaaatttataaagtcagtttaattatagctatgtattatatataatctgtctttggtactgattatagtttattaaaaatgactgatatgattactaaattaacttattgggcattttatggttaggcttatttacatgcattattttattttatcgacacaataactcttaggtcagaatttatatcccactctttaatatcaattttattgaggtagtgtaatttacatataataaaatgtacccactttaagtgtacagttctgtgtgttttggcaattgtaaacacttaaaaccacaccatagtcaagataaagaacatttccattccctaaaggtatagaacatttccttacccacacaaatcggtcccctccaccaccttcctcttaaccctgagccttttcatttctctaaaactgaaacagttttgcctgtttagaattttatataaatggaataatatattatgtagtttttggtatatggcctctttcagtcagcattatgtttttgagattcatccatgttacatcagtactttgttccttttattgctgtatagcactacattgtatggctgtaccacagttttttatttattcatccattgaaggacattcggatttttttttctattttttggctattatgaataaacttgccattacatttttgtacgtgtctttttctggagatgtgttttaatttttattgggtaaatacctagcagtagtattactgtgttgttagctgagtgtatgcttaacttttaagggctaaactgttttccaaagtagttgcactattttacattcctgctaacaatttatgaggttctagttcttttacagtcttgccaacatttggtattgttgatccattagtttttctatattcttgccagtattggtattgttgatccattttgagctacctttttttcttgccaacattagtattgttgatccattttgagctaccttttttttttttaaagacagggtctcactttattacccagtaataaaaagcctgtggtgtagtgtagtggcacaatcatagcaatcatagctcactgcaaccttgacctcctgggctcaagcaacccctcctgcctcagcctcccaaatagctgggactacaggcacatactaccatacctggctaatttttattttttattttatttttgtagagacggggtttcactgtgttgcccaggctggtctcgaactcctggcctaaagtgatctttccaccttggcctcccaaggtgctgagattacaggcatgagctaccatgcctggcctttgagctacttttgatcatatatttgttaattaacaatttaagtgtgggtctatttctggactttatgttgtattcccttaatatgtctatccttaagtgaatacaacacgatcctgactactgtagctttataggaagtctttaaataaggtagtataagtcctgtaacttctttttcaaagctgtttcggatattctaagtcctttgcatttccatagaagttttagaatcagcttgtaattgtttacagaaatcctgctgggaatctgtagatcagtttgtagagaattaacatcttaacactgagtcttccaagagataaaaatgctaacatctccatttatttaggtcacttttaattgctctgagcagtattttatagttttcagtgaatatatcttaatccaattttgttaaatttacctctaaatatatcatactttctgatgccaatttatagtagtgtggtttttttttttttgaactttgttttcctgaactcattgaaatgtaattgattttggtatatttaaccttgtatgctgatgctgctatgtccctaaatttacttattaattctaataatttttttgtagattccttaggtattttcttcaacacatttgcttgtgaaaaagatagttttgtatcttcctttccaatctatataatttatatttctcattcttgttttattgtactatctagtgcagtagacaatacctaatagccagtggcaggtagaagtggtgaagtcagaccttcttgccttattcgcagtcttaagaaggtagttagtctttcatcaggtgtaattgtcagttctaggtgcctttttatcaatctaaggaagttcccatctattttagtttgctgagagtttttattatgaaaagaatgttaatatatgttaattttttttctctgtctacttggtttatttcttttattctgttaatatgataaataaactgattttcaaatgttgaaccactgttgcattctgcagattaattccgcttgattattatgtatgatccttctgatgtattactggagttgattcactcatgtctttttaaagaactttgcatttctgtatttgatgctgtatttcttttctttacttttagttctttgcttggttttggcaccagagtaatgctgtgtttataaaataagttgggaagtattcagtcctctgttttctgagtttgtgaaagattgattttatttcttcctgaaagcttagaaggttagaattcaccaatgaagccatctggacctggagcgagatagagagagagagaaagagaggcgagagagagaggagagaggagagaagagagaggagaggagaggagaagagaggagagagagagagagcaagagagagagtgagcgagagggaaggtttttaactataaatgcaatttctttaacagatatagggctaacaggtttttaaattattcttaagcgagtttttacagccttgtcttttaaggaatttgttcatttcatccaagttgttgaaattattggcataccgttattcatctatttcctccttattcttttactgcctgtgtgacctgtactcatttcccctttcatttctgacattggtacattgtgtcttttctctgctttccttgatgaatctagctagaagattaacaattttatttttttttaaataaccagctttttatttcatagatttttctttattattctcctgtatatttcattgttttctgctctttgtttatgcttgaaaatgtctaccttttaaatggagtgtttaggtaatttaatctttaacctgattgccactatggctggatcttgctgtttattttctaattgttatgtcatctgtttttcatttcttttactgccttcttttggattaattaatattttaggattttattttgtctctactgttggcttctgagctatatgtcattgtttgatttttttcccccatggctgttctagtgttcagaatacatatctttaacttttcacagtctaccattaaaaatactataatacttcatttatcatgtaagaacctaacaatattatatacttctttttcccctactcaactcctctggccatccttttctgctattatacatttcatttctttatatgtgataaattgtctttagcaaaatgttcaaaccttttgcctttttaaaaaatggattcttatcattgagttttgagaattcttcatatatttaggttacaagttttttatcagatgtatgatttgcaaatattttctccctgactgtggcttgtctttttattgtcttaacgaaactgcctaattccatgccacaaagatttttgtactatgttttcttttaaatgttttatagctttaggttttatgttcaggtttgtgatccattttgagtttatttttgtatacgatacaggtttttaaaaagtatggacatccacatattctagtatcatctgatgaaaagaatgctctttctcttttaaattgcccttgcacttttgtcaaaaattaatttcccacatatgtgtgagcatttttcttaactttctagtctgtcctgtaggtctatatatctaactttatattgaaaccacagttttgattgctgtagtttgatagtaagtttggaaatcaggtggtatatatcctccaatttttattccttttttttccaaaatggtttggaaatgttagatttttttcatttctctataaaatttggaatcatcttgtcaattttttagttttctatgttattagtattccatgtacaggttttgcacttctttttgtttattaaatatttaatatattttgatgctgttgaaaattatattttttaaattctaaatttctgattgtttattgctgatatatagagatacagttgatttttttttttatctattgatgttatatccttggtaaactcaggtttgagttacagaagtttgtctgtagactccataagatttcctacatagaaaattatgccatctgtgaatgacagttttagtccttcctgtctaatctgaatgccttttctttctttcctgccttagtgcactgactagaatctccaatattttgttggtagaaaagtgttaaggctgggtgtggtggctcacgcctgtaatcacagtactttgggaggccgaggtgggtggatcacctgaggtcaggagttagagaccagcctggccaacatggcaaaaccctgtctctactaaaaatacaaaaatcacttaggcatgatggcgcatgcctgtaatcccagctacttgggaggctgaggcaggagaattgcttgaacccgggaggtggaggttgcagtgagctgaaatcacgccactgcactccagcctggatgacagagtgagactccacctcaaaaaataaaaaaaaaagttttaagattagatattcttgccttgttccagattttaggggaaaataattctgtctttcaccattaagtattaatattatgttggctatgtatttttcagagatgccctttatcagactgatgaagtccccttttatacctagttagttggggattttttgttttgtttagttttttaaaatcaggaatggtcagccacagtgttgtcctgtggggaagggagacagatttgtaaaaccaagagctaaggtctgcctaccccagcctgctgctgtgcgaagactctcaggggaagccactgtcaccatgtctgaccagcagccaaaaccttcaacttaggacttggggaataagaaggaaggcgagtacattgaactcaaagtcactggacaggatagcagtgagatttacttcagtgaaaatgacagcacatcttaagagactcaaagaatcatattgttggctgggagcggtggcttacgcctgtaatcccagcactttgggaggccgagacaggcggatcacctgaggtcaggagtttgagaccaggctggccaacatggtgaaatcctgtctctactaaaaatacaaaaaattagccaggcgtggtgatgggtgcctgtgatcccaggtacttgggaggccgaggcaggagaatcgcttgaacccgggaggcggagattgcagtgagccgagatcgcaccactgcgctccaacctgggcgacagagtgagattccgtctcaaaaaaaaaaaaaaaagaatcatattgtcgaagacagggcatccagtgaattcactgaggtttctctttgaaggtcagataattgctgataatcatactctaaaagaactggggatggaagaagaagatgtgatttaagtttatcaggaacaaacagaaggtcattcaactgtttagatattcttttaatttttttcttttccctcaacccttttttatttttaaaaatagttcttttgtagtgtggtgttgaaaagggaattgaaaactggcacccatctctttaaaacatctggtaatttgaattctagtgctcattattccgtattgtttgttttcattgtgctgttttttggtgatcaagcctcagtccccttcctgttgccctctcctttttaaaaattatatgtgtgcacagagagaccacctttttcaggactgtacattttctggcttgtggagataaataagattaaccaatgcaagtgttcgtaatgaatttccagttggccctgaagttctagattcactcctagacttccagcaggagacggatgtttttcagagaaatcaactgtggaaaaatgacctttccttaacttgaagctacttttaaaatttgagagttgagaacaaaaaatatcaggttgaagtcaagatgacaggtaacatgaaagcaataactaactctaaagatggcttcagtgaagaaaaggcattttaagattttaaaatatcttgtcagaagaacccataacagttctaattttcattagcaattaataaagttattaatgtagaaatgactaccacagaaaaaaatcaacaatggatgttagattttggcagatacttatcttcatctattgagatgatcatgtggtttttctcttttaatgttattaatatggtggttttcattcattgaattttgaatattcagtctaccttgcattcctgggatgaactgattgttttgatgtagtgtcctttctctatattgttggatttaatttgctaaagtttttttagagtttttcatttatattcatgaatgatattggtttgtagttttatttgaatgctttttcctatttttttcctcatagtaaagctggcttcagaatagaatgagttgctaagtgaacccttttcttcatttttttcaaaggtttgtgaagaattcatattatttcttccttaaatgtttggtagaatttgccagtgaaaccatctgggcctggagttttctttgtgggaaggttttaaagtacaaattaaatttgcttaatagatttagatctattcagattatctacttcatcttgaatgagtgttgctgatttgtgtctttaaaggaatttgtccatttcatctaagttgctgaattgattgacataaagtttttcataaattttttttattcttttaaaaaaatgtgtaaaatttgtagtgatgttacctctgtgtttcctgatcttggccattcctttctcccccgcaactgttttctttgccagtctggctagtggtaaagaaaaaagtggtaaacatttactcatgttgtggaagaaccagcttttggtttcatccatcttctctgttgtatttctgttttctgttttattgatttccattcagattttaaatattcttttactttcacttgctcttcttttcgtagtttattaacatggtcattgatttgagatctttcttttttcctaatattggtgtttaatgctataaatttccagctaagtggtgttttagatgtatcctacaaattttgctgtgttgtgtttttattttcactcatcacatgttctgaatttcccttagattttttttgacctatgagttatttagaaatatgttatttggtttacaaaattttctggatcttttattgaatttgaatttaagtttattgtggtcagagaacatactttgtatgacttacatccttttaaatgtattgagatttgttttatggcccaggatatagattattttagtacatgttcaatgtacactgaaaagaatgtgttctatttttctttggtagagtgttccataatagcaattaggtcaagttggttaatagagttgttcaaatgtgatctattgttactaattttctttttgttattttagttttcaattttttcaattttttatttttccgtaggttattggggaacaggtgatgtttgtttacatgagtaagttctttagtggtgatttgtgagattttggtgcacccatcactggagcagtatacgctgcaccctatttgtagtcttttatccctcgccctattttagttttttaaagagagatactgcaatctctgactataattatgggtttatgtttaaatgtgtaccatatctttattgagcttctgcatcattcttctatcaattattggaagaaggatatggaaatcacaaactataattgtggatttgtctacttcttcttgctgttctgtcattttttgcttcatttattttgaagctctgttattaaatttgtaaacatttaagaatgttatgtcctcttgaattgacactctttgtccttggaaatgttgtttgccttgaaattaattttacacggtacatcttttccattgttttatttttaacctatttgtgtctttagatttcttttgagtagcatataattggattttacttttaaatctgacagtctttgcctgtcaattgggatgtttagaccatttacatttaatgggattattgtgtgctggattgatgagtctacatagtgtcaagaaatgcttacatttctattagttatctttgtatttcagagtgattccctttttgcaagtttatggcactggtaatgctgtcttcatatcagaaaagacaggacacatactttttcagagttggtaaagcagagatttaaaaattctggcctggcctcataatgaagggtgtttaggaaactaggtgcttaatggaagtatccagagggcaccaatgtatttatgtttgttttgaactattctttttctttattattctggctcttaagggcattgaactgttctcatctctgggatatttgagacagaagttggcataagaccttttgggacatattatgggtgctccaaatgttacaggcactccagaccagtttgggatgcatagcaggcttcatgtagcattatccgaccactgatctccgttgattttcactaggtctgcttcaggggaaacaattgtgtattgaaattaaaaagcaagacttctgtctgatataaacagcctaattcttcatagaataattcttttaatactgttcccaggctgctgtcaaacctccaatttattgaaatctttcttcacattccagagttaggcaagataattaacttttgattctttagccagttctatattggcacgtgaaaaagaaaaccagtagtggctctacccttcacacttctctctctctctttttttgaaacaaggtcctgctgtgtcgctcaggctggagtgcagtggtataatcttggctcactgcagactcgaactcctgagtttaggtgatcctcctgagtagctaggactacaggtgtgtgccactatgtctggctaattttttattttttaattttctttgagacagaggcttgctctgtcgcccaggctggagtgcagtgttacaatcatggcttactgcagccttgaactcctgggctcaagcagatcctcctaccccaggctcccaagtagctggggtgggaggagcctgagctcctcgcctggctaatttttttactttgtatagagacagggtctacctgtgttgcccaggatggtcttgaattcttgggctcaagtgatcctcctgccttggcctaccacagtgctgggattacaggcatgaaccaccgtagtgacagagtctctatatgttgcccaggctggtttcgaattcttgggctcaagtgatcctccctcctcggcttcccaaagtgctgggattataggcatgaaccaccgcactgggcccacacttctcttttgataccatctacattaatatcattaccaacgatctcaccaaaaaaaaaaaaaatatttctttttttctgcctttggctacagggctagctcgtaaaaggaagggaacaaaatgtttaagtatgatcatgtttttagtgatggaaaattaaaaccattaaaaaataaacaatgaaaaatatggcaaaataagaaggtgaatgccagaagattaaggaagttctagagagttttgcagatgtgggatttcagatgaagaccagatacatctaatttgtgaggggaataaagagacaggtaagagagatgggtgggaatagagctagcctgaggagaaagagaaggagattaaaaacaaaattcgtatccagtctgaataaaatttgtttcatccctccttggcccttagaaattagagtcttttcatattattgtctttctatttggtaagctgtgtttgatagcggtgcacaaacttgggcacagaagcctgagtttgtggggttgcattcagtgtatagaaaagttacaactcatttctagttagttcttcctttgtacttatgcctaaacctctccatctggagaaatgccagcttgccactaaatttaaataaataagaacatgtctcatcaataggggcggcaaatttagcccctctttagagcactgagcaatttatgaccatatgttaaataccataaaacagctttaaagatttggtcgctggccattgccagattgcaccgtaggagtgcagcagcactgtgagggactgggaatgcttcctccggcccttggaggcctcagcaactcactgatgtcacagccaaagagggctgttttcaaacattccctttataaaggtgaaatactaaaagattccattttggcatttgggagcaaagaaggcaagacttctttttgattcttaagggtcaaaattagtatggaaagtgttgtgtgggagaatgagtaacttggcagcagtgagtacagaaggcaagtctagaaataggtaatagatatcctactcatcctttttcttggagcatgaactggacttttatgtggcataagccgaccaaatatcacgtttctcaatcaatttctttttgccaactttcgtcgaattaatattaatgttaaaaacaatttttaaaatttcatgccaaagcattgccaattgtaaggctttcttttcttccagaaatatgactcactatttggtgaactccaaatattagtttttcttcttaccaccatgacagcctgtgaatcatttatggcattcagtgggctcgtggctgagagaatgaaggtgtgtgccagcaaacatgtgatttttggtcaagtagtgctctgggaccttcgatgggcttttaacacatgtgaggaaaccagtggttcaggcagggggcagtattattaaatagtaatagacaccaaaaagctttgtacaagatttttcagactgctctctcagaaatgtaactcttcctacaaaggaagatgatgaaatttggctgtcaaaggtccaggattcctagccttcttgaatctgtagttgccagcccaagggctgatttcctgtcagttcctgtgtggtttgcactacatcctctttgcaacagatcagtattttaggtcatccatcataactgctctcctgtaagttcttggcaatttgatctcagtttgcagaaggcagctggcatactttgctaggaagtgcagctggagagctcctgtctcactcttcctaaggccaggaagcacactattgttactcattgctgctttcttcctttaaagaacaaaaaacttcaaactttggcaaattctaaagttactaggtagcaatttgaaattactctgatcgttttgttggtctagggcaaaaacttgagtgatcttttatatcatttgtaaatcttgtctggtttttccataacacagatatgtgcattagtggaagtttcctccccattgcaaatgaagttatgcttgtcttcagagtcacacgggaatttttagttttattttgttttaggctttgattgtcaaggacagtaacatggcctaatttcttctctgtgttttattcccttaacattgagatttttctattcctaatatcagcattgggtaagactatttaccttgggtatgacttgaatatttgcactggattttcaaactatacgaacagagatagttaaagcactttttttggactatttaatgttaaaataaaagtatcgttttagtgtttctgatttctcattccataatgggtgacctatgttgtgagatttagaaaaatgagcaattttcctcctttcttatgactcacaggtcacattttggcaacatgttttttttttcctgtagaatggtgattacctttaccccagttcacctaagagaggaacctgtttataaagaggatacaacctcatgcatgaattattttaaatggtattcttaataatctatgatggcacagatcttttatacttctgagttgtcttcttttcatctttacgaaaaccatatcttctgtagagttaaacaagattattaatgtagctcttggtttcttttatgttctggttcctaacataaatgaagggaaaggaaagataagttgtgctgctttatagaaaaatagtaaactttttgaaggccaaatttatgtcagatttatgggtatcaagcaataacatcatagaaacaccccaaatcctgatagtgcgctaaggatggcatgaaggaagaaatttttggatttgagatatgaaagaatttgatgtccagattatttctatcaaaccaaatctttagtctctaaaataatatattgttaaattctaggagcaagaatcctctgtgatttccaagatctgttgccgatgacccacacagtagacaatcaggaaatgtttattaaatgagtgatacaaaggcactaaaagatgatgtcttatgtggaaattcttaattggaaggacactaggtaattttgggaatcttccagtgggataaggaagtatctaaagatttgaaaagcagcagcatagtttctgcattaaagaaagtaaaagataattatgaaggttatatagagcaggttgacatacatatttagaaagaactcagaaaaagaatcacaaaagtagtttgccaacatttggactagtataggactaaccaattttgctttgtaaaaaacaattcttaatagatcaattcttattacagaatgatgagtatagtacattggaagcaaaagataaatttaatttatcccaattttagcagagcttttgattctgtccttgggatgaatctgataagcaaatcatgaaatgattatttagacacaagatgtgttgctcgacagtatgcctaaagtatatcatgactaaggaatgaatgctacttaatgttgaaatcagacgctttggtcatcccagtgtagagcaaattgcaaaactgtttcttctctggctaaaaaaatgttggttattgtcttcctgtttctcctttttctgttttctgcaacattatctcactacacttgggtaaaacaagtgccaggcaattgcagggatgacaatctcctgtagaaagaaaaggatccacaattttcaaagtactttaattcattcatctatgcaccagttactattgaggacctactcagtccaaattttgaagtacagtatttgatggcctccattttttttggcaccatcataatctttccagcattctctttaccccattttctactaaaccagattgccttgatagcctgtccttaagctcacttttcaacactatctgctattcttcaacattccttgagcacataatttgctttctaccctctaagttttgcttcttttatctctgcctagaattaccatctcattatttctttatctaagcctactctagacagcactaagagtagacattttaaaaaagaattcggtagagcatgattttagatgaaaaggaagtagtaagttaagtaagagactgtagcagactgtgttttccaaagatggccacaacagcatttcccattccacatgctcttctataccatgaccttaccactcctccaggtataattttcctcctcttgaatctgggtgggcttgtgattattttggccaacagaatatgatgcttattatgccgtatgactttcaaggctgggtcataaaaggcaatgaggctttcatcttactctagcaggaatacttttgcttggagccctgcaccactgcataagaagtctgtctatattgaggttgccatgctgtcaggtagccaaactacatgaagaggccacatgtaggtgctgcagttgtcagtttttatcttggaggtttcccagcccaggcatcagaaatgtcagtgaaattgtgttcggcctttcaaactgagcactaccagctgaacaccattgagtgatctcagtcaatgctgtgaggagcagaagaatcacccaactacattctgcctatatttctaacccacagaatctatgagcataagaaaatggttgttttaagcactgagtttggggtagttttgtaggtggcagtagtaattggaatgtagaccctgaagaataggagtggacaagagcctgtaggagggtggaagagatggggagaagagcagagatatagaggttaagtctccagagggagaaggaaaagacaaaaggattaggaaagaaatgggtgaatattgaggagaaagggtgaggaattcacaactgatgacagtaaacagcatttagttttttcaagaattccactggctgctttatatattttatatatatacatataaatgtttataaatgtatatatataacatatatacatatacatatatgcataaacttatatatgtttatatatacacacacatatatatgtatatatgtatatttagtttttttttaatttttattttttatgaagttgaagtagagctcacctgccaagaggtagaaggtctacaaaggcctggctgcttggtggaaagtattgaagatggtatagatgactgacctttagcttcttgcctaacaaatactcttgtgaggaaagacagacagaggcttggcattttgtcattaagtgtgagtggtctgccttccttgggagaatttgcacacagtatacactatcagtgtgaagtactttgagccctgcagaagaaggagagatggttttttccagaggagtgccttgggctcaatgtggctctgtgttcgtgagttctgaatctcaagataacttgaggaatttgaataacccaaagccacttgtagttttgtgaaatggaaggacaccacctttagagtgggtacttagattttaagtgctttcttgagagaagaaggcaacaaatctccagttctaactatgaagctttagagagcttttgtccaaattgaggactcagcatgagttgctaattgagtggcagagttgcttctataaaagtaagaattgttttctgtagcatccagcaatctggtcaccaaccacatgcgagtcaatgtattgtttctgtgaaggattacatgctccttgtttaaatatggtcctaagagcctaggaatcctgcaagttttagacagacagttttccatttagtgacataagatacctaattaattgttggaatcttttaattaatgtttcatgaagagagatgctggagagcctcattaaaatactattactggataaaagaacagtagtttcatgacaggataactgtgatatatccaatctttatgtagtctagtcagaagatagaatttgctcctaggttatcaggagtctaatatatttcacttttaatctctgtcacatgcttctatttcaatatttcttaatgttctgtttttttttttcctgctgtgttggagtgaccttggcacttctgagatgttgtgacttgtgtttgcttctttctctacttcttccctgaaaactgcaatacatgtagataactcgctgtcacagacactgcttgatttccttctgtctgacttgcgtaattttcctggcagaggcacaactgtctttgtcctttgttatcatcaacttacatttaaactatcagaaaaaattgccattttgatgctattgcttttgaaaaactgctcattttcttttgcttgatttttttttttcgtactttcagtgaatgttggctagagcttgtgtgtctttaaccgtttttactctggtcatagttttatttttattttttagtcttttcattcattgcttctgaaaagcattttttatgtctacttttgaagaattctgattgcttcatcctaatttttcagcatcttaatttttcattcatttcaatagatttttttccccacttcatcttctgtggattactggacttgcttttgttcattgttagacttattgtttagatctgtcgtgtgtgaactcaaaggatccttcataccattttttttacatctttcttatccagttactgggcatttcagagttatttgacagtagaaagtattcagtttttttcatgaattccacaggctaataaacttgattttcacaaagtttgtgaaggcgggtggagttttgcacagacttccaagcactattttgtgggagctaaagtataaggcatagtccaagattgccctttgtgtgcaagtttgattctgctgctagtgctctggtttgtgcctgtgtgtgcagtcagcaaaagactcattgttaaacaatgaactcagaattcaaagaaagattggtgtggttttttttttctccccagctagcattctgtggttatttctactgattttttggcaagtgttgcttgtctgtgtcgagctgtgccacatcagccttaagtttctactttgcgtagctcagctaggaattagaaagaaatatttacagtcatataacatttcgtattttccaaagtagttttacttaaaatgatctcattttaatcttccaacaactttctgagggctggctgtcttgctttacatataagacaggaccacagagcctaagtgactagcctgaggtcaaataactgggagatcagggacctggaactcaagtccaggacttctgagtcccaagcccaatgctttttccacttcacatgttaggaaataaatatcatctttattatcatacaataataacctgcttctcagtattagtagataagagcaaatcaactgcttatgatgagaaataaggataagcaatggctttgctgaataggaagcaaacacactatcagatgctaatgccttctgccatacatcagctggggaaggtggtggtcagttggcattgggaagtaaactgaaaaacttccattattgtgtggccatctcttagacactttaggagtaacaacttgtggttggttattttttttttgtttctgaggacagaaatcacctgcagaaattggtgaagacagggtgagaagttaatcaggcttatgtgagacaaaggctcagtttcagctttgagatgtagagaatagtcctaagtgctttattttgctatatgtgtttttaagacaacagacggtccgatcctcaaacttacaatggttcaacttaggattttttccctttgcggtggtgcgaaagtgatacacattcagtagaaactatgctttgagtacccatgcaaccattctgcttttcacttccagtatagtagtcaatcaattacatgagatagtcaacactttattataaaatagactttgtgttagatgattttgcctacctataagctaatgtaagtgttctgagcacatttaaggtaggctaggttaagctatgatgttcagtaggttattaaatgcattttttacttaacaatattttcagcttatgatgggcttactgggaggtaaccccattgtaagttgaggagtatctgtagttagcatgtgattgtatcttctatgccttgacccagtaatatggatttgtgattcacttctattacctggcctaatacatctctaattcccttaattatctttttttttttttttttttttgagagagagggtctcactctgtcacccaggctggagtgcagtggtgcaatcatagctcaccgtaaccttgacctcctaggctcaagtgatcctcccatctcagcctcctgagtagctgggactacaggcatgcacccccgcatctggctaatttttaaattttttttgtagagatggggtctcactatgttgtccaggctgatcgcaaactcctgggctcaaatgattatcctgcctcagcctcccaaaatagtgagattacaggcgtgtgctaccatgcctggccccccttaattatatctttttgattcataagttaaacaacagttttgaactactttctaaaatcatttggaaatttttgtttgtttcttttttttaagaaatgagatctcactctgtgtcacccaggctggaatgtactgaatcatagcttgctgcagcctcaaactcctgggttaaagcaatcctccggcttcagcctctcaagtttctgggattactggtgtaagccactgcatctggctaatgttttaattttttatggagacagggcattgctttattgcctagggtggtctctaactcctagcttcaagggatcctcctggcctcccaaagtggtgggattacaggtgtgagccactgtgcctggtggtttttctttaatgtgggaaatatgagggaaggaaacttaaaggtcaagataataaagtggaccagatacgtatagctaaactctttgagcatttgtgagtgaaaaaattgggttttcattttcaaatgtacttaaaatgtatttagaaatgaagttatcaaaagattttaactgtagcttttgatttaaataagtacccagttttattttatgaaacagaagggatcagaaagaaatttgatatggtcaaaagcaaatttaattaaaatagaatattagctcttcaagctactattttgctatagtacctcttaagaaacatgggtttgtcagaatttatgtcatcttaataattaactgaactgaaagaactgcatatgtttttagagctaaagaccatttgatgtcatctaatttactacctattgtagcaattgctttagtagtgttcttggtaaatgcatatgtagctactatcattaaaaagaatattatccacgagacaacattacagtgctcattcaaaaaatatttttgtcgtaggaacaaaacaactttattttcttatttgcattgacagttttatggtactgaaaggagctctcagcagaattcttatttgaactaattaaccataccaaaattccttttatagtgttgatctttttgacaagtggaattactagaattaccacagtaatcatctggttgaagaaattgtggataatggcagcagactatagatgaaggaaatcgttgtcccaatatttaaagaaaagaaggagaggccaggcaaggtggctcacgcctgcaatcccagcactttgggaggctgaagcgggtggatcacctgaagtcaggagttcgagaccagcctggccaacatggcaaaaccccgtgtctactaaaaatacagaaattacctgggcttgttggcgcatgcttgtaatcccagctactccagaggctgagggaggagaattgcttgaacctgggaggcagaggttgcggtgagctgagattgcaccactgcattccagcctgggtgacagagaaagactctttctcaaaaaaaaaaaaaaaaaaaaaaaagaaaaagaaaagaaggaaggatatattcttaaaggattcagtaaattgtctgagagcatttaaaacctgttatatctttagtagccaacatggatttacatagaagcaagttataccaaactagtcttaacggttttttaatggtagatcagctgacatagcaaatcatttcagcagaaaatttaacaatttccctctgatgtctttctagatgtttcatatgttattataccaaaatatagttaagtagatttgcagtaaatggaacaatcattggaaaatctcagatgaaatactctagggttgtatttttgactctgttttattcaacatttttctgagtgatataacatacttgttcaacttgtggaggactcaagtttaaagagacagctactgtgacatatgacaaaatttcattctatcccagtaggttagtacgttggtttggaagcagcaggatgtaataagagtaaagtccattgctatggtttgaatatggtttgccatattgaggctttgtcttcaatgtagtgctgttgagaggtggtacctttaagaggtgatcagatcatgaagatggatggattagtgtatgtctcttgataccagattagttctcatgagaatggattagttcccaagagagtgggttgttataaaatgaacctctcatgtgttgcccttttcccttctcatgtacctgctttcccttccatttctctgccatgtttcgatgcagcatgaggccctcactagaagctaccacacttgaccgctcaaacttgaacttcccagcctgtggaactgtgcactaaataaacctttttctttatataaattccccagtctcaggtattctgtgatagtaacacaaaacagatgaagacatccattatttaggtttccaaaattagttgtataagtagaggaaagcagttacatgaaaaaattatctgcgatgtatagtatgaaccaataatgtagtgcaattactgcaaaagctaacccagtcttgtgctggattagcaaaactttgggtctacagtgtggaatgaggttgttgtgctgtgcctgtaatatggtaggccatacatgagtgttgtattgacttttgggcagcacagtgtaggaacaacattagggtgtgttcgacagaaatcatgacacattacacactgcttgaagaagctaagagtgctggtttttaaagatagaaagaggtggaaatggaggcttagataggttttaggttttataaattgtccaagatgattttattggttcttagcagatccaattctctgttctcagttctggattctttctactcatcacattctgttcttctagaaaataaaaccaatgctaccaagtagaagttattaggaaacagattttcactctgcagagagtttttaataattgatgttgtcctctaatataaggaactgctttgggaaataatgaggtttttgttacaggagaaattgaaatagacatagtataactgccttattggagatggggtatgttttaagggataattgtgagttcaactatgtcagaaactgagctgaataagatatggagggcaattaaccatatccctctctatgtctgttgtcctggttaattattaataatgcccttttttcccactctgggtgtcccatttttggtgataaaatttctggctgccttcattataaggttttttccaactctgtaagtatgctgaatgaaaattatttcaacgtaaattatattggtttaccgtgtgaaatcaaatcttggtggcaatatgtggagtcttggagaaaatcacttaaaaatatttttgaaatggaaaatttcaaacacttagaaatgtaaagagaatggtataatgaactcttatgtacctatcacacagtttcacagctatcaactcatggtcaattctatttcatatgtcctccatcagctttttcccaaataattttgaagcaaattccgagcgtcatatcgtgtcatccataagtattcagtatgtgtctttataagctatggactctctttgtaaacaactttaatatcattgacacactttaaaaaaaatcaatgctaatccttaaatcttttattactagtcattattcaatttttttggttgctatatatatacacacacgtatacatatgtacatacatatacaaacatacatatgtaaaatgtgtgtgtgctttacagttgtgtggatactgattgtgtgcacattgcaataggttgatatgtcatttagctctcttatttgcagttatcttgttcccttattcctcctttttttctttgtctttttctccttttcctcctccttgttttcttcatattcttcttctcttggttctcatttctttgccttctcttcattatttttttctgtcttctttttcttctttgttttatatttatttgtaaagaagctgggccatttgttctctagttttccacagtttgattttgatgatttcatttctgtggtgtcatttgatgtggtagtttgatgtagaggcttactcaggttcaggttttgttttgttttggttttggtttctggcaaagactatctcacaggtaacatattctttcattagaggcatataatatggcaaccttcagtcgtctttgcttagatccgttaatttgttaagtgttgcaaaatggtgatattctgtcatttcttcttcatttattagttggaatacttgtgtaaagagtttttcctgatcaactatttggtaatcctgagtacaggttcctttaggaaggataggataaattctttctttttctttattttccagttttcaaaataatgtgtagatctttcacatcttctgaagacaacttgatttgttaatatatcattaactcctgggtttaaaataatgtggtgtgttttaattcattacagttattgttactgatgcttaaattcattcgtctttgaccaggagcctctgcatgatggctcttcaggtcttgttgatctgacccccaaagcctttgatagtttcttgctttctggcatgaccagatgtttcaggctcatcttgtactttttaaactctgggcctcaggccagtcttttcagtctttgtcccctcacccctcatcagctgtaactcttgtgagaaattgctgtactctgcgaaaatgtctggctggccgtagtgagttgccaaaccagactctcccagggctcaggctatgctttttgtttgattaatttggtacatcaagcagctttaatagcttgaaccattctcctctatattaagtagctttgtttgtttgttttgttcctttatttgccttttgggcacagacctgctgccttcctttactagttgtaggatagaaatagaaataccaaagccttatcttatggcattgatctttagtggcccagactaagtgctctcttcttgtggggttgtcatttaacaggcagaactgtcagagatatgattttataaaatcacatagggtcatgaatagatatcaaaaatttcatttctccaggagaaacatatatttcttcattgaacagccaagcttcctgcctttgtttggttcctgaaacagaagaccctgagacaaaaatttgagtacatatacttcactggaagatgatacggtttggctgtgtccccaccccagatctcatcttgaattcccatgtgttgtgggaaggacttgtgggaggtaattgaatcatgggggtatgtctttgccatgctgttctcgtgatgctgaataagtctcatgagatctgatggttctataagggggaatttccctgcacaagctctctcttttcctgctgctatccattgtaagatgtgacttgctccgccttgccttctgccacgattgtgtgaggcttccccagccacatgtcactgtgagttctccttcaaacctctttcctttgtaaattgcctggtctcaggtatgtctttatcagcagcctgaaaatggactaatacagtaaattggtaccagtagagtggggtgctgctgaaaagatacttgaaaatgtggaagtgactttggaactgggtaacaggcagagattggaacagtttggagtgctcagaagacaggaaaatgtgggacgctttggaacttcctagagacttgttgaatggctttgaccaaaatgctcataatgatatggacaataaaagccaagctgaggtggtttcagatggagatgaggaactcattgggaactggagcaaaggtgactcttgttatgttttagcaaagagattggcggcattttgcccctgcccttgagcttagtggaaatttgaacttgagagagatgatttaggtttccagcggaagaaatttctaagcagcaaagcattcaaaaggtgacttgggtgctgttgaaagcattcagttttataagggaagcagagcataaaagtttggaaaatttgcagcctgacaatgtgatagaaaaaaatcccatattctgaagagaaaattcaagctggctgcagaaatttacataagtaatgaggagccgaatgttgatcctcaagacagtagggaaaatgtctccagggcaggtcagaggtctttacagcagcccctcccattacaggcccagaggcctaggggtaaaatgtggtctcatgggctgggcccagggtccctgtgctgtgtgcagcctagggacttggtgccctgcgccccagttgcttcagctgtggctgaaagggaacaatgtagagcttgggccatggcttcagagggtgcaagccccgagccttggcagcttccatgtggtgttgagcctgcgagtgcacagaagtcaagaattggggtttgggaacctctgtctagatttcagaagttgtatggaaatgcctggatgcccaggcagaagtttcctgcaggagtggggccctcatggagaacctctgctagggcagtgcagaagggaaatgtggggttggagcccccacacagagttcctactggggcaccgcctagtggagctgtgagaagagggctaccatcctccagaccccagaatggtagatccactgacagcttgcaccatgtgcctagaaaagccacagacattcaacaccagcccgtgaaggcagctgggaggacggctgtaccctgcaaagccacaggggtggagctgtccaagaccatgggaatccacctcttgcatcagcatgacctgggtgtatttacccaatgcctgtaccctcattttatctaggaagtaactaacttgcttttgattttataggctcataggtagaagggacttgccttgtatcacatgagactttggatgccaaaatgagttaaacctttggggaactgttgggaaggcatgactggttttgaaatgtgaggacatgagatttgggaggggtcaggggtggaatgatatggcttgtctgtgttcccacccaaatctcatcttgaattcccacatgttgtgggaggtacacagtgggaggtaattgaattgtgggggtagatctttcccatgctgttctcgtgatagtgagtaagtctcatgagatctgatggttctataagggggagtttccctgcacaagctctctgtttgcctgctgccatccatgtaagatgtgacttgcttctccttgccttctgccatgattgtgaggcttccccagccacatgaaactgtgagttctccattaaacctctttgctttgtatattgcccaatcttgggtatgtctttatcagcagcatgaaaacggactaatataggaggtgatctctggaagcacagtgagggggtggggaagagaaagagagggagaaaagccaaaatagggtgcattgaagagtaggttattgctgttgttaagtggggttaaatttcactcacaaccccccagctatgtgaaagtcacttcagtattgtgccagggaagggcaaggaagttgtttacacatccaccctcatccttcattcttagtgtcattcacttccaagtagtccagcctttttatatactggccaagctaccttctaggccaggtaatgcccttatgcagacagatgcagttactggagctggatggccacgatttctggcagtggttctttctcaaactgaggttggggctcgggacgggggaggaggttattttgctctgcaaggagcatttggtaaattctgtggacatttttggtagtgacaactgggggagggaaaaagtgctactggctggcatctagtgggtagagaccagggatgctgcttaatataccgcagttgatatggttgccccctacagcaaagagttatccatccccaaatgtcagtagtcccatggcttagaaactctgttttacaggaattcagagctgcaggtgacctctgggtgggaggacgaagggagtatggtgggtcaccatggcatctgctacacttctcaggtacaccctgagtttcttgctactctgcttttgctcatgatgttccctttgtatcctcatttccaaatcctttttattctttaatttttttggtatatagtctatatgctatattttttcactttttataaaggaatatattaatgtatttttaacttttttagagttttattgtctaattcccagtcccagtgccacttcttcaatgaagtcatctgttagatcctgactaattcctgtattttcagaatttgcatggtgtgttatttgttcatttcttgtgatgctaatacatttttactttgtgttatatttttctctcaaattgttattttaaaggataacatctgccttttaaaaattggaacaaattgtactatgagcatctgtcaaccctttatttaatctatcagttgttaacattttgccatgttttagaagtctctctctactcacatgtatatgtgtatgctgatatagatatatagtttacagtatctatctctaaatctttgagtcattttaaagtaagttgcaaatattttcatacttcacccctaagtacttcactacatatctcccaagaaaagaacatttttctcctatagaatctcaatgccatgatcgtactcaagaaatgtaacatggttacagtagcatcttatgtgtggtccatatttatatatacccagttgtccattaatatccttttagcttttttttccccagatctgtgatccagtgaaagatcattcattatgtttactggtcacacttaaaaaatgttttaaatttttttctttaatctagaacaattctcttacccttttctttttgtttttggttattcatgacattaatgattaatgattttgaagagtctggggctgttgttttgtaacatatcccacagtttggtttatctgattttctcttcatggctgtattcagtttaaacatatttgtcaagcttttaaaataagtgatgttatatacttctcagtgcagttaccacaaggcccatgatatgtttcttccattgttgctgctgcttgaccacttgtttaaattaagttggtgtctaccagtttttctcattataaagataccttttctcaattataatgaattagtgatctgtgaagtgacactttgggactgtatcctgttctgaaaaacattttgcccagtgtttttagtatcttgaatcaatactacaagctttattggggcagaatctcctaactctttttctgtcagtgatagtacttaacataatgtatatgtttattgagggattgaatgaattaataaatgaaaattttatctttagagaatgagaaaacatcttgatttatcctgccagtttaaccaaaatctttacagtcacatgttctttttcttaagcttgttcaagtatagaataattcattactgtttttttcctattgcttcacatctcagggtttttcatcgtttcctccaaatggcaatgtctctttttcttatcagtaaatacaaagctacttattctgtatgtttaaaccaactttacaacatccatctcactacgatatttcattaaaagaaaaataaatgtaaatacatagtgttctaggagctacacctaaatcaagggtgtgtgaatgtgtatatgggtatgtaaaaatcaagcttacttgctaaattttcccatgtgtttttttttttcaatgttttactatttcatgacaaggatcattactgatttgttttaaaattatatttaattctgaactactttttaaaactacaacaatcatagaaaggttgaaaaagcttactttcttttttatagtgtcacttgcattgtagttattaaagagttgataacaaattgcagtaatgaaacagtttgtgaatatgcattagaagatcactaagactaaaattttctgcagtagaatatttattgctcaataaagtaatgctaatttatagcatttggcttaaaatattgttgttttatgcaccgaaataagtataacaaaaatacaaggttaaaagttcatttaaaacatattacatctgaagatggacaatacccctttctgaattagtctaattttctaagaatcaacaacatgtatattatctctgatacacataagaatcacgtagcttaatttcctgaaaattgtcttattattaaccactgaaagaactaggcatatttaacctggagaagagaagattaaaagaagacctgacagtcatctgcagatggtttggggactatcgtgtagaataatgcttagggtagaactagtgttagtgggtaaaagtgatttgtagctatattttctgtttcaatataagaaagaacttttttcaacgggtaataactgccaaggaacagagtgtggtatctaatgaggcagggaggacattttacatggagatagtcatggaaaattaagtgacctttcttaccttcccttcattccctttgtttccttctttcctaatcagtgtttcctgtagatctgtgctgtccaatatagtcgctgctagccacatgtggtgatggagtctttgaaatgtggctagtctgaattgagatgtgctgttaagtgtgaaatacacatcagatgctaaagtttatatttaaaaatataaaatatctcactgataacttttatattgatgacatgttgaaatggtgttattttgtatatcttggctaaataaaatataaaggttacataactttaatttattattattttaattattagcttttttttttttttgatggagtcttgtgctgtcgccaggctggagtgcagtggctcgatctcgactcactgtaacctccacctcccaggttcaagtgattctcctgtctcagccttccgagtagctgggactacaggcgcgcacccccacacctggatgatttttgtattttttagtagagatgggatttcatcatgttggccaggctggttttgaactcctgacctcagatgatccgcccgcctcggcctcccaaagtgctaggattacagtcatgagccaccgtgcctggtcgtaattattagctttaattaccagttctcggtaaaaatgagtaaaccctgcaccctatctctctcattggttataatttaaaaccatagtacctaaagaatacatataggaactgcttgaggactctgaaaagtaattatcagacatactaagaagaattaaaaactcaaagattaacccatatggaggtcattttcttgtgttttaaaaaatttgtttatcttttctttccatatctcctggtttggatcctaggacatcctggaccctggcactatgcactgggcaaggacagaaaattctccaatgaaaaccctctcccaggtcaaagacatagaaagggggactcttcaggatgtaatcttttttttttttttccccaccaactcttctgtccctaaggcaggcaagctctagtgatgaaacaggactcttgcagtagcctcttagactcttttcttttggggtttcttctccagattgacacagtaatggaaagtatataaaaacatggggagggaaaaactcccagtttcaagccagagtaccaagaaaaggtgccactgggaggcagagtacgggggaaatcacagagaagaggggctggagaaaaggatcctttaatctgtgtgtgaagtctcaggcttatccttgagcttcacacatggaaccggacagaatcagtatagcaaagtctttgagaactgagctacagcatagaacagtgcccagactagcctctgggtggtgcgtactttgggaaaaccagagtaacatttaaaggctttgaaaactattctgatgaatcaagtccacagaagatggtttagtgctttcactctgaacctaactttatgccaattcatttggcaattaagtgaaatgaacacattccttgaaagagataaactatcaagattcactcagaaagaaatagattatctgattaatcctatatctgttaaataaattgaatttatagttaaaaaaaaatctttcacaaatgaaatgccagacccagattatcttgggtgaattctaccaaacatttaagacaaaaagtcaccaattttatgcagtatcatccagaaattgaaaaggatacaacagtttctatcttactttatgaggctgacatttttctgatatcaaaatcagtcaaagaaagtagaagaaaacaaacaaacaaactataggccagtatccctcatttgaacaaagaagtaaaactttcgaaaaaaattagcaaattgaatttagcaacatatataaaatacatacatatatatgtatacaacatacattatctatgtatgtatacaagtaaaataatatatcataatcaagcaggttttattctgggaatgaaagccaagttcaacatttgaaaatcagtctatgcaagtctccatattaacagactaatacaagataaactgtatgatcatatcaatggatgcagaaaaaactaaaatttaaaatctgttcataataaatactcttagctaaataggaataaaagggaatttcctcagcctcaaacttataaaggacatctacccagaacctacagcttaatatcatacatggtgaaagactgaatgcttttcttctaagactgagaatgaggcaaagatgttcactttcccaaatcctatataacatagtactggaagttgcaggaagtcaagaaaaagaaataaaaggcatatggattggaaaggaagagataaatctacctaatttgcgtataatgattgtctatgtagaaaatcccaacgcatattcaaaaaatcctagaacttacgagttttttaaggttacaggatgtaagatcagcataggaaaatcaatcctatttctttatactagcaatgaacaatcagaaacagaaagttaaaaaatagtaccaattataataccttcctgccaaaaaaatgcttagttataaatctaataaggtatgttcagtatctatatgtagataaaggaattgaagaagacctcaataaatacagagatatataatatattcaaggatgggaagactcaacatagttaagatgttttccctaattagttttaattagtttcctaagtcaattttccctaaattaatgtacactatttagtgtaatccccatcaaaatcccagcaggattgggtagatattgacaagatgattttaaaatttacgtgggaagcaaagaattaaaatagccaaaacaattttggaaaagaacaataaaaatggaggagtcagactactcagtttgaagacttattatcaaggcagtgtgatattggcaaaagaagagccatagatcaatagaacaaaatagtccaataatagatccatataaatatggtcaatgattttccacaaaaacgcaaaggcacttcaatggcaaaaggagtcttctcagcaagtagacatctacatgcaaaaaaaaggaccttgacttatatttcaaaccatgttcaaaaattggtgaatcacattcttaaatggaaaatttcaaaccataaaaatccaagaagtaaccatagaaggaaggctttgtgacttgggctgggcattgagttagatacaacagtagaaacataatccataaaagaaaaaagttgataaattggatttcactgaagcttaaaacttttgctctgctgaagagactgttaagaggaagaggaggacaagaagcagtaagagaaaatatttgcaaatcatgtatctaacagagaacaaatttcaagaatatgtagctttcaaaagtcaacattaagaaaaccaacaacaataaaaaaaatggggaacagatctgaacagatactccaccaaggaatatatacaggtagcaaataaacacatgaaaagatgctcaactttattagtcattaggaaaatgcagattaaaatcattatgagatgccatgatgtacctgttagaatgactaaaatcaatgacaataataacaaaattgaccatattaaatgttggcacgaatgtgtagaaactggaactctcatgcgttgttggtttgctaaatgtaatagtcactcaggaaaaaaggttggcagtttgttttatggttaaagatacacttcatcatatgacctagcaatccagtcttaaacatttatctagaaatgataaatgtacattcacgcaaaacatgtacatatatgtttgtagcagcatcattcataatcatcacaaactggaaatcacctacatgtctttcattgggtagatggatatacaaactatggtacatctgtacaatggaatatactagtaggctataaaaaaggagcaagctattgatacatgcagcaatttgagtctcaaatgccttatgctaagtgaaagaagaagctggtctcaaaaggttacatactgcatgattccatttatatggcattctggaaaaatgcaaaactgaaggggccaagagcaggtcagaggtttccaggaataaggaatggtcggaatatttaaatacacagggatagcatgaagacatattggagagtgatagaattgttctgtatcctaattttggtgatgtttacacaaatctctgcatgttatacaactcttataggtgtacagaaaaagatgaattttactgtgtataaagttaaaaaatagtttataatttttatgtcaccttttttctttttactgtttgaatgtggctactggtaagtttaaaattatgtatgtggcttgcattattatttctattacatagcactgcttcagatattagaagtgcaaagaaggattaggtgtggtccgaagtctaggagagggatatggcagaaggaagtcttctaagaagaggaggcaaatttaaatgacctaagtttagcctctgccccctacttccatcctttgttctacagattttgtttgagagcctaattcatgtaaatatgccaactctcagatgtagtaattccttagagtctttttccttgatattggaaattaaactctaccactcaagatgaaaagaatgctgtgcaatggaataattagtggcatccttgcatttgtaggcacaacagcctacattgctgaggcagttgacaagttccttgacaaacttgtgatgaatgtttaagttcatattattattggttagacattattgtttaaattattgcacccaagattgtttattgtttataaattgtcataaagggaggtttccagaaggatgcctagccagtatgtttataatttgaagttaggagtgccaacccaaaattggagtagaatctaagaatatcatgatggactttaaataggtaaatctagcgatactgaaatataatacagataaatttaaaatttcaaaatggattctaaaatttagttgtcccagttaagaagagggatatgtagcttagcagtggtaaatacataaaaatgttagggcttttagttaataagaagcataataggagtcactactgatgaggctgccaaaaaagctattttaacttacaatgccatttatcaatagaagtttaatacataaattaaggcatggatttttgtatttgtttctgtgctctttagaacacacctagaatcttatcttgagatctgggtgttatcctctaagagagctatagacaaactggtacatattcagagaggagagagccaaatgatgaaggaaattgaaacaagtcagatgaggaatagtgaaggagactgggatagtaagcctgtctaagaggtgactcctagtggggttgaaagataggtcacgagaactgccttcaaataattgaagggctgtgatattacagataaattaaacttgtcccataaagttctcagaaccagcaaatggaattttcagagagatattaaatttcagtgtaaggacacactaagggttagagctaactcttggaaatgagtcacctcttcaaagtttttcgtaaagctctgaaatggtttggatatgtgtcacctccaaatatcatgttgaaatgtgacctccagtgttggaggtgagcctagtgggaagtgtttgggtcatgggggtggatccctcatgaatggtgtggtgctgtccttgtgataatgaaagagttcttgctctgacttcatgtgagatctggttgtttaaaagagcgtggcacctcctcttgctctcactgccactctcatcttgtgatgtgcctgctctcccttcacctcctgccatgattgtaagcttgctgaggtctttgccagaagcagatgctggcaccatgcttcctgtacagcctgcagaactgtgagccaattaaacctctttttataaattatccagtcctcggttagttctttatagtgatgcaaaaatggacggacacaaactctattgcttgaacttactttttgttgagactatctccttcaaactggcgtttccacaaagttcttgtctgactctcacttccatacttggagtttcagtcagtaatcatttaatgcagcaactgataagaataatctatcattggcagaaaaccagtcatttacctttttctttttttctttttcaagtttcattttaggttctggggttacatgtgcaggtttgttacgtgggtaaattgcatatcactggggtttggtgtacaaaagatttagtcacctagatagtgagcaaagtacccgattggtaggtttttgaccatcaccctcctctcaccctccaccctcaagtaggccccagtgtctattattcccctctttgtgtccatgtatactccaatgtttagcttccacttacaagtgagaacatgtggtatttggctttctgttcctggttagtttggtaggataatagcctccagctacatccatattgctgcaaaggacatgatctcattcttttttatggctgtgtagtattccatggtgtatatgtaccacattttctttttttctttttttttttttgagatggagtcttactctgttgcccaggctggagtgcagcggcacaatctcggctcactgcaacctccaccccctggattcaagcaattctcctgccttagcctcccaagtagctgagactacaggcatgcgccaccatgcccagccaatttttgtatttttttgtttagtagagacgtggtttcgccatgttaaccaggctggtctcgaactcctcacctcaggtgatccatctgcctcagcctcacaaagtgctgagattacaggtgtgagccactgcgcctggcctatgtacattttctttatcagattcactcttgatgggcatctaggatgattccaagtctttgctattgtgaatagtgctgcaatgaacatatgagtatatgtgtttttttcatagaatgatttatattcttttgggtatatacacagtaatgggattgcagggttgaatggtagctctattttaagttctttgagaaatctccaaactgctttccacagtggctgaactagtttatgttcccaccaacagtgtgtaagcatttccttttctgtgcagcctcaccagcattttgttattttttgactttttagtaatagccattctgactgatgttagatggtatctcgtggttttgatgtgtatttctctaatgattagtgattgtattagttgtattagtattgaattgtttcttagaaactatgttttcctggcagttattgaaactgatagacaaaatagtatgataatatttcactggtgaggaataaggcaagtatcctgtggacaggctgtgttccttctgtaattagggagtaggagatatggtccactctgcatatctggtaagtgagccttcctgagatggtgctgataccttctaaaaattgtcagctgctaaggcacaagcgtgtaaataaaatctactttgtatttaacatttctgtgatttcatgtatgtgtcatattataaagcactgttgatgtgcattttgaaaggaaggaacttctgcccccattgctcccactgttatagcctggcaagtttcagggagtaatgaaaaataagacttgaaactcttattttgttgttaggtggttgtaacacttcttccttttttttaaacctcgccttatagcacctctgatcctgcttttatttctttgttctcctgcatactcttccattttatgaaaagttggagtaagcagtgtccaggtaatctgtactctgtgttcatatcatctgctccagggtgaaataaaggaaatgtgatgttattgctcttctatatgatttgtgttggtcttttctctactgtctctgccttgaggtcaggtactatgttttctacttcctgtataactccccaggtgtccagtatgcacatctgtgcgttgtgggtttttaataaatgttcttgactgatttactgactgttctgcatagcaagagaacaatgccacagtttatttcaaagaggctgtacagtattgaggcaaagtgtttcacagttctctgaggttgaaggtaggagcctgagaaattctggaacataactatgtgagattctgaaagctattttaagttacttctttgttttgaaaaatatttatataatgtttttattacatgtaatgtagtaaacttcctccccttttagtacatatcttttccttaaaaaaaaaaaactttattatatattcaaatactggttggttgccttaaaatttattgaaaaatcagctgtagaagtaataagatctagtgtttggcagcacaatagggtgagtatagttaacagtaatttattgtgtatttcaaaataaagagtggaattggaattttcttaacacaaagaaatgataagtgcttggggtgatggatatctcaatttccttaatttgatttttatacattatgtgcttgtatgaaaatatcacatataccccataaataagtacagcattatatatctataatagttaaaaatttaaaaagtctgtctttaacattatccagtcgtgtccattaaaaagacacattttgtaaagttccttaaaaataaagatctttgcaagtatttatcttaaaaagcattctttacttttataaagggctcattgcagagttcttttaaatgcagaaactcttcacattgcatttttaatatgattttatttataaaagtaactgtgtcacaactattcagtaaacactttgtaatttatttaagatcaggtttttttaaagtgggacaattttttgcatgagattaaaaataaaaacagctttattgagatacaattacataccgtgcagtttaccctctaaagtatacaattcagtggctttttacaaatatagtcacaaagttgtacaaccatcactaatttcagaaaatatttatcatcacaaaaagaaagcttgtaccagttagcagtcgcttcccattctcctgttccccattgtctggcaaccattaatctactttctgtctctatgaattttcatattctagacatttcatataaatagattcatacaataataatacaataagtagccttttgtgtctggctcatttcacttagcttaatgttttcaaggtttatccacattggagcattatatcagtactttctttcaaatttgaataatattccattacatgtataatgtcacaatttattcattcatcagttgacggacattagttgtttccactttttggcgattgtgcataatgctggtacaaacaatgtgcaagtttttgtgtggacatgtcttcacttctgttgggtatatgtatacctacgagtggatttgtagggtcagatggtagctctatgtttaacctcttgaggaactgccagactgttttcaaaagtgactgcaccattttgcattcacaccagcagtgtataagtgttccagtttcttcatattttcataaacacttattattatatgtctttttgattatagccatccaagtgggtaattaagagctatcttactgtgattttgattgcacttccctgttggctaatgatcttgaacatctttctatgtatttatttgacatttgtatatcttcttggagaaatacctgttcagaccctttgcccttttaaaattggggtatttgcctttatattgttgacttgtgagatttctttgttctgggtacaagtcctttattagctatgtgatttgcaaaattatctccctgtggattgtcttcactttctagatagtctcatttgaaggccaaaatttttaattttgatgaagtttaatttatctatttttgttgttgttgcttgattttggtttcatgtctgagaaagcattgcctagcccaaagttataaagatttattcttatgtttccttgaagaatcttgtagttttttgctgttacacttaggtctttgattcattttgagttaatttttgcatgatatgaggtaggggcccaacttcattcttttgcctgtggctttccagttgtcccatcaccatttgttgaaaagatgcttaaaaaacccatttaattgggataaaatatacttaacaaaatttaccatattaaccatttttaagtgtacacttcagtagtgtacttttatgaaacacactacttcaggtgtttcgtataagtggagtcattatagtatttgtctttttgtgactattttacttgatgtcgtcaatattcattcatgttgtagcatgttttaaaatttttctccttttaaggctgaataatatttcattatgtgtacacacacacacacacacacacacacacacacacacacatatatgtcacatttggtttatccattcatctgtttgtggacaattgggttgcttctactctttggctattgtgaatcatgttgctgtgaacagatgtgtgcaaatatctctgataatctccttttagctacttagggtatattctcagaagtagatttctggatcatatgttaatttttaatttttttgtgtggaattaccactgtgtttcctatagtggctgtaccattttacattcccaccagcacttccaaggggttccaatttcttcatgttctcacccacccttgttatttttttgtttgatagtagctcttctaatgagtgtgagatgatgaaaatacttttttgccccattgaattgtgttggcacccttgtcaaaaatcagtaggccataaatttgaaggtttatttatggactctgaattctgttccattgatctgtattcctatccatattccagcaccacattgtcttcattgctgtagctttgtaacaacttttataattgagaacgcctgcaaattatttttaaatatttctttggctatttgcatcccttccattttcatatgatttttaggattggcttgtcaatttctgcaaagagtccagctagggctttggtagggattgcatgggatctacagatcaacttgggttgtgttgccattttaacaatagtaagtcttctagttgacaaacatgagatgtctttccatttatttaggccttttttaatttcttcaaacaatgttgtgtagttgctagtgtacatttcttatacttcttttgttaagtttattcctaagtattttgttctttttgatctcattgtaaatggaattttaaaaaattatttttggatcgttaattactgttgtacagaaatgcggttgatttttgtacatttatcttgtatcttgcaaccttgctgaagctgtttattagttctcattgtttgtgtggattcattgggattttttacatgcaagatttatgtcatctgtagatagagatagttttgcttttttccaatgtagatacattttgtacctttttttttttttttttttgccaaattgttcttgctagagcctccagtataatgttgaatagaatcaaccagaatggatattcctttaagtagattttttcaatgtttaccagtttggaaatatttattactagcagtgttcctttgtgaacttgaaaatgcagccattcttctatagcagcaaaagtgataaaatttcttttattggaatttagcatgttatttatttttagaatgtcaagggacaatagatcctagattggcatttttcaaaactttgatatctttgctctgttaactttttgattttttttcctaaagtaactaaagtaagccaactataggacttttaaaaacacatctctaaagtatgttccttcctaaagaatatgcttgctgtgtatatttgaaagaatgagtaatcaggacattcatattatctctacttgtgctttttagccaaggcttgagttaatgccttatagttagcacttttgaattttatgatttatcatagatacaattgatcatctgagatgatgatagtggctagggtgagaggaggtggttgtactacttttgataatttaattttatacctgtcttctgaaggatacattttcttgtttaaatttcttccctacagaagctccaggagtgactttgctatgacttcttcttctttttttaaataaaaatatattttatttttagttttttttgtgtgttgcatttctcacattttattttatttttattttttattccagtaggtttttggggaacaggtggtgtttggttacatgaataaattctttagcggtgatttctgagatttaggtgcacccatcaccagagtagtgtagactgtactcagtgtgtagtcttttatccctcacctcctcccaccctttccctcgagtccccaaagtccattaagtcattcttacgcctttgcatcttcaaagcttagctcccacttatgtgtgagagcatacaatgtttggttttccattcctgagttacttcacttagaataatcgtctccaattccatccaggttgctgcaaatgccattattttgtttctttttatggcttagtagtattccatgatgtgtgtgtgtgtgtgtgtgtgtgtgtgtgtgtgtgtgtgtagctacgatttctttatccgcttgttgactgatgggcatttgggctggttccatagttttgcaattgtgaattgtgctgctataagcatgcgtgtgcaagtatcttttttgtataatgactccttttcctccaggtagatacccagtggtgggattgtggatcaaatggtatttctacttttagttctttaaggaatctccacactgttttccatagtggttgtacaagtttacattcccaccagcagtgtaaaagtgtcccctttcaccacatctgcgccaacatctattattaatatttttttgattatggccattcttgcatgagtaaggtggtaatcgtattgtggttttgatttgcatttccctgataatgggtgatgttgagcattttttcatatgtttgttgctatgccttattcttcactgaagatttttttcagcacttagacgttcagttcagagaatagaatttctttaatttattgagtgtttattgaatatattctatttgtgctgtactttcccctgtcagaaacattaaataagtataaaaacatgtctgttctgtggatgcttacaatttaattaggaagatcaattatatgtactcaccttgtaccgctgtgtatttgtggctctgggtctatgtcttatatccctcactaaacatgagctccttgagaataaatatctttgtattgacacagcgtgtcacagtatctcacaggtagcttgtgtttattatgattttttaaaattaatagagcaataaaacaatataagactacttacaactaaatactaaagtgaatggcgtaattagtcaggattttaatttcagaagtaacaatgatctgtgtgttctggatttattagggtaggcttcatacaagagacaatttagtgggctcataaaggatggtaagaactgagcaaggagagagatatagtatttgatgtcatagtatttggagggcattgagcagatcatattgactggaagaaaagacaggcttgtagataaagagaagggtggatatcagtttgaaaagtttgcttttactccatttgatattagagactcatttaagtttcttgagttaggaagttttgggacaaaatagcacattaagaatatttacttggtgataatatgtattatggactggagggcagctagtattaggagatcattttaaaaggtatgataatgattgagtttctttagtctgtcagcttttaatagcagggttttttttttgtttgatctttaatgcctatcatagtggctatggcaaagttcaaatatttattcggtggatgagtgaatgtatggactaggtgatctgggcctggaaggggctgttaacagtaggaaaaatccatatgagtgacattttggaggaaaaattgagatgacttattttctaagagtatacagggtgtatgaaaggttgaagatgacactgaagttttagcatggaatcagggaacgagaggagtgagaaaagggagagtcatcatcatgttttagtcttgctgagtttgacattgaaatgcctagtacatagatatttaaggactcaaatgagaactgaagtttaaatgtttacatttggataaaattttatagatactgtttgagcagtaaaaatgattggattgataaagctgttatgtatgtatgtgtacagaggtggtatacatgtacacaagtatacatatttttatacattacaactcaatatgtgtgttagattgtcgataaactaatctacttgttagtattagcataatgataagagctgattcttgggatgagcagaggaaaaaagggagctacagaagaattcagaaaagaaacaggtagaagaacttgcaatctaaatttgctaatgagactttgtaaatttgtcttatgtttcaaaacaaaagtaatacttccattatcacatgttgagaacttactatatgctggacactgctaggcatgccatctctttttatcgtcacaataaatctgtgacattagtactattatatctacttcttactgatgaagaaactgaagtctaaagaagttaaaacttgctcaagatcacttgagctaataaataatgaggagaccttgtggatataaatctaagtttttgtgaactataagccatatgttctttccattatacaaaagtatgtatgtttaatttctgcaaggcaaagactgtgtctatacagaatcagtcttcgtaaaggcttactaattaattagcaggcagtgattggacagtaatgttacctgtaaaaataatcagtacatattttggatgtggctgcttctacttttctccttggatatttacattcacagtgtacttggagataaagcttttttgattgcttgttgtggatgttaaattgaaaaaggatagcaggcctgggatagtggctcacacctataatcccagcactttgggaggctgaggtgggttgatcgcttgagctcaggagttcgagaccagcctgcacaacatggcgaaaccccatctctaataaaaatacaaaaattatctgggcatggtgacatgttcctgtaggctcagctccttggggggctgagatgggagaattgcttgagcctgggaggtcgaggctgcagtgagtcaagatgacaccgttgcactccagtctggatgacaaagtgagaccctgtctcaaaaaaaaaaaaaaaaaagatatcagtttatttgaagaattaatcatctggaaagtgcttttcaaatggttttcttaaactaatgtaaatttcttttagaagtttttctgatacagtcttcagaatattcatacttagaaaggaaataaaaaggacctgtcattttcttttatttcaggggatatcattttcaatgcccaatacccagaactgcctcccgattttatctttggagaagatgctgaattcctgccagacccctcagctttgcaggtgagtactgcagacttgcttgaatgatctttctttggtgaaaggaaaacaaaattggctttcagcagttgcttaacagatagatttgtcacacatctgcatttttttcccacccctcttttctctgtcctgtgaaatagatggaactctttatgtgccatagtagttaaataagaggtttttttcattgctgtttagtttcagggtatttcgaattaatgaaagtctctagcatattggttgaaatatttttacttcagtttaaagagacatgttgaaaatattttctttgttttaacataatatatcatgcctgcaatcaattttctaatgtttactaacacttcattacagggctcgttaggagagtgtttcttggctcttcaaggagccgtttttatatagaagtgaaagtggcaaatttggacttgtatccgcattatctcagtatctcagtattgttatcagaagggtaaagaccagattaagtgttctttatcaagcaacaccagaaactttgtagttgaaataaaatgtttctggaattaaagcagaaatattcaccattagggaaagggtggtggtacttgttggagcacatatgctttagtaagcatacgtacttactaaaaaagttgtgtgttttgcatggtggatggagaaaaacacatgccattttgtttaaatggttctgaccagacaaaatgtctctttttatttcttctcaaatttgagtttggtatgatacctatactagaagaggttttatagttgttcaaaactatactcttagtttcgtttcctggaaattttttgtcttattcaagttttattgttaaaagttttgatgacttactttgaactcttgccctgcttccaccctttaaaggtattaaacaggaagtagtaacccaaacctaaagtattgtcttaaacattagaacatagctgtaaaaatattgttggcaagagtaaggtggattcgtggtgaagtttctaataattgaacatcagctgtaatttttttaattaaaaaaatctgagttcaatatggcccctttagatgctgtgtgttacgtattcaccccatattaaagctgagagtcttaaacctggaaaaaaaaatgacacagagatttcaccacagacttcttctgtattaagtctgcccagaggagggtggcatatgctggatgccaaagatgtattccaggctaagtgcctcaggaatttaaaggtggtcagaaaaagctttgtagttgaggcgagacttgtactcattcttgaagaatggaacaaaagtgggaggtatgacaaagagtatttcaggtgggggaatgacataagcacattgggggaatgacataagcacattggaagtagctaggatttgtctaatgtatttcagaaggcactgacaggtttgctgaaatgtaagtcaatataaggaagggatcaacaaggttagaaaggtaaattgggagaagactgtggggcacattgaatgctgggctaggagccattgaaggaaatgatgaagggagaatcatctaatagcagtgtggtcaatataatggaataaggagagatcgaagaccagaattgaggatagttgtaaaaattcagtggagggagaaagggctttgagctagggtgatgcaagaagaaacagcataatggaaagaataaaaaagtcatgtttacaacttctttttttttgaaattgcatttaaaattcatagcacatatctttaatatttggcaagtattgtgtaagtgtagaatttaaatgctagaaaggatcttaagattcattttattctaatcttccattttaatattgaggaaattgacctagatttatataattctgtgtcagacctgatattataacaccactcttaagatgtttagtccctgagtgaagttatcacaaatgttttgagaatatagctgaaaaagaatagccgaaaaaatcaaagcactagatctaagtgaaagattgcaaatctaggggaacaccttctccttagtgatagttcatctacggccttgggtagactacccagggcttcttcatggatcagcgggctgagcaagcccagataagcaaccagagcataccctccactagttgggcgatgtccaaatagttctgaaggttgctcttgatggttattgttgtctgattaaaacaccagacaggttaactacaaggcctgatccccagcagacatttctctgagtgtagcttgtctctgaaagatttttcactcacttgttaacagattttggtttaattcttggattcagttcagacatttttccccttcctgtagtgctcagagcacaatcattaataacctgactagtctacatatggttctgaatgaagggggaatacaaatttcatcacccatggagtggaaaacagaatgcctagatttcttggatttttcctgaagtatgccttgcagaagggcatgagtatatacccttagaacctgggagtgtagtctgaagtagttcctgtggcaggtgtggaatttctttgaagtttctgggttttatcttaaaaattcatgaaaattttatatttgattctgtaatatacctgtatttttaaaacaaaaatatattaaattataaatatttgagaaaaaaatgactcttcaatgtgtctcagtttgagaaatgtagttttagagaatatgtgtaatatatataatcttttatttattcaatttatttaaatcaaatcgtttctggggaaaaaaaaaggatttgaggtagcttaagtaaaggacacacataaggttaataggaatatgtgacgtgctgtgatccatccaatgaggccacctctttctaaactcagactcttcatttagggaggtgagttccattaaggaacttgagattttcagataaatggaaaatactagatagagaggtatctcatagatagcaaaggtaaactctcatacaatcattgagctaggacattaatggttcagtggttcccaattctagatatacattaaaataaattgaaaagccttttaaaaatacagattactggacctactgaattatatcctttggggagcccaagaacttattaaattctctgggctatttttatgatttctctgagctgttactgggaactactgattgaatccatcttttatagtaatgtttccaacagaaggctgtttgcctttgcttaacattatttccagtgaagtattattttccattctggagacagttcaaaagtttttttaagtaacagctttattgagacaatttatatgccgtacaattcacctaaagtgtgtaattcagttgtttttagtatgttcacagaattgtgcagcttgcatctatcaccacaaatttagaaccttgtcataatcccaaaaagaaaccttaaacttattagcagtcacttccctatattcccaccctgatccaccaccacccaaagtagcaacttatctgcattttgtctctatggatttgcctattctggacattacatataaatggaatcatataatatgttgtcctttgttactgatctctttgacttagcgtattgttttcaatgaagcatgtattactgttttattttcttattgccaaatacgattacatcgtgtgcatatactgcattttatttatccattcatcagttgatagacttacaggttgttgccgtattttagctattgtaactactgttgtgtggatatttttatttctcttggatatatttctaggaatggaattgcagggtcaaatggtaactctatgtttaactttttgaggaaataccaaactgttttcaaaagtggctgtggcattttacattcttaccagaagtgtatgagtgtttcagtttctccacattctcagcaacacttgctattatgtcttttttattatagccatcctagtgggtatgaagtggtatctcatacccacaaatgaagtggtatcgcactgtagttttgatttgtgctttttttgatggctggtgatactgagcatcttttcatgtgcctattggctatttgtatatatcctttggagaaatgtctattcagatcctttgcccatttaaaaattggattgtcttttattgttcagttgtaagagttctttattctgagcataaaaataaacaaaagacaaagagtcacatccattagtatttattgcttgtatactgtgcattgaacactgttcaatatggaacttgacctcaagaagtctaaattttatggaggtggctgggtgcagtggctcatgacttgtaatcctagtaccctgtctctcaatcaatccatcaataaattttagggaggtaagacgtagatatctaaaagcaaatacaggtagtatataattaaaatgttggaataattgaaacaaaagcaatgctatggggtagttaaatactgtttttcacgtacaatatgtgatgtgagaagagaggatgttcaataaattaagatggagtctccattgtaataaaaaaggaaaattattgtaggttggaattttgggattaaaataatctagaagaagttaagtgatgggtaggttatgctatagctgtcacccaattgcttctttaacttgaacttcttctcttttgctcttttgctccttgctcagccctttccagccacagaggcatccttgccattcctcagacattctaaacacactcccaccttagggccttttcatttgctattgaccattttttatttactctacctgtaacccttcctgcacttacctgaatggcttgttctctcctttcttgaagtgtcattatatcagagaggctttccctgacatccctatgcaaaatagcaatactctcctcagtacattctcatctttgttgtggtctgttttcttcaaagcacttatcatcatttgatgatttttggttgcttgtttggtgtctgtctctgccagggtgaccaactgccttgatttgccctggactgaggggttttctgggatgcaggacattcagagttaaaaaagggcagtcccaggcaaactgggataatgagtcatccttgtcttttcactggattggcagcttcaggagagagtggaatttgttcactgctatatcctggtaatttgaagagtgcctggtatgtaggggtatacaatacatgtttgttagatgaacagatttcctttaaggttctgtatcccttaagggacttgcagctttccaggactagaaaatacactttagattaaaattttaaaaagtagaaaaaaaatttagagaaatttggagggataaaaataaaatcagttaacagaacctctgaaactatgattttcagcctttgttttgcaacaccctgtggtatgttcatctccctcaaaggatattatgaaattctttacccccaaggtaataatgataattcactttaacttaaaatgaagttgcataaaggaggaagggtggatcataaatttaaatgagaaaagcatgttgcaattatagtaggttggaaacctctgctatctgacttcccggtttgaggaagctgagggtaatttagtgtttgggacaagcatcttcagggtagtgaacctaatgctactgcaggtattggtcactggttgtatgagtccttcagtgactgttctgcttgcgtagaatgtaagagtaccaatgccttgtcacttttcctcctgtgctcttcattgtgctacctacagaaggacatcttctgaatgtgtccttgcaaaatagttcccatccccagtatacacaaaatatatacaaagaatgcactaagctgaaatggactgcatgtcacacacttgaaaaacgctatcccgatggatggtgctcgatgcctagacacttttaagtgccttggcctacaacatattttaaaatagaatgttctctcatttttcaaatctccatttggtgcctcatttgagacctgtaaagcacttgtccttagccctgaagctgaacatagtgctcaagacagataagcagaattatagcacagggtgacaagtgtggagatagaggtatatgtacagagtactgtgggaacatggagaggggcactttaccatatccatgtatgtgtggtaagtaccagggacttggaaacatattatttgattttttatgaataatgtatctctcttaggtaactattattaacaaataacatttatacagaagagtgtataaatcacgtgtatagcatggtgaatttccaaaaggtaaacacacctgtgtaagtagcacctagatcaagaaatgatatttccaacatccagaagcctcactcatgtcctgttccatcactatgaccaccttgcctcagagtaaacactatgctgacttatgatgtcatcattatttttgcctctctttgatcttcgtacaaatgaaatcaaactatgtgcttgtcttctttcactcaatgtttatttgtgagtgtcatccatgtagttactttggttgttgttcatgctcattgctgatagtattctattgtatgagcataccacagtttatccattctactattgattgacacttaggttattttcagtttttttgctgttgtgaatattgctactgtgaacattcttgtacatgtcttggttaatgcacatgtatccattcctgatggctgtgtattgaagggtggacttgctgggtcatatagtatagatgataggacagtttgaggtttctcaactttattagtttatcagttagggtccagtcaggagacagaaaccatagcagtaatttgaatagggaaaatttaatatagagaattacttacctaaaggggtaaaggagatctctaaagaatgcaagactagcagttgtagggagcagctattctagagctaagggagaggaataaactttgaagaccctttcccccatcacaccccgtcacagctgagattcctacctccttgttggagagggtgtggctgcaggctacgggaagatgaagaccttcactggggtgctgtgggccagaattggtgcaggtggcctactgggtgctggtaagccagagctggcaaagtggaaatgggctggtttcagtgaaacaggctggaggatgagcactaataggtcttctgcatggctctggcagcaccgtgggagcaaggaggaaagtacacagaaccaggataagaagctcctccctctgctgtgccttgcactgttcctccatcactctctgttgacaagctgaacactgcacccactggcagaagaaaaatgtttacagggtctggcccccgcttcataaacagggtaaagcagaatggctttgggagatgagaggcaataaatgaatgaatagcacaactagataatggcaaacttatcttccagtttattatttttcctattaaacccatcctcatgagttcttttttgtttgtttgtttttcttagatggagtcttgctctgttgcccaggctagagtggagtggctcaatctcggctcactgcaagctccgcctcccgggttcacgccattctcctgcctcagcctcccgagtagctgggactacaggcgcccgccaccacacctggctagtttttttatatttttagtagagatggggtttcaccatgttagccaggatggtctccatctcctgacctcatgatctgcccacctcggcctcccaaagtgctgggattacaggcgtgagccactgcacctggcccctcatgagttcttaattttagagaatatgttcttcagttttacaattctatttgattattttctgtaaattccaattatctggttaacttatcttttcatctatatctaaatggctttctccactttcttgcttgtgttaattgtatttgttttccagtccatgtgagctaattttaatatctggaatatcctttgatttttctgtgtgtgtttcgtttgcttttttcttggttatccatcatgtggttctgtttttggtgtttctggtagttttgagtgaatgtcagacattccagttaaaaaactacagaggctccagataacgcagtcttcttccagagagagggtttactgtcccctctgatagggacataggctgatgtgattggatggtcactttaatccagtcagggtttttgctgagtcgaagctagtttatggctttggtaagagtctgtttacttctggttcacttctgttctgggatagtgctcttcagggttttacttgggagattggagtggccagtgttcctaaacaattctaagtgccttggcccacaacatacttcagaatagaattctctgtcgtttgtcaaatatttaaacacacaagcagtgtggatctcaaattctaaatgttgtcttacaagactgctgattgctttgctctgcttttcagaggcgttttcttaatttttagcttctgacctgggctacgccagaattcatcaaagtcttgagaggagctggctgcatgtttgaggtctctcaacactctgccaaaagctccaatggttcctctaagcctcagcagcagttttgtgactgtgcatagcctggattctcagcctccctcctgtaccctaaatttgcaaatgtccccagggtaggagcagctgcagacatcagctcctctccttgaggttttctcctcttgattctcagcctcccagttctcatttcttccatagatagcaaatgccttcaaatagatttctatattttatttagctttctagttgttcttattgagagtgctgatctgtacagagctacttcgtcccacctggaagtcctctccattatattttgagaatatataattttaaaatttactttcaaagcaaaagtacaaaagacttcagcagatcataaaatacaatgtacatgtattacaccttggtaagaatacagaattaataaaattaatcaataattaataaaaatgtttgatattaataaaatgttcaataacaaattattaaaatgaagataactgtacttcttccttttatatgaaaacctaggtgttcacttccaatatatatattcctaaggtagaaataaagcattgttaacatggcatctctggttctcttgagttgtaatcaaaggatgcatcatcagtaaatgacccaagagaatatgagaaaattactagaaattttggtggagaactggtttgtgtgttgatgaactaaaaactactgtatttctactatgtctgtttcatcagccagggaaacattttatgaagtaggaagaaagttgatgttattttttaaaaaatatacttcctaaaggaagacagtagaagaaccctggttcaaaattaagatttatgatttcatctgttttctaaaggtgttgctattatagctaattatagattaagaagagtattaatatatacacatatgcatacacatataatttgaaagcatgtgttataaacaaggctttaaaagtgcagttgtagaaaaacagagcaccttgaaagcacaaacaaggtatattaaaaacattcactctcctaagacaaataaaaaaaggcaaaccaagttattttttgaaatccaatggcaaatataacatttagcagatgttgccagttttgatttactctattgaatttgtaaaacagctattgggaaaatgaggtacggagttgagtataaaccattgcagttcaagaatatgcttatccagggccaggcatggtggctcaggcctgtaatctgagcatgctgggaggctgaggtgggtggatcatgaggtcaggagtttgagacaagcctgaccaacatggtgaaaccccgtctctactaaaaatacaaaaattagctgggcatggtggcgcgcacctgtaatgccagctactcaggaggctgagggaggagaatcgtttgaacctgggaggtggaggttgcagtgatccaagatcatgccactgcactccagcctgggaaacagagtgagactcagtctcaagaaaaaaaaatgcttatccagaggagttatttaatcagttttgaagattacccattgtctttggttggtcgtctctcgtcatccatccgctctttgtcgcctcctcttctctccatcactcccttcaaagagctggatttaaacaaaaaatattaataataattattattattagcattcgaaatacaagtaaataccaagaaaaaccagtctataaccctagatgagttaaagatgaatattcacagtttagtagatttttatttccggtgtttttctgcctatgccacatggacatacgtttgtctacatttttcagttttttttttactttatatattatcataagcatttttcctaagacattacagatttatcttaagcaccttttaaaattggtttctgttcttttgatctgttcctgattgctagcacctctgcaggaagataaaagatgtatctcaaaccagtcctttttctttatttttgtttgttactcatagagagttccacttgaatctaaatgaaatggtgattacttgtgaattcttaaccatctttccccttactgtgaataactaatagttggttatggttgataacttactaaaaaaagctattaattcgttattttaagactactgtctgtgaacaaggcttttacctttgtttctcttaagaaagtaagggagaaaggaaggttttagtaacatcaaaattgtttttagctaatatatgtatagcattgagtagaagatagagaaccaacctttcaagaggactttggtttaattggagaatcaggacttagacattaaaagggaaatattgtagcaaattacagtacagtatattatcatagcacattatatacacctttgtagcattgtattctgtctagtaattgcttgtttacctttttgtcttctgtacatttgtgagaacaccttgaaggcagagactattatcttacttgtctttagttttcctaacatctatttgtggtaccaggcacactaagattttttttttgtttttattttaatgaatgaatatgctgagtgccacattaatgatacaagaagtctgataaagtagaaagtagtgcttattgtacctaaggtgatctgagactttatggaagaagaagggttctagctgactcttcaagcaggagtaggatttagaaggcaagagatggggggatggcactgtagacaggggacaaaagtacagagaagcatcatataccaaggatggcatattggaagcactgagcaagccagttggcttggagtagtttgcataggcaaatagtagaaaatacggttacaaaagtaggttgaagtagaattgtaaggggtttagaatacagtgctaaggattattcattgccagtctaagctgtgattttaaaaaacttccacagccttaggttttgttttccttcttcctagtatgatttaaccaagacgttgaaacttttgtgagatgttcatgatttgaggataatatttttttctttatggtactaaggatttcagaaatttttaatgcctttttagccacttgctgttaagcacgcttcctgaaatagttacgaacttcatgtgtatacattagtttttcagaggagtcagacttttattatacatttaaaaagaatgtgtagttgcttgctgattatattccctcaggatctttaaattaattatttcatattcttcacttgtttcaaaggctgttcttacaaatagcttgctttgtgtgcttttggtatacaggatcttctgagggaagggctatttatcttttaataaagttttaattttagaatttttgttttagatttatagaattgctgccaagacagtacagagagcagagagttcctaagtgccccacattcagcttcccctattgttaatatcttatattactatggtacatttgtgacaatttgtccacaaaccagtaatgatatattattattaactaaagtccgtactttattccgattttaaaaattttttcttaatgtcctttttctattctaggataccatctaggattccacattgcatttagtcttcatgtctgtttgggttccttttgtgacagtttctcatattttccttgtttttgataactttgatggttttgcagagtaactggccaggtattttatagaatgtcactcagttgggatttgtctgattttttttcatgtttaggctatggttatgggcttttggtagaaagacttcagaggtacaaatccattttcatcacatatcaagtcatattgatagccacatactattgatatgactttgcactattgttgaccttaatcacttggcttgagggagtgtttgctaccctgtaaagctactctttctttcccccttttatcctttactatggaagggtctcactgtgtgcaacccacagaagtgggagttatgccctctttgagggcagtatctacataaattatttggaattctactgcctggaagatttgtctattctctccatttattaatttattcaatcatttatttgtatcagtatggacttatagatatttattttatactttgggttacagtccaatactatgttatttattttgttcttcaaattcttccagctttggccactggaagttcttccacttggttcctatattcctttgatatgcccccatcattatagatgtttttatttgtttgtgtttttttgtggcattttcttactttctggcactatgagatgatcttggctcatcttgtcagtttcctgctccagtcttagtatcagccatttctccaaggaacccttgtcctttttattggagaaaggtcttagaaaccaagatcttagtgccagatgtgcttgttgctactgggatgtcattgcttttatttaggtcctttcagctcacagagcaaggaaatgtgcatatctataaatatttgtctatgtagccatctgtacctatattaagggaaacatgattttactgatgtcttcaactcttatctacttccacatggatcattctagtcaccaggaaggattattttaagatcccatttgtgtatgtactgacgtctgccttcctgtgatattattcctttttgttagttaattcctactacaaacatgtattgagcctgtattatatttaaggcttgcactaggtgcaagggatacaaaaatgaatgattcattgatgcattcacagtttcttcaatacctgtttattgaatacctcatatttaggcactgtgctccatgctcacactttagtagtggagaaaatatggctacagacagttatgctataaggcaggatggaactgtgatacaaggtagaaaagaaagtgtgttcttgtgttgctattaaatagtatgtaagactgagtaatttataaagaaaagtagtctatttgggctcacagttctgcaggctgtacaggaaacatagtgctggcatctgcttctggaaagagcctcagggatcttacaatcatggcagaaggcaaaggggaagtaggcgtatcacatggtgagagcaggagcaagagagagaggaggggggtgctacacttcttcaaacaatcagatctcatgtgaattcagagtgagaactcactcattaccatgaggatagacccgcccctatgcaccaaacacctcccaccaggccccacctccaacattgggagttagatttcaacatgagatttggaggggacaaatgtccaaactgtatcagaaaggtaataacagagttcaaatgaagaagaaattacttcaggaaaggcaatcacatgatgaattgtagcagttagaacttgatgagatgcaagtgacagaaaatacaatcaaacaggtaaaaaaaaaaaaaaaaggaatttattgattcatataacagtaaagaccaggggtagaactagcttggggtgcgaatagttttagggcttaaacaatgttatcagggctttgctctgccttctgctcacgctgatattactcttaggctcttcctagtatctcctagtacttctaggtgaacatcacaacaccaagttccgaagaaaagaaagtctggtatcacaaagtcttggaattgagacttgtcttgactttcctcatataggtcattgtatctgtgaacattattgctctggggaatagaatgtgctgatgagcttagctttgtacatgtgctccatctgtttcacagatgttgattttgtgattgttattaattaaggtattcatttttgttttgtgaacttgtccatatatttgttatattttgcaataaagttttttttaaaaaagctaaatatattcagtatataaatattaatcaatgtaattactcagattcaggtagtccacttaatcctaagatggctatctacaaagaaatttactcctagacacatcatggcaaattacagaaaaccaaagacaaggagaaaaatctaaaaaaagaaaccagagaaaacaaaagagcaaccattagattgttagctgacttcttaatagcattaatgaaagagagaatacagtttagtgatatatttaatgtgataaactaaacaactgtttaaaatcctatacctagcaaaaagatgattgactaatttaagtgaaataaatccattttcaagtaaacaaaagcagagacttcatcattagcaaacctttgctaattcttcagggagatgaaagacaaaaatctcaggtggaagatagagatgcggaaaggagtaaacggccacaaaatataataaagggagccagtagctaaagagggtataaaattataaatcatctagagggtgttttagctagaattgttttatacattttggtgattattaggatttatgttcccaatatacttcatgtaggcaaatactagaattatgtgacttcttggtgtttactgatttgggagtggggaagtgagtgactgtagggtgaaaaaagaaaatgacattaaagctttgttttgcaagtagataatttagtgttgaccatgtctgccatcctgctttctacatttctcttcttgtattgctgtgtggtgctgtgattatttcatggggaaatcaggaatgtattgattgctggatcctagctcccagagatttcaatttatttatttagtctggggtagaacctgggcatcagtggttttagaaagtcaattctaaggctgggcaacatggcaaaaccttgtcactacaaaaaacaaaaattagccaggcatggtggtgcgcacctgtaattgcactacttgggaggctaaagtgggagaatcgtttgagcctgggaggttgaggctgcagtgagctgagattgtaccacagcactccagcttgagcgacagagtgagaccctgtctcaaaaacaacaaacaaacaaagccaattctagtgttatagccagagtcgagaactacaggtattgaaaatgaacatgggcgagacagatctgaactctagatttagttttattgattactaggtggattatgcaggatctatgtatttatttattgataaaactgataagtacctgtctcacaaggccattttagggaataaagacagtaatatttgaatgtaaaaatggaaagaaaaccagaggtgtggaggccaaaatgaccaaggacaacatataatcattaccagagagagcttagcacatggatgtattttcaaagaagccctaagtttacctttgtaattgaagcagtttgttttgatttttgtacttatctttcaactcatatagcaatgaggttttgtgcttaatgaagtctttaggattgggattgctctgctgtacttgggttatctacaagaatgggcacattacagaggaagagtctcataaattttgaacctggttctaatatatgttttctccaacatttttaaaaagcaaaaaaaaaaaaaacacttagccattaaaaaacatttttcagagaaattatctacatcctgctgagaattttatgccaaactgcagcccccacacaagctttggagagccaagatatttaaacctgtaaaggaaaacgccagctcagcccttacactggtttgatgtaatcctttaaccacagaatggtttctagccttgaattgacaatgactcagtagaccttgtatacgttttaagaatgtttttaagtaggtaggattacaaaaatagaagtacaacattattatgaacaaaacattcaacacattgaatacagtttcttgaatctgtttcaagaacatttatgaagaaaccagattgaaaaataaagtctggattattatagaattttcaaaagaaggacagctaattacttatagtatctaaaatagtctaccagaggttatcagtcactttttaaaatcaaaggaggtggttctttaggaggttaaaaaattaatttgcacaaacactaattgacataacaattacatataatttgtgtgtttaaagatactttttttttttttttggttaagatatggggtctctgttgcctaggctggaagtgtggcggcacaatcacagctcactgctgcctcgacttcctgggcttaggtgatcccacctcagcctcctgagtagctgggaccacacttccatgcctggcttaaaaatacattttaaaaagacttatttattttagtaatttgaagatgtttccaaggttaacatgaactttagcctagttagcgcctctgggaattatttttaaaaagcaaaatgtgtctcaatgagatttgactttaatttaaaactaatttaatgtactagttaaccatttattttactttcaactactatctaggttctactccaaattcagtaaatctatacagattaaattaaaaagcattttcaagttgggaaaagagataactatttcaaacttttgagtttatatatttttattgatatataaatagaactgaatagaaatacttttggaatgagctatagatttattttatgtatgtatcttgtctagttcatagtgaatacatcatagacaaccttagctgtgttttactgaattagaaaatctgtcatagtgattgtcaaccttttaatactaaacacaaataattgaaatactgtctgttaatctaaggattttgacttcctgaagagagctttaagtccatttcttatgttttgttagtattttttggactttttaatttgtaattattaaatttgagataaaaatttttgtgctgttttgcagcatgccctgtgaaaattttctttttcaaggaaacaatgcattttaaaatgtttgtaacatttagaataaaggactaagggtgttttgaaaattgataaatttttaagccagattaaacaattaagattaattgcataccttctttaacttttagcttcatgtcatggctataaatttgtaagtagccattttagaaatccaattataattcttaggtataattttcagaaatcaaaacaacaaaattaattacaactgtagaatttccttatttgaaaaactttctattttggggtattgtataatgaatccccatggatctcgtttcaataattgccacgtcataatcttgtttcatctatactcctattcacttactgcctagtagcattgtagtttgaagcaaaccccacatattatgacacttcatctgtaaatatttcagtataatatgcaaaaatataaatcttttaaaaagcataaccaaaataccattatcttatctaaacaaattgacagtaattccctagcatcatcaaataaccagtcattgttcaaattcctaattgtttgaattaagatctatgcattgtgattgttatgtcaagtctttttaagttactggttttctccatcttttttttccccttttttgcaatttatagctgcagaaacagggccatttgtcctagaaaattaccacagactagattttgctgattgtatctctgtggtatagtttaacatgttcctttcttcctctgcagttcatataaattggtagttggatatatgtcccaaatttcttgtaccttaaattacttggtacatagtcacaaaccaaaagtaaccctggtttcccctaccatcctggtttctaaattttgtgaaatagctgaaataaggactatgtgctttattttatacacaacatatagaggcatctttagattttatttagataattgtatataatgcttgactgaagattagaatttgcagtgacattagttttagcaaaatgagacaaataagtgtatagcaagtagaaaataactattaaaagcaacaaggattctaaaggtacagtatcctggtgtcatttattttaaggacaggtagcctattcacctaaaacgtccctaactatatcactctttttaaaaagtggctatctgttcttataagaatgacccttgttcatcaagtaaggtgaatgatactaagtatgctttattttaaacaataacaggagcaactagagagttagcagtttagtttagcacttgaaggattaaggaattatatattgtagttgaaaaatatggtgatctgtttaatctgtaacctctgtatacgatatatttaatgtgtgtatattaatgttaggtgtcatatataaaaattacagaaattcttctgtattgagaattgtggggaaataaggtatatggattaatccaatattcagactcataaaaatatataagctatatatgggccaccagttcttttaaaataattgattttttaaataaaataccccttccactaaaagtagaacataatttgatctttttttttgatggtttggaagcatttaagagactttatagcatcagtattattattaaccttaattatcattatattgtagctgtatagcagagttgattaatgcagagttccaaagtaatgtttgttaccagagaattttcactggattaagaaagcctgaatggtagtcacagagaatcacataaagagacaggaactactatggatgcatatatatgtgtggctgcatacatagacttatatttactcatgtgcacaggtgtacatattatcgttaaatttataatgtatattgttaaacatatatacatatatatcaacctgtgacatgtgcagccattaccagtactaaggaagctgcaaatggaagaaatttgatcaaaatttaccaagaggaaattggctccaagacataatgcttttggctggagaagatagtgatcctggcacagtatactctctatttccttgttagagctccaagattaaaagaattagctacatagaggcagatgcttggtagctttctggaagcacaattataaggtttatgaaaaacaggaagatcaacatcacatacaggttttatgaactgggaactgatttaatgtgctattttgtatcccttagaccttgtctattgagccataataatttcatttcatttttataactatttttactttcttattttaagtgtgatagcctttggaaagaaattatgtcttagaatgcttttaagatactgtttttcagattgttcaaactttttgtgattgatgactataattagtcatattgcaatattgtattttcagaattgctctccaattttcttttctctacttctgctaataaccacagattaacttggctcccagtagccagtatctttattgaccctggaaaatgttttggatcctttaatatacctaattttgtttataatgaattgaatagtagtgatcattcacttgaaaaataatttgagtgcccattttgaataacccataatgtctaatgcagtatttgcatagagatgaataaaatactgttcctgtcctcccatagtttataatctcatagaaagacagtgatatgaagtaactgtattacccagacaatcagtgatttcttatgaacattagtgggtgcaataaataggagaggtttcttttcatctttaattttcaatgactgagaaacttcagctattcttttgcttacatgacaccaataaacacctgatgcatctaccataaatgaagagaccatgggaagaaataaacagtctttttaggagatgccctaaaatctcagtaatcttacttgtagcaggggctacgaactcaaatgtctgaaggagccagtcaagtgtacccaggtaacacaaatgaatgaaaaagtatgtatgaaacagttggaattggtggggattgtgacctgctgaagtgtgtatgctttgtttaaagattttcaaataaaaatttgtgtgggtcaaagaaagcatgtctgcaggctgaggcggtcaatttgcaaatgctccgtaattccttaatcttaatgaaaccatcacaaaaacatttgagagaaaagatgatgatttaaaaattaaacacaaataaatatgtccaatttgagaatgatcacaccattgagtaagctatttggcactttccccccagggcaccagtgacattaaattggggtgatgggatctcacagacagcctggatgatattacagttctaggcagatgaaaggatcaagtttagtaaaattcattactataggagaagcagaaaggagcaagagtgatgttggctctccattgttgaagatgttcttcccccctggatatgggcagctctggattccaggtgatattcattgttagaagtagaccagaggtctggagacacaacctgtaacttcctgggatacgtgtggggcaactagtggaaagctctagtgggtggagcttttagccatcgtttagtcaatggattgtatgtgaaggtctagcgagtttatatgaaattatttgggccttcaatcacaatgagaaaattcatcggaaaagtaagtgttctgggttttgcctgctatgtgggtgcctgaacctgactccaaaatcatgaatagattgtatagggccaaggagcaggtctcaccccaggcatacttaatcagtgtatcagagggttggatctgatactgtgtctttttaagatgcttccacagttattctgatgatagccagtgtggaagctagggtagtaggtagaaaaggttcatatacttgtagggaaatatcagccttccctggttaatgaagattgcatattggcagccttctattaagggatttttaaaatattaattattaataaatgctctttattaataaaaagaaacctagtctgtttgacgatgagttgatggcagtcgaaattggtagcttgggatgttaatgctttgttaaggttcgtgaagcacttcattggagagagtatgtcttcatgattatttatcctgagacccagggaaggctgtttggatggtaccatttgaaacagatgcttttatttaagtttactttgagaggcaccacagttttgaaagaactggtgaggaatgggtttaggggctagagacggatggcagtagtttaaggaagtgacagctgatgaaacaataatcattgtgtattgctaagttgataaatggtttgaaggcagtcaccatggctgccttctggggacccattttaagcctcctggagagagaatgtgtgcaaaagatgtaaaggtttactggccagaggcacacatttccagtgtggcatggagccagcattcatatgataccacaggacagcttgtacatactgaatatgttccagtcaagtggaggaaaggtaaaaatatctcctgtttaagggactgtgaagccagtgaaggcctcctgtctaagctcagtgctaaagaaggactggggtactgctcattgtgtgcatgtcagtaatcaaagacacatgtcagtaatcaaagggtccttatttagtctggaacagttgttcatttttctcctttatgtccttcaatgggactgttagcttttttataagtttcacttgattacccactgaatcaaataccttattggtgtttgaaaagatctaggatggggaacatctcagatacctctttcagatccattttaacttaaatttactgaatgagttgtagtatacaaaaatatagattctgtttttcctcttttccttattatttattttttccttaagaaaaatcattataatcatcattgggttagtaaaaatagattaatcctctatgtagatttttctgcagataaatgtaggaagctactcaatttttgtctctggcagaaaacccaaaccaaatctatacttttggttgaagtgctcttgaatagttatatggcctagtaagagcttatgtgcctcttcctctgatctttcccctaaagaggtaaaagggtgataatggtgttgtggtgtgtcagtgctcttttattttcttattattctttatttccattttttttaagtgacaggaacctgattcaaactggctttaactataaagagaattaattggcttagagaacttaacagtccagaattgagcatcagacaaagcttggtccagtggctgaaataatgttatttaaggacctggtttcttcccatttcttttcttctctgctcttcctcccattgtgttaacttttagtccccatatccacacaggttcacaagtcttttcccttgtgaataaaaaattgttactccaattcagactttatattctcctttcataggaagaaagaaagcctttatttctcagcagtcccagctgatgtctttgtttatctcattgggtttgactggatatgtgtccagtggctgaatcaaacattgagctaagtgcataggcaatgttgatggggttagatagtgaggacctatagagcttatagagaactggaggttcccactcaaaacttatgcctgagaatggggaagggaagtctcccccacaaaatttggtttggtgttatcagcaagaggggaatggatgttggacgtgaaacaatggatgtttactaaatgtatgtttagaccaaggatattatatggatctggggataagaggtagagtttttagggagaagagtaaagacattgaaagctctttagtatcccgtgtattgtgctttgtggatatcctttccttcagttgagtgtctattttgctttgctttttctttcttgctcttatagctgcatgtggctgttataacccgaagagcctggggtagtctcgttttcattcagagttctacctgcccatttgcacataagttgtgttactaggacattggtggttttaagacactggccagaaaagcctatagctgggatttcgactaagaggaagagggtctggcaaatattgcaggtctaaagtccagggagctcagctaagatgtggagaaacagttacataatataaatcattgtagcccaggggcctattctcactagggaagtcatctagggcagagatcagaaactaggtgtcagagcctgcagatgtttctccagttgtaaataacaaattggttgaaactgtttgctcttcttgttccatactgcctattcctgtgggtttgtttgtgattatcatagtcagaaggaaatcagaatctactgtggggtctggtgccgactgagacaggaaaatgttactatcttgatctgggagaatggataggagttccctatggctataaaatattcagtgccagcaaagggtcactaagcttaaatgatctttcattgtgatttaaataatttgctccaagtttaaaatctttggacggaattgggattcttaactctctaagtttgaaagattcctgaagacattttctaatgaaaagtgtaacactaacaaagtgtttgctttaactaaatgattgcagttaatttcttgtaaagaaacacagaagcacacattaacttaaaataagctcacactgttgtttcttgtagtacagccaggaaaaacagtaacaagctgtctccttcaaaatcacatccctggatgatattcgagcaacctggaaaatttaaatacttccccaggaaaaacaatttgaattaagttagaaatcatatttgctaattccctttctgccattgcctttcattctctgggtctgagtagcattaattgaggtgtgtggcatcaatagctaaggtaaatggtgacattcattttagaaccacagccaagctggggccacaaaaatagttttaatgtttaggattcataagtcaaattttagcctacattgacattttgtcctaataatattaatacatatatttttgagaaaccactggtttaaaacttgagcattttggccccaaatagatttgattttgtatttaaacgatattaccttaaaattgtgaggataaagacaacacctatggaagaaatagagtatatttagttgttagtcactctagtactcttcacggtgcttatgttcaataatttcagtgttcttggccttagttctctaatgcgtgttttggaaaatacattatttttattctctgcgtggttacagttttaagagaaaaatggctaattaagattcttttcctttggagggtattcttttcattcctgtcccacttgagggactttccaagatagaaaggaatttgcctactttctttctcttaataaatgaggaagattagatcaagagatgtggtttaaaatttcttcgctctccacttctctcccacctttgtttcctcccatttatccatccccgattcttaagaaagaaacacaagttggaattaagctgggtgatcctagagactcatttgaagtggaaattcaagatggagtggggctgcatactggttaccttcttttaagaggaactgaaaggtaatctatatagcaatttctgatgggcaagaagggacatcacaggcttttgaattttataaatggagccataattataattagctatcattttgggatacttttgcatgttttaggtttaaagcttacttgcctatggaggaaactagacatgtgaagtatgccacctccaaagattctgacaccctggcacaaaattgagatgataaattctgataagattccaccagtaggtcatctcttggtagatatttgaacatgccctagaattcctctgttagttggaagtttggcttacctagcaactgggtgaggctgcctactgaatggcattttgaaaagttcagacttaaaatttcctattttgttttttctccattatgagtcttaccagtcctatcacaaacttttatgggaaagtggtttttcagctacaaaggtatttgtgcattttgcccaagacatatgtcctcctcaagaatatataactgtcatattctgtattgacatgagaatcaggatcatattaccacaagtagctagaagatttcattggttgtaagccagggaatggtctgattgattttgtccagcaagtaaaaaaaaaaaaaaaaaaaaaaagctcttacacacacacacacacacacacacacacacacacacgtgtgtgtgtgtacacgtggctcacagtgaagttggttgttggttgagaggcaggtcagaaccttggagagctcaagataaaggaggggcagaaccacaatcagaagcttccatggcttccatggctgctcccaaaaactccccaaaacagttgagtttttctggagcaactgccagctccactctgcttatcgttaagatatgtaggatttaagaagataaatcccttttactccaagcatgagctgcatatttgttgactaatttgataatttgtggctaaagtcttaaaaacaaaaactgaaaggaaaaaaacaaagggacatacttttcttcacgtttttgtgaagatcctatgccattcctccatggccatgttatgattactgattccacttagcagggcttctggtattgagatgagggtcacatacaggatggggggaggtaacattaagatttcactgaactattcactgtgtattagactagatcaatttttccaaaaaaagattcttttcaaataacaacatatttgataaaactccaaccaagccaaactaaaacaaacaaaaaccagaacaacagaggtgttctggttaaaacaggctttagaaagcctgaagtgccttctgttcagactaattctggctccaccagaagcccccaaacacaagtcgcaaatcaccatgttttaccggcatacattcagtttacttgacagacacagttcctaagtaaatgtgaggacttaacctaactgtgtttctaggaatacttttactagcccaaattaatcccagaagtggccatttattggtgtctacttagctattcatttggatggcagatatttgcatttctttctttctttttctttttttttttttgccactcaacttgtttatggttaagtctcagcttcaatatgaagctggttttttttttttttaaatcaaaaccctgcattttacatgctaaatatcttggcaagtaggttgttaaacatagtaatgaacttaaaacagcgagagtgaggagttaacaaaaactaaacattgcagcctaaacaaaattcatacaaaaaataaactatcactggttacataaaattttcctgactggttaaaacttagtataaaatgtgcattttagaatccttagctatcaagttcagaaagtaccagtgtctatttaaaataattcctttcccaagccaaagcgtaatcaaaattaattcaaatgacataacacattctaatgctaaaaaatattcattattattgaagtggaagtaaatcccagagcttttgggtctttctcatgctgcaaatggctgtttctctggttcactcaaagcagcatatgacagcatccaaggatgacactaagctcagtaaagggcaagactgctggtagccagctctgaccttcctgtgaagcatggctgctgtgtccacaaaacagatgtgtgaggatcaaaggcacactattctgctagctaaagagatagcaaaccaccccctaaccctaaaagctccttccccaggtaaataaaggtatacaaggggaaaaattaaaatacatttatctacagagtaagggttttgaaatattaatttaatccctccttcaaaaattttaactagagtcatctagtcatttctgatcacatcttaaagatgtatccagattcaatttctgttggtttatctttagacacttctagtcaaaagtattaattttattcccaaatatcttaaccactaatacaactgcagtgtattatctaccagagttatcaagcactggaagagaaaaaaatagatgttcaagcagcaggcagcatttatggccctttcacacagtggcatctgagtggctactgaatagtccaggaataattctaaaaacaagaaaattcatgcattttagtaaatatgttatagttttcacagttgaaatttcctcagacattgtgctttctttataagggaatcctgatttttctgaatgttatggtgagtcaggacttgaactagcaggcttctttttcttcttccactgtttttctcatgcttctttttctgttttgtttttttctgttgctttttctcgttcttcactgcttttcctcttttttgctcgtacctcctccatatactctgattctgacaaggactcagatgataaaggtttatcttcagaatatatctttctcttttttctgagtcctttaatgtccttttctttctcagttgcatcttttgacttctttttcttttttaaattatccttactgtctgattcagtttctgacatggacctttcagaagatttatgtgaacggttctttttctttctcagttttccgtgtttcttacccttatcttcagaatcagaagaactgctggaagaatcagagcttgatgaagaagaagatgaatacttaccagatttcttcttttttctttctctgtctttttttggatgagctctcacttgcacttaacaatttccccctgtgtttttctagttctttcttccagttctcattcattttttcttcacattcaaccaaactcttggagcctttctttttcttttctagttgctcttttacttcttcccaggtaggccttgatcgattcagataatcctgtatttttggccctgaagactggattggaccccttgatctcgccattgctgttgggttcatataggctacccatttgtcccacttgcccatggtgctgggctgagcacacagtcgcacgccgagggaaactgggccggagagatggccgaagcgggcccgccgcaggtgcatttctttctaattaacttctgtacatcccagaatccactgtgttttagactgcaatgaacagcttcaaacatcatagcaacaatctcatcagactctataggctctgcttacaagggggaagagaattattagaatatttgaaaacaaagccatggaggatcacagaactaccctgtttaatttttttgccttaccaatatttatttctatcagtgtgctacaatttgtagtggtgaagggtactactgtgatattctttcttgtctccacttcattttgttcgtaatagttgaaatttatcaagaacaaaatcccaaaatataatctgcaagttaaaaccataagggatgtgattggcagtgctgtgttacctttttttgttagccacatgactataaatatttgaagggtatttacatggaagaaggagtagacttgctctgaatagtcccaaagttagtttttcttaatccagcttctctttctcccatcctcaaattcatgttatgtccacttgactttacaaaatttggaaattgttatatttgaagaaattaggaaaatatgtttaaaatgatttcatttcaattgttttagatgatatattagaggaattatacatacttaacaaaatgtacggtgtaaacacttattgctgataatacttggtcctcttacaaataggtcaatagcaaatttatttttgttgttatccttggtattctgcagatggagtgacattttaaaaaatcatgcttgttcagttccagttttgttagaaatgtaaaatgttgttggtgatttcctaagacttcccatttattttatttttttctgcatattctgtataatttattcatgattatagacattagaagtttaaaattagaaattacctaatgcactattactaagttgtagaaagatttttacttttttccttttcaacagctttattgagatctaattgatatgtaactcatccatttgaagtataaaattcagttgtttcagtatatccacagagtcgtgcagtcatcaattaccatagtgaatttagatcattctaatcattcccaaaaagaaactgtgtatgcattagcagtcctcattttcccccaagtctccagccctaggcaaccactaatttacagtctgtccctatagatttggcttttgtagacattttgtataaatggattcatacaatgtgtggcctttaggtctggcttcttgcacagcttaatgtttcaaggttgatccctgtcatagcatgaatcagtatttttattgtggaatgatattccattgtatgtgtgtacacattgtatttattcatcattggttgatggacatttgggttgtttgtactttttagctattaggaatatgctactatgaacatttgtgtacaggtttttaaaaattttttaatttttgtatttcagtaggttttgggaaacaggtggtgtttggttatatgaataaattctttagtggcaatttctgagattggtacatccatcacacacgcagtgtacactgtgcccaacgtgtagtcttttatttcttgctatcctcaccctttcctgagtccccaaagtccaatgcgtcattcttatacctttgtgtcctcattcttatacatttgtgtcctcgtagcttagctcccacgtgtgagtgagaacatacgatgtttgtttttttattcctgagttacttcacttagaataatagtctccaattccatccaggttgttgcgaatgccattatttcattactttttatggctgagtagtattccatgatatatatcacattttctttatccactcgttgattgatgaatatttgggctggttccccatttttgcaattgcaaattgtgctgctgtaagcatgcatgtgtaagtatctttttcatataatgacttcttttcctctgggtggatacctagtagtgggattgctggatcaaaaggtagatctactttcagttctttaaggaatctccacactgttttgcatagtggttgtactagtttacattccctttttttacttttataatgtaaaagtgttcccttttcaccacatccacgccatctgttattttttgattttggtcattcttgcagaactgaagtggtattgtgttacggttttgatttgcatttctctgataattagtgatgttagcatttttccaaatgcttgttggccatttgtatatcttcttttgagaattgtctattcatgtccttagtccactttttaaaacattttactttaagttctgggatacatgtgcaggacgtgcaggtttgttatataggtatatatgaaccagggtggtttgctgcatctgtcaacccatcatctaggttttaagccccacatgcattacatatttgtcctaatgctctccctccccttaccccccaacccttgacaggccccagtgtgtgaagttcccctccctgtgtccatatgttctcattgttcaactcccacttatgagtgagagcatgcagtgtttgattttctgttcctctgttagctttctgagaatgatagcttccagattcacccatgtccctgaaaaggacatgaactcatcctgttttatggctgcatagtattccatggtatatatatgccacattttctttatccagtctatcattgatgggcatttggattggttccaagtctttgctgttgtaaatagtgctgcaataaacataggtgtgcacgtgtctcacttcttaatgagattttttttttcttgctgatatgtttgagttctttgtagattctggatattagttgtttgtcagatgtatagattgtgaagattttctcccactctgtgggttgtctgtttactctgctgatagtttcttttgctgtgcagaagctttttagtttaattaagtcccatctatttatctttgtttttgttgcatttgcttttggattcttggtcatgaagtctttgcctaagccaatgtctagaagggtttttcctatgttatcttatagaatctttatggtttcaggtcttatatttaagtctttcatccaccttgagttgattttcatataaggtaagagctgaggatccagtttcattcttctacaggtggcttgccagttatttcagcaccatttgttgaatagggtgtcctttccccactttatgtttttgttggccatgttgaagatcaaatggctgtaagtatttggctttatttctgagttctctattctgttccattagcctatgtgcctatttttataccagtaacgtgctgttttggtgactatggccttatagtatagtttgaagtcgggtaatgtgatgcctccagatttgttctttttgcttagtaagactttgcatttagatgaatgcaacacaaaagagttttggctaaggaaagcacaataaactgcttcaactgtgaccactacactttagcatgttgcattagctttctggaaatgttctgcaaggctcagaatttaagaaatagtaaattcaaagttacttgaagcatacgtgtttagggccaaatgatgcaagatttgttttccagacggttatggcactggctaacttttttagttgtgtagaagagacaattggagtctgacgtcataaaatgtataaatgacaaatggaatttcttaaactttgagattgaaaaacagaaatgaaatatgtgaagtgtgaaataaaagatgtgaagtatgctattatgttttcttaaaagttatatttccattatgaaagtatgtgcatgtcttatatatgcatacatacatatgcatgtatatacactcagaaaatttggaaaatacagaaaaacaggaagaagcaaaaaacttttttaaatagctcccaactatggatatcagttatcaacatttctcccaataaattttccatgttaagatggtttttgctgtggaaggttgggaggggatggggatagccaagttgtaatcataatgtatatatagatttatatctctcctcatttagtgttttaacaaaagtattttctgtgttattgcaattgtttctgtgctattgtaattgtttataaattatatatataattgtataaacatactgtaatagtatagaaacatagttgcagattatttatttgaattactttaacagtttttaaaacagttcttattatcaggtatttagattgtttgcagtttcatgatattacaaatgactctatgtgtatttctgtctataaagtcccccccgttatttttagttatttgcagattagctagattcccagaaataagatttctagaggcattgagaataaacatttctaagactctctgtctctctgacacacacacacacacacacacacacacacacacacacaaactacttgtatgagtttacaattccttgtgtaaaaggtccatgaaattatatcttcaccaacattagctgtttgctgaaaaaaagaacttgactaatttaagatataaacattgtttctcataatttttgcccaactttcttctcttgtgggaaatgctgggtgagggacaggccaaatcagagggttccatgggagccagaaacaatttgtggagctgaagcactatcaggataataagttgaaagtaagacactgatctgagggaagcatgcaccatggaagcagtgtttggagcttcaaagagtgggagaggcagcatagagtggcagagccatgggtcatgtggaggaacttaggaagggtcagacattggtgccgtgtgcaggccctgtgtgggggaaagtatcttctctagggagaagatctcataatataggctggagggagacttaatattgttctttacattcttttatgccatttaaaaaatattcgttttaccgtgtgcatatattactttttcaatgaaaaattagtttattaaaaaggagaaattaggaaaattatacttccttaacactaatgggcttgcatacttttcatatattgtcagtctcttttaatttccttttattttatcgatatgctagagagttgggcaaaattttgtagtaagaagtttttgataattttcttgttatatttctaatgtattcctgtaccttatccttttattagttgaacatttttatcataagattaatttcattaaataatttttttccccccggaagatttttttccctccctttttaagcagagatggttctaagtctcatttcttcatttgcttagtttcctcctttatctccccacagacatggacagactacattgtttctcagtgttttccgtttataggtatcctcgcgcatgtctaaatttgtggcactgtggccaaaaaactatgggttttgataagtggaaccggaattgagggtgagctaggccttgaaactactattcctcactgtctttctgaagaaggaagctctgataaggaggagctctgaggattggttgggcttgttcaagtctgcggagctattgatatgggagcacataggtacgtgatggagtgtatttacgagagagaaatgtgggaaggtgaggggtcacatgaacttggagcactggtcctgtcaggcagcctagacaggggagccaaagtaaacaattcaaaattaccactattcatgagttcgctcatgaccacaaagaggcaagtgccagttcgttggttcaaaactgatattttagttaactgattggaggaagagtaggcagatttacattctacacagtctcaattattgtttacacgtgaatgtgagcagttatttaatctctctagttaactagtctttaaaaagaattggcgtgataccttccctgaactgtttcataggtgtttttgtgagaatgaatgaagtttctattataaaatagtagtgaattttcttttgcttttgtttattttctttgactgtgttttatcactttctctgaatgcgtttttcattcctcatttttggaatccttttttgtatgctcttttctctgttaatatgtgatgtgccctgtgcctactctttgtgaccatcttcatttcagatttcttccttcaagcattaccaaaaagatgtagaagaagaactttgtgaatagagagagaaacacttatttttctctttttcatagatgcctgctaacttatgcctcctcctcctctttccctgaaggagctttgggcatttttctgtatctcctactcaagagaatggaaagctccaatgccttgtattgccagacctgtttttaaaatatgccctattcttagggagtaactaaaactttatatatcttctgttttctccccttctaggcaaagtggttcaaaccacaaattacctaacaagtaaaagtggtcgtgtagcaatactagaggaatttttatcttgtttagtatagctaaaccatccttgattgggagtgttttccagtgagtttgccttgaatggctaaggagatcaataaagaaattatattttaatggaaggagactggttggtatgtctttaaccatttgtttgaatcacttgaaatgaattcaagttggtaaggtatgttgccaacttatatgtttttataatttttaaaaattgtttggatataggcctgtaacttgccaaataactaaggagaaatgacagaatttaaaaaatataaatcaagacaactaacttttctttttgctctagtagggaatgaggactggtaaggaatacttgaccaagaaatgaaatattgtattttattcttgcttataaatgtttagcaatgctctctgaaggaaatgcatagcaagctatgttaggatcattttaagttctatacggtgctgttatatcctactgatactttgaatttagtcttgaacagctcagaaggagtttctggctattgaggtcaacagatttgccagggaaaactttgtactttacttatcaaatcactttcatatcaagatacccctcttattcactgtatgatgctgaagctcttaccttttcctctgttcatcatctttatctgaacatcctaagacccgtttttcctataaatgaaagaacacttatgaatttccccattgtcatttagttcctataaatcaactcactcagtagagcaaagtaattcctttaaaaaatgcattcctttactttttctttgttttcttttggtagaagctatgcttggtttgtccttaaggcaatataaagtagtgttgatggttctcaaagtgtggtctgcagacctctgaggatccctgagaccatttcaggggtctgcaaagtcaaaactgttttcataatcttattaagatattatggcatcttttttacagtgttaatgtttgcatttacgttgcagaagcagtggtgggcaaaactgatgacttggcattaaccacagcagacgtcaagctatactcatggttattttattctctgttgtcacacatactcagttaaaaaaacaacgacagttcacttaagaatgtctttggccgggcacggtggctcacgcctctaatcccagcactttgggaggccgaggcgggcggatcatgaggtcaggagatcgagaccatcctggctaacacggtgaaaccccgtctctactaaaaatacaaaaaaaattagccgggcctggtggcgggcgcctgtagtcccagctactcgggagactgaggcaagagaatggcgtgaacccgggaggcggagcttgcagtgagccgagatcgcaccactgcactccagcctgggcgacagagcgagactccatctcaaaaaaaaaaaaaagtctttgatgaagtaacaaaaactatgaattttataaagtcataacccttgagtacacatgctttcaatattctgtgcgacacaatgagagtacacatggaggactactgcatacctaagtacgttgtctcaaggaaaatcctgagtgtgattgagttccaagctgaactagctgcttttttcttggaaccatcctttttcacttggaggagtgactgacggatgaactgtggttattcagatttgcgcatttggcagacattttcccatgtctctattttatgcctatctttttcaggcctaaccgtcaccattgtgcttatatttctgtgaggctctagtgtttacagagcgtttatttatatctggtattacagatacagatggtctgtggatctgagttgaattactttagcatataatgctgaatttaggtagagatcaaaaaaattaaaattataaaagaataagaaacaaattaagtcttccagggctaaaattatggtcttctaggatatttaggtttcttgttttgttactacccggctttacacttcactttttctgcctattcatgatggaattccttctcaatttttctgcaaggatttttttagaaggcaggagaaattgccaatatcaaaagatttctctaacttcatctctgggtatatggctaaggaggagtagtctgttcctcttagatttctattactcttttcctctacattgatgtgtgaatgtgatactggatttgtatgaaatttcagttttaactggtcttttatttgttacgacttctacagaatcttgcctcctggaatccttcaaatcctgaatgtctcttacttgtggtgaaggaacttgtgcaacaatatcaccaattccaatgtagccgcctccgggagagctcccgcctcatgtttgaataccagacattactggaggagccacagtatggagagaacatggaaatttatgctgggaaaaaaaacaactgggtaaggatttttgagaatggaaaaaaagatgacttcatccataataaaataatcaattcatatgtccatttgtaaatcctagtcatttctttagataaacatggtccaggtagcctatatgtttctcataatttagagtttaaagagaccttaatgtttgtctagttcattgtgtttctcaaagatattacctgggaagtttgtaagattcagagtctcatccccagccccagatattcagcagtcagaggtggagcctgagggcctgcacgtgctaccagcctccatgttgttatgatgtatgtggcttgcaggccacattttgagacactaacaagtttccccctcctttgagtggaagacttctccaatatcccagtcaggtaagagaggtcagtaactctggaagcagctagcttacatggtgccttttatattttctttttgcaacttataattatatgatcctttaaaaaatcaagtcagaccttatcacttctcttcccagaaccttatgtacttctctttttttctctcatggtaaaagccaaagtccttccagtggtataaaaaactctatatggagaaatgcaaatcaaaatcacaatgagataccatctcacaccagttagaatggccataattaaaaagtcaggaaacaacagatgctggagaggttgtggagaaataggaatgcttttacactgttggtgggagtgtaaattagttcaaccattgtggaagacagcgtggtgattcctcaagaatctagaaccagaaataccatttgactcagcaatcccattactggatatatacccaaaggattataaatcattttactataaagacacatgtacacgtatgtttattgcagcactgttcacaatagcaaagacttggaaccaacccaaatgcctatcagtgatagactggataaagaaaatgtggcacatatacaccctggaatactatgcagccataaaaaaggatgagttcatgtcccttgcagggacatggatgaagctggaaaccatgattctcagcaaactaacacaggaacaggaaaccaaacatggcatattctcactcataagtgggagttgagcagtgagaacacatggacacaggaaggggaacatcacacaccggtgcctgttggtggggaggaggctaggggagggataccattaggagacatacctgatgtagatgatgggttgatgggtgcagcaaaccaccatggcatgtgtgtacctatgaaacaaacctgcacgttcttcacatgtatcccacaacttaaattttatataaatatatatttatatataaatatatatctatataaatatataaaaaaatataaatatatatttatataaaaaatatataaatatatatttatatatataaatatatataaatatatatttatatatatagatatatatatttatatatatatagatatatataaatatatataaatatatattaatatatataaatatatatataaatatatattaatatatataaatatatatataaatatataaatatatataaaaatatataaatatatatataaaagaaaccccaaaaaaagaaaaaacaaaactctgtatgattcccatcaccaccatcttccatccatcattaattttgtctgttcatctcctaccttcctctttcaaattcagctccagccacactggcaccctgctgtgcagcaagcacaccaggtattctcctgcccaagggtctttgcataggctctctgttgtcagagatgtttccctcagatatgcacatggctaatactcttccttcaaacttctactaatgttatgttctcaatgatgccatgttaacacccccagtagccgttttgaggtataatttacatatcataaatttacctgttttaagtgtacagttaaatgatttttaataagttggctgatttgagcaaccaccaccattatccagttttagaatggttccatcaccccagtgagatccctcatgtccacttacagttaatcttgttcccacctccagccctagtcaatcactaaactactttctgtttctatcaattttcttttctgaacatttcttatggtggaatcatacagtatgtggtttttgtgactgacttctttcacttagcctatgtttgaggttcatccatgttgtggcatgtatcagtacttcatttctttttatggctgaataatattccattgaatagacatactacgttttgtttatccatttaccaattaatggacacttgggttgtttccactttttgacttttatgaataatgctgctgtaagcattcgtgtgtaagtattggtaataccccttttaaacattgttttttacattgtttaaacatttttttaaaaaagacttgcacctctcctctattttttactttgctccacatggtttttttgcatttccttttggcatgccatataattaatgtattagttatatgttgctatgtaaaataatcattccaaaacttagtggcttcaaacaataacatttattatcatagtttttggcagcaatctgggtaggtcctttgtctcagggtctctcacaggctgtgcttgaagtgttggctagggctctggtcatctcaaggctcgactggagatggagtcattataaatgcatgcatttaatagttggcgtagttcagttcctcatgggccatcgaatggagggcctcagttcagtgctggctgttgtctggaggccgccttcaactccttgcctctctacagggcagtgcacaagattcagagcaagcaagtaggggagagcaagaaggagtgtgtgagcaagatagaagtcatagtcttttataacctaatcttgaaagtgacagcccatcacttttgctgtattctatttgttaggtccaatatcccaccctcccaacacacctacaccccccgcccctccccgccacccacacgcagaattacataggaatgtgaataccagagaccgctgggagccacttagagggagcctaccatacttattgattatgtttattgtgtgtctgtcttcattggaatgtaaaatctcatgagggcagggatctttgttttgttcactggtaaatcacaaacgcctggaacagtgtcttccacttcattggtattccataaacgtttttgaatgaatgaatgaatgaataaactctcattaagcacagaaaaagtttaggtgctcttctctgctaattcttttaggtttccctgtcttttttaggctaaataacactccggcttttattcttcagctttttctttttcttttttttctttttttgagacgaagtctcactctgtggcccaggctggagtgcagtggcgtactctcggctcactgcaacctccgcctcctgggttcaagcaattctcctctctcagcctcctgagtagctgggactacaagtgcatgccaccacgcccggctaatttttgtatttttagtagagacgggatttcactatattggtcaggctggtcttgaattcatgacctcaggtgatctacccgccttggcctcccaaagtgctgggattatagatgtgagccaccatgcctggcctcttcggctttttcttaaaggttatgattttaaggttttacacatgattaatgccttcaaatcagcatgactaaaatttttcttattacaaatcaagttgtttgttcagttcaaggtttttttccttttgtaaagtcttgaatttatatttcagtaaaagacacataacactacatttgccgtctttactatttttaagtgtgcagttcagtagtgttaagtatattcacattgttgtgcaacagatctctagaactttttcatcttgcaaaggaagccattaaacactaattcctcctccccccagcgcttggcagtcactttactattttatgtttctatggttttgactcctttagatacttcatatgggtagaattgtatagtatttgtttttttgtgactgcttatttcacttagcataatgtctgaggttcatcaatgttgtagcatgtgataggatttccttcctttttaaggctgcatagtgttcaattgagtgtatttaccatattttacttatccattcatccatcagtgaacatttgggttgcttctacctcttggctattgtgaatcatgctacattgaacataggtgtgcaactatctctttgagattctgctttgagttctttgggatatatacctacaagtgggattgctagattatatataatcctatttttaattttttgaggaatttccatactgtttccttaagggctgcactattttacattcccatcaacagtgcatggttcagacttaaactatggattgttttgaaatgttaatatgtttatatggctcataaggaaaactttgttgaacttaatttagcctctatccccagcattttcctattaaataatcaacttaattgtccttacataaatgggtgttaggttaattcttggtgaacatgtgttgtctttagtgctgacaggctcatctgaaaacaggaatcgctgtcaaactaaccagtctttggtttttagaatttgccttcctgtctcattcccccttttttaataataatagtgaatttgaatataatccagttttatggcaccgtttgttacctaataattttcaaaatgttattcagtggctcagctaatacttgagttgtagttcatctaggtgtagaagtttaaattcatttcaagcagatagtttgtatttatagtattttttaaactttctgtttaatgttaccgatattcctttctttacttacaaaacctactactgctacacttatctcagtttattttgatttgatgttaagtagtttgtaaacattagggcaatggttatggattcaagtgaagtaaagaaactgagaatcctgtaacaaggcaaagcttacagcagaccaggcctagggaaggcctagtagaaatggtagctgagtctgtagaagtaaaactatgagttggaatcagggaagatcaagaaacagggtataaaagtgagtcttgagggatgaacaaattagagcttggcatgagggttcaggaatattaaaggacagcctgctaatggaggaaaaatatagaccaagagtctggagataaacactggaccctggcagaaagaaaggagcttgattttgagccaagatttttttgaatcagggactgtattagtttcctattgctgctgtaaaaattaccacaaacttggtggcttaggacaacacagacttattatgtcatagttctggagggcggaagtccaaaatgggtctcccttggccaaaatcaaggggttggcaaggctgcatgccttctggaagctctaaaggaaaccgtttcagggtactaaagaaacttgcagatatgctctctgggacattatctttgagaaattttagagaagcagaaagatcctagaagactgttataaataacaacatcctggagatttttaaagaaattaagttcagatctttaagtagatgatttgcaaacattaaaataaaaatgcagtagtcaattggaaaaatagttgggtaactgggaaactgtcatgacaaacttagtttacttctttaaggaagggtagtatcataaacttagatgatctcattttcagcgaggcacttggtcattctctcttaggattccactgacttatgctcctttcttagttgttgggatctgtggaagcgttccacctaaaagtttgggtataactcttaccagcctcaggtgtttcgtggaatgtcacagggcttttcctttgaccccgtcttgttaagggttttgttagggacttgaatgaacccatacaaagtatgcatttcttttttctgctagcacagagcttgaaaagatagctattgtgcaagattacagaatcaacattaaaaattatttttgtgtgctggaatgctgcaccaaactaacaagatgcactttagtagggctcagccagtatgggactaatagatttatggaaagtctactatgctaggttttgggttaaaaaaaaataaagtagatcagatatggccttggctcctgagactgttaaaatccaatttggaaggtttaatctgtatctctaaaagaggaatttgaacaatactggatagattacatctcaaatggaatatacaggctgtgtgagcattcagcagaagagacaatcactgaggaagggagtaaccaaggaaagcctttactggccaactgagctagaccctgaaggaaggtggacgtagatggctctctcaagagagatgttcagtgggttgtatgactggggaaaacttagggacatgacatatatggggaatagaattgtaagcatatattcaactggcttactgatcagtaaaacacatctattatgtcttagtggcattttgcagcatgaggacatttttgtatgaaataaatggatattttttaattaaaacatgaaaatagtatattctctaaatgaaacattataagaatcaataggttcttcctgatctgaatggaaattcaagtattttagttttttctggtccaagtagtccatctgataaatgcttgctataaagaatctaagactaggaatgattatttaatccctttgcattatgcaggtctgtatctgttagagaggatggtctttactgttgtcatcactgaatttttctttctgccacatacatttatattcttaaaaacattcctgctctaaaagtatgaggctttgaaaaacctgatatgcttcttccttttactatcagctggcatgaggaaaatgttaccatgtagaagaggaaaagggctctgatttactatcagtcttccgacaagtctgcgaatttgaaatacactattctccccaccctatgcagacactcttctccctgccccctgaacctccatttagaagtttgagcaagcacacatttgaaagtaaacattaaccaaaaaaaacccattctttattgtctaattctttaccgttgtatttttaccaaattgtttctccttattgctttgctcatctcttttaatgatttttagacattgtagtccttgtctatgctggttttataatgtttaagaaatagtaataataattataaaactataatgtttaggaaacccctgtttctctaaacaggtgaaaacagatgcatattgggatgcaagcttaatgttaagaatgaagaagacttttctgcctgcatgctcggagtcattttttaaaagtgtatttattttatattttgtaaacattttcattttgaaataattatagatatataggaagttgcaaagtagagatcctgagtatccttcactcagtttcccccagtggttcgattttctgtaactataaaaaaatacagaaaccaggaaattgacattggtacaatgtatgtgtatagttctgtgccacttcatcacacacgtaatttcctgtaatcactattgaaatcaagatgcagatattccattaccacaaagatctctactgctacccgtttgagcagagctatttttaagatcataattttaaagtgacgaattcccataatgtaagaactgctattgaaagtatatatcctgttttgatatatcaaaaaaagatacatcatacattttctcaatgggtaaatcctaaggtttcattttatattgccactattattattatttattatctctattttatattgccttgttaacatttttgtcatggatgtgtgtatcagaagaaccagtgtgtcttagtccattttctgttgcttacaacagaatacccgaaactaataacttataaagaaaaggaatttattccttacagttatagaagttgagaagtcctaggttgagaggctgcatctgataagagccttcttgatattggggactctgtgcagagtcctgagatggtgcaaggcatcacatggcgagagggctaagcatgctagcatgctcgcttaggtcaatctctctcttcttgtaaagccgccagttcccctcttatgataacccatgaatccattaacccagtaacccatgaaaggccccacctcttaatactgccacattgggggttaaatttcagcatgagttttggagaggacagatattcaaacacagtgtttattaattgcaacaaagcacaataagcaaatttgtgaattttattttgatttgttttgatttccagaacttaaagttggcttatcatacctaacattttgattaaagtgtttttttttttgagatatgaaatgtaagttttgaggtattccaaaaccatatagtttacatataaaaatcatcaatgggtgatctgtgagagaaaacagttttttaagcaacatattttttccttaataatgatttatgcttttataatggggatgtgagacaattaccttttttgcttgtatctgacccaaatcctagtaaggttttaaaaatctttggcttatccattaagctctggcaacattaaaaatattgtggagaaaagaaaggagccattttatggtatctcctcacttgagttaatgtcttaagcttccctcatgtcatcgtgctgcaatatcatgtgcaaagggaaagtatctgagcaatgtttgagtgtgagctcctctacacagaggccatttgaagatgtgttggagagggagagtgatctagggggcaggagctttgggttttcattctgccacccgttctttttgtgtgactctaggtttttccatgtgtcactttcctggagataactacattgttgtctggaccttgacacaaagattaaattagatcttgtgtgggaaacagagagttaagtaaatatggagtcaagtaatacaaagtgttattattactattagctttttttggtatattcttgttgtaagttattataacaggtgctcaataagtgccgcttcaatgattgttcctgtaggatctctcaaaatgctgttaatcataaagttaccatatgtgaccaatagaggctgtgacctccaaggtgcagataaagtgtagagagcaaggtaaaagtgaaaatcagaaaaagagagtgttgcttatcttaccaggagcagttctgatggacttctgaggatgggaaaacagatttcagagaattaggcagagaggtggagaagaggaaggaaaggcaataggtttagacagtttttggaggaaaaagaaaaaagatattggctaaaagaggctgtctcatggtcattcccattaacccgctgacatttatcaatctgcttgtgaggaatctttcaggtttatggtatttggcagcttacgtaggtctttaggtatttgtggcagggagtgtttaccttaatgtcgggattaacgttaatgggaaaatgtctagaactatgctgtccaatacaggagcttctagtcaaacatgtgactatcgagcatttgaaatgtggctagtctgaactgagatgtgtgcacgtgggaaatacacaccagagtttgaagaattagtacaaaaaaactcattaatgatttttatgttgattgcatgtggaaatgctaatattttagatatattgggatgtattattagcttttcacctgtctttttttgccttttaaattgtgactattagaaaatgttaaataatcttaaattatatatatggctcacatttgtactttgcattatttttctttcagacagcactggtctagcgtgataggagaggagggcaagagttgctaagagaaagataaaaatatctggggagcctggaagtggatggcctttcccctactggcatgaggatgtagtaggtgctctggtcatgccagtcagccatatatagcagggcatgcagggaccttcacctataatctccctttaatttttgctgcttgggagttatgtcctgatggcatttgacatggggattaacatgtggtggctcctttgaaaagggtgtagtgtggcggtcagatatgctacagtatactccaaggaattgaccatatttgtttagttttgtttttaaccacacggaactgttaggagttggacattatgtaaaataaatgaaccatgacagtgtctccctttttaattgtctttgtaatggaatttgttgtactgaattttgacttgcatgtcaatggaaatacttaagatcttgcttacaatagcttatatttctggtttttaaccttattaataaaaagtagtgtgtggatacctaaattactttatacctcaaaatattaaaggtgtagattataacttttaaaatcatactgatattccaaaggaactctgttactgttttttaaatagtagaggtatcagtaggaaattcaagttactttcagcagcaggatgcatcaagtggaaaagatcttattttcaggaagcatacgaaacacaaaggaaatcctttccatttcctttgcctatacttttcagaacagcatgtgaggaaggactctaattgcgcccccttacttatctttgtgaggccactcatttgttctgaactgatgggtgcattgccccatctctttggtggccatttagatgtagggtgcactccttgcacagtgttatcgccatgaaggaaatggacaagtgttgtccaaggaccagctgaggcgggttttaatgcctttttttcatgtactaaaaggcaaaagacaaaaagaatcctacatttcaagtattctgtacgaaaactcttaaggtgtttaaaaaattgttttcggaaatgtacaaatgatgcaagctgtttccttcctcagaaaagagtttcctagtttttcaattattttcaagaattcatggtaccattaacttatttacttcaaagaactgtggaaatgtgttgattagatcagggaggcttaacctaagccaaacagaattcttccctgggaatttggagttagtactgagggagtgagattggtctctgtatgagtaattggtctgtaacatgtaaatctgggaacttttttctaataacatctggtcaaaagaatcagaagctggcaaatagaaaggaaaatgaagtacagagacagcagagacaagagactaagagaaaattctgtgggtattagaatccttggaactgaggccatgctatgtttttatccttaggtttcatgagatccctcatatcctttcaataaattctcttttgtttgttcaaattagtttgaattggagttctgtcactggaaactgagtgtcccgattaaattacttccaaagcgtcctgtgaatatctctgtcaaaacacttaccatgtcgtactattttgtttaattgccagtctagtcaaaatagactttaagttccttgaggacacatagactgttttgtcttaagttctccattatctagcctagtacttggcacagtatgtgctcagtaaatatttgttcaatgaatgaatgaatgaataatgcatgaattgtggacattttattatatacgcttttagttttttttaaattccttaaaattttttcgaatggataaggtattcatattattcaaaaatcaaagtctatgtaaagtaatatagtgaaaagtctccctcccatctttgtcctttgtccacccaaatcataccactttcctcctgtccaggtaagcactaatataaattttttctagtatagattttcagagttagtttgtacatatataagcaaatactaatatatattccccctttttatgcaaatggtaacgtatattatgcactgttttggatcttccttttaactcaatatagctcagagattttttctgtataaacatatatagaactccctcattctttttttacaattgtatattattacattgtataattgaattattattacatctgaactctattattggatattgtttgcttctaatcttttgctattacaaacaatactgtaataaataatcttgtatatatgtcactttgcatgtgttcaggtatgtctgtaagataaataattagaagtggaattactggatcaaagattatgtgttcataattttattgtcaaagtaacttccataaagtttatacaggtttattaaaccagcagcaatatatgaaagtggttgtttctccacagtattgtcaacagtatattaaaatatttgtagatttctgtcaagttgcactttttgtcacggccaagtagctcctgttgacctaactcttcacaacagctcagagctccgagcaaaatatagagccatttgcctgaaaacactagagagtgatcaaagcaggcagatactggatggacattgatacttggaagaagggaaagcagagccttgatattatgggatagtatcaaaatgtttaatatataagaaacgggagtcctagaaggggaagagaaagggagaaggcaggaaagtatttgacaaaataacacatttccaaatatggtgaaagacagaaatttacagattcaagaagctcaacaaaccccatctgggataaatgcaaggaaaaactaaaacaaaacattatagtaaaaatactgataaccagacataaagagaaaatcttaagtaaccagagaaaaattatgctttatgtacagttccctctcactgcttttcttctttagacttttcctgcctggtgttatttatttttccatgtggtcttttgacttagctttaaaaaaaattccctccaagtaatgagcccccaaccctagatggttcatttcctcctggaatttgctctcagagcactgtgccctttgatagcatttatcacaggttataatttattttatttattttgtattttacattcagggggtacacgtacagggttattacagggttatgttgtgtgatgttaaggttttggtttctattgatcttgccacccaaatagtgaacatagtactcaataggaagtttttcagctcttgtcccctttctttcctccctccttctggagtccccagtgtctgttgttcccatcgttatgtgtgtgtgtgctcagtgtttagctcccacttataagtgagaacatgtggtatatggttttctgtttctgcattaatttccttaggataatgacctccagctatatccatgttgctgcagaggacatgattttgttcttttttaatttctgtgttgtattctatggtgtatatgtaccacattttaaaaatccagttcaccactgatgggcacctaggtagtttccatgtctttgttattgtgaacagtgctataataaacatataagtggaggtgtccttttggtagagcgatttattttcctttgggtatgtacccagtagtagaattgctggatcaaatggtagttctatttttagttctatgagaaatcttcaaactgctttccacctgcctgaactaacttacattcccactaacagtgtttaagtattcccatttctccacacaggttataattgataggagtgattattttgattgatatctgactcacctactagactataagctccaaaagggcagtggtcctgtctcttttactcactagatgcctagcggagtgcctgacacattttaggcccttaatacatactcgtgaatggatgaatacaccttgagtcttgaggttgagctctgtgactctttgttactctctcaataactgtaggcaagtttcttgactgttctaggcctcagttttttcatttctaagtataaatgaattgtatctaccaagcagggttttgggataattaaatgacatatcttagaaaacattttgtaaattataaaattctagttagactaactttgactttccttttcacatttagtgtatatgtatgcatgtgctaaggaacaatctccagatttaggctcactggttttcagagtccatttgaagaatcagccttaccagtttgtcacccagctaaagttataatcacttgagtgtttcttagcttttagctgtctaagtggtaagagcagtcaatttcagataaaagcttgtttgttgacaagggaagtgcctctaagaaaggaagtaaaattttcccttacagaacaacctgaacttggactccattctgcacaaaatgtctacctgtcacttctaaaaggagaagaaaactgtcacagctgtgattaccaaaagcaaagcttagacttaataaattgccaaaactcagagtcttgttagtttaagttgcttgccaacgtactataacttgaaaaaaggaaagatgcacatatttattgctaatgctggggaaattgccattaagacagttggcagaaaggctgacattttaacagtcataggttagataattttctgcatctatccaagagaagattttgaccaaggactgacaaaaaaaaaaaatcaaattattctgttcacttggcggcatctaaatgtctcattttcagcttacaggaaagattgctgtgaaagcaatctttgacattacaactgagtgaccataaattgcttgaatagctgttggaaattcaaatataaaaccacatgaaaagtcattatctgaggtagaacaaggatttttcacttgttttgctcttcatttacagtttataacttaattttacattaagattgttttaaaattatcatgtactcagtttcacagaagatgattagcttataggtcataaggaaaatcagtgccagaatgaaaaactgaattcttttttttttttttttttttttttgagacggagtctcgctctgtcgcccaggctggagtgcagtggcgggatctcggctcactgcaagctccgcctcccgggttcacgccattctcctgcctcagcctccagagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaaaaactgaattcttgagtcttagcgttcaacatttccagtgctgtcagaaacaagtgctgagttttctttgttcttccaatggcaaaataaggaatgtatgataggcttgaaagttggcaatcataaagtgctttttatggtttcccaaattcccttcatagtattgtttcttttattatgaatttagttgtgtaaatcagcctgttgctgataaacaaaaatttatattagtcctgggaccaacatttctttcagtatgacattagttgtgtaaatcagcctgttgccaataaacacaaatttgtattaattctaggatcaacattttgagaaggaataaagtagggatcatctaagagtttttaaaagaatgtgggtctaaaatagctggtagaataaaaatacattgtacaagctaaaatagggcaaaagagctaaaatgcagtgcatggactaaaataactagcagttcaaatgagtccaagtgctaaatatgtaattatctttcctattaccttatatgtacaagagttattttaacttttaaaatcctacatttcacttttgttgttgtttatttatgtatgtatatgtaaaatcaggcatatatatatacacacctctgagtttaaaagttttcaaattgcattttaatttacaggttacaggttgacattttacactagtaggcagaaatggttatttatttattggtaggtggtttgctttataaactgaaaatgaagaaatgacttgagtttggtttatcatcatccctccaattcccttccccaaactctttgaatctcatggtactttttaaaagcttgcctcaacatccccaggaataacttcacagttgttccacatagatgtagtagccattttcttattcactaattttatgaatgattgttgcacatcctccaggggtttagaaattgctcataccatggaggagagagtttctgggtgactttgatccgtgttagtgcttatttgctcctgtaaccccgacctttttgccatcccctgaacacaggcacacgcctgcatcaaccctttttatacttgttctctggggtgtttttccttcagttccacatggtttgtttcttaccctctttccatctttgctcaattgttaacttgtcaaattactctgtaaaggagctaaatcctgaccatttggtagttttgagcaaacgaggattagaatccaagtgacatgttgaaagaatcactctgcctattgtcatgagaataaactgcaggtgaacaagggctgacagagttaggggcaattgcagttgtccaggcgtagagataaaggtggttcagatcaggtggttagagaggtggtgaaaagtggttggactcaggatatattttgaagggagagtccaaaagtcaatattttgaagggagactcaggatatattttgaagggagagttaacaagattttgccgccactttgaatgtgaggtgagagggaaagatagaagtcaaaaatgactctaggtttttggcctgcgtgactgaaagaatggaattgccatttactgaaatgaggaataaatatcaagagaagagcacaaaatcaggaatttagttttgtttataggagttggataaatgaaatttgaatttaaaaaaaggtctgggatgaagatacacaagttgggagtcatcagcatatacattatttaaagtcatgagcctgaatgagatcatctgggcatgtaaataaagaaaagggtcttagagttaagcccaggcataccccaatctccaatgttcaaggattgaggagaccagagggagagccagtgaagtagagaaactgggactctggaaaccaagtaaagaatgttccaggaaaggagtgatcagctgtgtcaaatgctgctggtagaacactaagataaagaccgagaaatgatcattgaatttggcaatggggaggtcattggtgaccttgaggaactgttttggtggagtggtggtagggaaaggctgactggtgagggcttaagagaaaataataaaagaggaaatgtagacctcaaatatagattaactttttacaggtgattattttttaaagtaaaacagagaaatgaaatgggagctgaagaaggatatgaagtgaatggaaacattttaaaaatgatgtttataaggccgagatgggccgatcacgaggtcaggagataaagaccatcctggctaacatggtgaaaccccgtctctactgaaaatacaaaaaattagccgggcgtggtggcgggcgcctgtagtcccagctactcgggaggctgaggcaggagaatggcgtgaacccaggaggtggagcttgcagtgagctgagatcgcgccactgcactccagcctgggggacagagtgagactccgtctcaaaaaaataaaaaaaatgatgtttatatgctgatgaaagtgattgagtaaagaagggaaaaattaattatataggagaaagagaatgtggacagttgttgggagcatgttttttttttttttttagacggagtcttgctctgtcgcccaggctagagtgcagtggtgtgatcttggcacattgcaacctccgcctcctcctggttcaagggattctcatgcctcagccgccccagtagctgggattacaggcacatgccaccatgcctggctaatttttgtatttttagtagagacggggtttcaccatattggccaggctggtctcgaactcctgaccttgtgatccgcctgccttggccttgcaaagtgctggtattacaggcatgagccaatgtgcctggcctggagcatgtattcttttatgagtggtccttcttctgtggcactgtacacagtgctaagggaagacttttctgtctttccttctacactcccagattctcactgggctaggtgtcccttttataagctcccatttaactctatgctgttattgttgcctctacacttacccctttcaaagtatgaccccttgtacttaaaaacagacctttttaggtttagctgtgtcttgatccaaagaaccacacttaccagagtatgttagttttagagtcatctaggagctcagcataataccaaaaccacaccttttggtaatcttggactgtaacagaaggcaagaattataataggatctcacaaaccttctcccacccaccatgatgagctatttgtagatccttagtggctcttaagtattctcccaagtgttgagttgtgagtagcctgcacataatggcgttcaatactgagaatagctactcagctctgagcatccatcctttttctcaccattggcattcctggtggcacagtggcttctatcactctctctggcttgcctcagctttgattctgtccattcaattctcatttccgccttgtctgtcacagggttaggcttatggtaatgaagaaatgctctgtccttagccagagattggtgtaagttaaaagatgctgtgagcggtaaaacaaacaacatttaggcagatattagttattattattatcttcagagctcaatatatttctgtctgtatttttaaggtttagatcagagttttaaaattagggccataaccttttttgttttttgagacggagtttcgctcttgttgccgaggctggagtgcaatggtgcaatattggctcactgcaaactctgcctcccaggttcaagtgattctcctgcctcagcctcccgagtagctgggactacaggcacgtgccaccacgcccggctaatttttgtattctttagtggagatggggttttaccatgttggccaggctggtctcgatgtcctgaccgtgggtgatctgcctgcattggcctcccaaagtgctgggattacaggcatgagccaccatgcccgggcaagggccagaaccttgaaaccacttgctagggtgtttgtagaatggagtggaggctgtggtgaaactgtctaaagtgctatgcatgtgtgcctaggtgcattcatccacccactcatacaaatatttgtaaacgcttgctatgttttaagatgtgtttaggggagtttgtgctgctcattttttaaagagcgggaactctttggtagttacaatattaaaaggatagacatccactctgagtagttctggatcatttctggagttcttttttcaaatatgtctaagtaaaacacaccatgtcaaaataccaggctgagctgcacacttgcagtgagacaggatggaagaccgaggattccaccaggtcaggacgcatctttgttacctttgcagaggttctctagcacctctagatctctgcatgatctagtttgaaaactcctcctctagactatgacaaagttaaaaaaaaaaaaaagtgattccctaggctttcctgtcataaaaattgagaggcagacgtttttcttttaaatgagttttctgttttagcaaatagaagctattatttatagcttagttaaatgttttaaatcgccaaacctccgtacctctttcctatagagattagttcatggagggagttatgaaaaacatcagttaatgataatgatatagtggactttcaggagatgagaaacttattttgaatacccactgctaggtagaagtttgacctttgcatgtacatccagaaaggatggtggtgtatgccatcagccttgtggtttataaatattagtgatgtggtctgaatgctttaataaaaacaaatgaatcaaaggggtaggtctgtctttattgtttgggattaaaaaaataataatcatacattcatatattcttttcatacttttaagaaacaaaaaggcaattctgctaaattataattttattgtacatttaaaatgcagattttaaaaactcaaattgtgctttttagtaactaataatttaagaactctttctgatcctcccctacttttccaaccttcttttcttgcctaacgttaggaaaaccaaattgaagatgcctgcattttgaacaggttgaacttgtggccttggctataattgtcacttcataatctatttttgattttaatcttattattataactttctttttacagactggtgaattttcagctcgtttccttttgaagctgcccgtagatttcagcaatatccccacataccttctcaaggtaaaaatatatgattttcagtatgagaatataagtgagctttttaagtaattatttaactcaatatttgtatgactggtttgtcagcattttgttcagatgatgaattctattaaaaatatttcttacatgaagttccattgagctgttttgctgcctaaaagctaaaatagtaactgtgaaagtcatttagaagtgagttttccatattaaaataaaattattataagtgaattaaactttgggaaaaatcgcttttatttaataatgttactggaatgaaagactctcatataaattacctaatatgcaatattagtcaccactccattctgcaaacaccctagccactgccttcgaggttctggcccttggccgggcgcggtggctcatgcctgtaatcccagctttttgggaggctgaagtgggcagatcacctgaggtcaggagtttgagaccagcctggccaacatggtgaaaccctgtctctactaaaaaaaatagacaaatattagccgggcatggtggcaggctcctataatcccagctactcgggagactgaggcaggagaatcgcttgaacctgggtggcagaggttgcagtgacccaagatcgagccactgcactccagcctgggtgatagagtgagactccatctcaaaaaacaaaaaacaacagataaaaaacaaacaaacaaaaagatttggctggcctccctctgtgctgtatttgtacttgtggttctttaattgcaatctagcataagaaaaatttctatcttcctaatttgatgttgttcagagaattaatggtattcataactgcctagagaaaagacagaatctttgtacaagtttgcttgcatattatactaatcaataaataatattagatattaatttttataatggttataagtatgacttagtagaatataaactataaaccatagaaaaggttagggaattttttttaatacattccatcttttttttttttggaaacatggtcttgctctgtcacccaagctggagtgtagtggtgtgaccatagctcaccccaagctcaagtgatcctcccacctcagctttctgagtaactgggactacaggcgtgcaccactgtgccaagctaattttttgttttttgtagagaaagggtctcagtggtcctcccacctcaccctcccaaaatgttgggattataggtgtgagccactgttcctggtctatacagtccatctaaagaggaaaattattttctttttcgctaagtaaaacataggatttttgtacttcattaaactttcgtttttagtttccagttgactagttctccattttgtacccaagagttgtaaagtccaaataagaatggaaatcatcaatttctatcagtttctctacaatcctgttgtggaaaatatatatattagatttgtgataaccaagcataattaatttgattttggcaattactatgctctattagactagtaagcagtcttctaagaaacccttatagcatatactcaggacctcctccatgtattccagttaaaactctctttcagctcatttagaggcaagttcaacagcatatgaaagtacctgatttatataatccacaatttacagttacagtgctttgttttaatttactgtgccttatcagtttcagcagtcttcctgtttatttgaaattgatgttgcctctgctcatattcttgaagggtcaaaggaaaaaaatgtttgttggctcataatctcatatttatctcttcagcatcaaattatcatatttttattttaagaattctaactttatatgctgttcttattttccttgccagtcagttaagagaaaggtggaatctatttgccaaaacagtaatgttgtttaacccctgcattactgtgaaatgatgtctcttctatagataaaatatctacattgcaacactaatgtccttctggatctttaaagttcatgcaaaaagagtaaaacaacaatgaccaaaaaggagaaactcttgtgtaacacaaagcaacagccaaaaaaacagaaacagaaacctaccagcacaccagaagcaatccagaatacttgttgagggttttaatatctacattcctaaagttgttgtaacatgtggttatgctcttcaaaggaagtttgccttaggagctgctttacatattatttgcatttggatgctcctcatctaattactaggcctataattgatagtctaactacaaaaataaacttcctgaattcctagggttaggatactcttcaccagcatcaatatagttttaccttatcatttcaaacaaataaaagggaaggtagaacttgaaaatattgagtagtatggagttagactgcataccctattgatttgctacaatgacatttcattacactgtgatgaggccatcattcactcataagttcatattaccaggtgtgcctgttttgcccactaatagaattattttatgttaaaatgaaaaagccattcaatattcagtgatatgatttcccttaatattgtattgtaaacatatgtggttcttacaggggatagagtgaatttattctgaagatgaagtctgatttcagagtctgaatttcacttttggttgaggttaatcaaagggtcagatgaatcactaacataaacacgaaaaatatttctgtatttattaggattctcattttgcaggtggttgaaatccagcatgagctcatgtagaccagatgagaaatttcatacaaatcctcttcttctgtggtctgtatagcaggaaacagtccatacttagtactctacagatcaggcgtagaccaactgtcttatgtctgttccactgggctcagttgtgtacccctgaacttctcaactggtgtgtttatggggagaaatcgtggtccccagcataaagaggagattacagaaatgatcaaagtgcaagtattctctacagttactgaaccaaagaaagatggttttataattacatactttctcttaacgaacagctagtcattagatgctgctgctcttaattttcttagagtgtggtgaaaagtgctgtatgtgtattcctgtctttatttttgtcctgagaattagtgaacttaacaatatgatgctaagaaggctgtgtttttgtttttgcttctgttttctgtaaaaccatactccatagaaaagtagctaaagaaaaggtttgaattgtctactaacatttttattctctgaacaagaagcttagaaactaagaatacagtattttgggggataggagaggcttacttgtaaatatgatgtgtgtttgaattggtcacttaaaatagtaagccagttttatacagaatacagtgaagttaaatcctagagctaggaatcccttcagtagcatcatacaaaaatatggaggcaaattgttttatcccactgaactggagggttaaatagcaactatttcctgctgatactggatatggcaaatataaccgtgcaaagaaaatcaacattaacttttttttgttgggtaagaaaagaccatattgtttatgtaggctaaattgttggagtatctctaaactagaaatcagtgagccctagcccaggttagaagtaaggctataaccaattgactatgactgaagtacttggacttttattggcattatttaatatcacacactgagcccattcatcctgatggattgcatgtagaaatttagttctactgtggaatctgaatcatgacactacagcgaaattaattgagtgtgaaaaagctaaaataggttgtttatacaagagatgaagttctcatccttcttctgaagtcactgtggctgtactgatcagtcagggcacaatcagtgcagagcccaggtcactctgccaaacagaggcagaaagcaggaattcagttcagggtgtctagacttgttcaggagcctaggataggcagagagttgtgaatatgtaactatgcaatggtctaagcagatcactaacatggaagagagcatctaggtgtgctgagattatctgatgcaggagcagcctcctcagcctgacattggccagccggctacctacttatagtcagtctgctttctaaccaaacctagtagcaaatgcagatattcacagagccaggcaagtactgaaaaggagtgaatctgacttgatacaatacaataggaaatggtagggactggagtgaactagcatgtatgtgcttcatctaaaggcagcagctgctatacagctacagagttgttttccatttgataatttgggactggtgttgccagatatccagatgttattaaaaaggagcccagaatctcagggcttcttgttgatgttgttgttaatatgaaaaactactatcttttaagtaatagcaatgataaatattgtttacaaacactgtgcaagaacacttctatgtcgtagccatggcctgtgggttaatttgtgacccttgctctaaaacctaactgtcttgtaccaggtgggtggcagaaggcttttcttcactttccttgatttatactatacagtgtggtattcagggagatcttactatgacccagtgggtaacaggagaaccttgaactgcagtgccactcaatatcctgagccgcttatcacaactgcaacagagtggccagaatgagtttggcttggtttttgagtgcggtactgtgcagaacacctaagtactgattttgccataaaatgatactgggattagacaaacaacaaaagaaattcaagcataatcattgtcctcagagaccttataatataattgataagttaacatttactgataaatagttaagtgttaacttgtacgctacctgcccagtaagcttttaaaaagaataaaattgttatggattggaatgattaggtcataaaatctttatgaccaagtttgggcattagctagacctctaagtggcatagcttttcaaggctggaggggaggaggaacagatcagggatggatgatcatgcagtcagtggtgggactgtgtggacatacttgatttgggaagtaggtagtaatctaggttgcaagagaaatttcctgcaagagactactgagagataaaaccaggaaaaaaagttggaaagatactgaatgctgggagattgattttagacttcatttagcaggtagtcttaatccccttataactgggttatcatggtaagagctatttccttggccccattctcttcagttcccaatcttcctgcagtgttactgttagtctcctgtaacgtttctcaaaatgagtagtacttacttgttggatgctgcttctagagcccattctcccatgcagtgctgttttacacagcttcccaaaatgtgcgtttaatctcagaaaggcaactatccgcagtgtcctgccagtgctgtgagaattcccagtgctgtcattttgctcatgctcttctttctggctctgaaattcctactctttcatctttttctggataattcacttaattgacataaaaataaggagaagtccaaagaaattcaattacttgcccaagactgtgtttatttggaggtattgacagaatatcttattttgattattggcagctagaatgagagaggtgctaaaaggtcaaggtggaaaagaagcaggataatgaaaccaaagtgaaccttttgaaggaggaaattttgcacacaactgtggagaaacctgaatttggagaatccaatggaagagaattgtcgtatatgtagaaggacaacaggagctcagagtcataaaggtcaaggtgtgttttttttttttgagacagagttttgctcttgtcgcccaggctggagtgtagtggctccatctcggctcactgcaacctccacctcccaggttcaagcaattcctttgcctcagccttccgactagctgggattacaggctcctgccaccaggcctggctaattttttgtgtttttaatagagaggggattttgccacattgagcaggctggtcttgaacttctgacctcaggtgatccacccaccttggcctcccaaggttctgggattacaggcatgagccaccatgcctggccaagtcagggttttaaaatgttcatgatgaaggaaatactcaaatgccattgaaagaattagaaccaagaaaaaaagcatttgaatttgtgaggatgatagggatggtgagagtagagagaacactttaagtaggatgaccagaatagaggccagattgttggtgttcatgaggatatgaatgattagaaaatgtactcagtgggtatctgacaaaatgaattttggaaatgggatggaaacttgaagaactgaaatgatcaagtgaaactattaagaagaaacaactgaaatgatagcatactagccaaaataatcatagagaaggttttttttttgcttttttttttttttccaatagacagagtcttgctctgtcacccaggctggagcgtagtggcacgatcttggctcactgccacctccgcctctgggattcaggcaattctcatacctcagcttccccagtagctgggattacaggcatgtgccaccatgcctggctaatttttgtatttttagtagagatggggtttcgtcatgttggccaggctggtctcgaactcctgacctcaaatgatctgcctgcctgggtctcccaaagtgctgagattataggtgtgagccaccacacccggccgtaatcatagagaaggtttcttaagaagttgttttaattcgtgatatgcttaaatatgatcattatatcaatgttctctcctggaaaagtttaaaggaaattttgcctggaaaagcccatttcaagtggtgctgtcattcttttatattgttaggagaaataggtaatggcatgagtgttaaaaaacaaagtgtgtgtatgacagtcacattttgtgacttgccattaaagattgaataagttggcagagttttgaaatttctcattcttctcatctgcccttaggaacaggggaggattttgcattccctgcacccagaagaacattagactgattaacgttactggaatttttttgtggatgaattcttgcattgtcttttactatttggaaatgcttgaagcccatttagcattacatgtttgctagaaaggaaactggtaatttccccccagatattcactttatttaaaatccagcaagcttgttagggtggtatgtattgattataattctttttcagcacatgtaagatagaaacattgaaaagcctttgattctgataagaatatataaattcaaaggctgaccttacaagtttttctctaaaccacagattaaataactcctctgaatttgagacttttaagttcagggaatttttttgaaatcagtaaagtcacacttaatagtcagcttttagagagaaagactgctttaacacactcttgtaaaatctagctttaaagcaaaatagtcgtctggtacttgaaggaccataaagaattcacacagaaccgtcatcttcttatcttaaaggaaataatttctgtctaatcaaataggagtgggcatacttttctaaaagtaggaaggagtactgggaagatagtgccataaaagtagggtgctgtttactcctgtaataagacgatttatccttgctaaatttgagccaaaatttgcatttgagacttaatcacaaagaaagcagtgagatggtctgaacacttacactgcagggaatctgtctctttctttattaagcagtggacccatggctgcgctcagtacctcgtccttgttccacctcccttctctagagagcagacaggacttagggaaaaatacactctagttcagggtccagcaggctcctctaaagggcaagatagtaaaattttagacttgtgtgccatatggtctctgtcacaactactcaactctgctttcatagcatgaaagcagctacagacaatatgtaaatgaatgagtgtggctgagttccaataaaactttattttcatgtttgagatgatggatatgctaattaccctgatctgatcactatacattatgtgtatagaaacatcactatgtttttcatgaatatgtacagttattatttgtcaattaaaaaatatgaatttctaaaaacaaaaacaaaacaacgtttatttttaaagtaaaagataaaccgtttttttaaatccagcccaggcattgggctggatttggcccataggcagtagtttgtggatcccttttctagatgatggaggggagtgtttcttcacaaagacacctggtgcatcataaatagatacgtaaagggatttggctcagtgagtgtccgtggtttttataccatggtctctgtttatgtttgattagtaccttcaactctgttgaagtctcccttcttctctttctccccctaccctttttttaaccttccttcttttattccatcttctctcttattttaaatcatctgttagtaacataaaatttactgaattatcttccaagtcttagtttcccaaactgttaaaatgacgttagctattattatgatctgaaattttatacccaccttcccccaaatttatatgttgaaatcctaatccccaaggtgatggtattaggagttaggacctttggaggtgattcagttatgagggtggagccctggtgaatgggattaatacccttatgaaagaagccctagagggctaacaggcctgaggacacagtgagaaggcaccatctgtgaactaggaaacaggccctcaccagacaccacagttgctgctaccttgatcatggacattctagcttccagtactgtaagaaacaactctctgttttttacacagtttatagtattttgttagctacgcagtttatagtgttttgttatgggaattggaactgactaagatagctatgcttaccacacaggattgttgggactattaatgagataataaatatgatggtacttaatacacttctgagcttggtgcaggtgcagaatagaaatggttttgatttcattaagtcatttaatttgtatttcaaagtattgaatttactgtggaactaagcactattcacaatagcaaaaacatggaatcaacttaaatgcccatcagtggtagactggatgaaaaaaatgtggtacatatgcacaagtgaatactgtacagccattaaaacaatgagatcatgtcttttgcaacaacagcgatggagctggaggtcattatcctaaggaaactaacacaggaacagaataccaaatactgcatgttcttactcataagtgggagctgaactttgagtatatgtggatacaaaaaagggagaaatagccaccaaggcctaccctagggtggagggtgagaggagggtgaggatcaaaaaactacctgtcaagtactatggttattacctgggtaacaaaataatctgtataccaaaccctgtggcatgcaatacacctgtataacaaacctgcacatgtacccctgaacctaaaataaaagttaaaaaaaagaaaaaatttcattgaaattatgacagagttatgtttactacttaatttttcctctcttctgatttcccttatgtagaattcaaaacttaaatttttacttgccttaagtttccaaatatgatttatggtaattctgacaatggtatatatattttcttagtaaaaatgaagaagtcacaggtagtttcttggaaaaaagaagttacaggtagtttcttggaatgtagattggggtaacccattatggaaaacacaatggaggtttctaaagaaattaaaaatagaactaccagtaatgcctcttctgggcatataaccaaaggaaatgaaatcaccacctcataaagatctctgcacagccatgttcattgcagctttagtcacaagagccaacatatggaaacaacctaattgttcaacagtggttgaatggataaggaaactgtggtacatatgcattttgaaatattattcagtcctaaaaaagaatgagatcttgccatttgccacaacatgggtgagcctggaggatatgatgctaagtggaataagccagacacagaaagaaaagtattgcatgatctcgcttgtatgtagaatcttaaaaaaaatttcaaatatatgtggagaacaatacagaggttaccatgggttgggggtggtggtgagtggtgaatggggggatgtaggatacatcttctgtgtacatcagagggtacgaagagcacctgtgtaggatgaacaagtctagcactctaatgtgcaacaggactacaggttatagaattgtaccatatatggaattcatgctaaatgagtagatttcagctgctctggccataaaaacaaccaccaaaaaatgggtaactatgtgagatgatggatgtattaatttccttcactgtagtaacctttttattgtctgtatatatcccataacatcagattgtatgccttaaatatacacaataaaatttattttttaaaaaagagagccttcctcttttggctttcttttgttgttttacagtttatttaaaatttttttttatgatgtgcttctttctttttttcaaaatttctattttagaatgtaggtgtatctcaaatgattatcagttgacctgctttgctaccctgtccccatttatagtgattgtcatttaagtacagtctattcttctacaggacatgctttagtaacatgaattagttcgttcacaattggcaaatagtagaagcctgtcagtataatacaaaagcagctatggcttacagttgactttttctctagcacattaattattttgaccactaaatacagcaactaaatgcaaagtacactaatacatatgaacatagcaagctttggaggcatactgtattatttattgtgtcacttattattgggaatatagcatcttaaatacattaatattttactgaaattactttggtttttgtcagtgctgtgcttacaaagttgtgcaggccttaagtggtctatattttcctcataagtctcttatttttagtatgtaatttactagaatgcaattttttaaggaatgcgtatatcatattatagcagcaacacttgtattttaaaacttataggctaggcattcttagtcctttgcactttccaaatatgtcgcaggtttttaagtccttctccatcttcatacttctctttagggagtgttccagattgccagcatctctcttaaactgtggtgcccaaaaataagcacaaaactccagggagggttgatcaggtcagtgtttattaagactctaagcatcaacattaattcgtacttcttgagtttgtagaagaccatacttccttgtcttactaatccagctttaagcagttggttttcctaagccaatgtgtagacttaatcccttcatatcagctttttggatttgccctattttcttcagtccgtttatgagggaagccttgcaacctatgatccagaaagggaagtggggattggaaccatatagcacagtgagactaacaggaattatgggatgtgatcactacaggtgaccattttttttttttaatctggaactactttcctctatggtagagttttcttcacccacatcttaaaggtgccacctggcacctgacaggttgtgccggtttgtttctgtcatctgttctcattactccattttcatcaatcagcagacctacaactcaaataaaggtaaaagctgattaatggtgtaaggtgactacacagataatagtgtaatgcatgttaggataatacttaattattaagaaaagtacaaaatttagtaggttggtgagagaggattacacctggctgggaaaaaaacctttataaaggaggtgacatttggaacggccttgaaagacttggttttgataaagagaagctagacaggccaggcacggtggctcacgcctgtaattccagcactttgggaggccgaggcgggaggatcacaaggtcaagagatcgagaccatcctggctaacacagtgaaaccccgtctctactgaaaatgcaaaaaaattaaccgggcatggtggcgggcacctggagtcccagctacttgggaggctgaggcaggagaatggcgtgaacctgggaggcggagcttgcagtaagccaagatcacgctactgcattccagcctgggtgacagagtgagactgtctcaaaaaaaaaaaagaagctagacagaaagaacaagcatttttttaggtggcaacagtagcacagttggaaaacagttgaacagtccagtttggctaaaacgtagaacttgtgtacaaagtagtgggagataagaaaggaagggcattttaaagacatagtgttacagccttaaatacttaactcaaattttaatcattatttttgagcagggtagtattacaattgggattgtatttaggaatagaaatcagccagaaacataatataaaatgatggagaggaggaaggaggaaatgaggctggaccctggatgcagacctgttatcatagtcagggctcaaggtgatagaaaacttaatatcaaggcttcaggtgatgcatgttttagatttgctgaagtgtatataaaatatatatatatatgtatatatataaacattgtataattttatataccagctggggtgcatggtcacttaactcagtgattaacctgggaaagtaggggagaggaaaggtgccagaaccttctagccggtgctacccaaagtgcatcagttttggttcttgatgaaacaaacacagcattgagagcgtttagaaacattaaaagcagctgacagaataatcatatatctgttgaatctaatgatagaaatgttgggtttgtattttgtatgtgttttaaaagatttctttttctagtaattcactttgaatgtattttacaaatccatcagttggtgatggattagagagaaacaaacaacaacggctccttcactgtggatggtttgagaagcattattcgagcccgccctgtgccttctgtggctgctggttaccgttgcctcccttatcctgagatacagcagtctgaggtgtctctgaggttttttggttttattctttttgcttagctgagttttacaatcattgtcacccagcacgcccctcctttttatttttatttataaatacatttccagaatttggcataggagaagcccttgacttgattgacatttaatacagaactagaagagagggattttttattttataaaatattttgaaacatattttaacagtacacacataccttgatctagtttaatgacaaaataatgtcacaaagggatctaccctctttccttcatttttctgaagatccattttcttccttgtatctgttgcagatttgttttcatattatgatcatattatatagttgggatgtgtgaatcccagaaataaagttggtgtttctccttgttccaggattgctcataagcagtttgactctcttgaagcaggatgggatatgatttagatttgtcaactttgtgttaaccctagaaagtcatgtgagtacttcatgaaaatactctttagcagaagatcctggaatactgatagtgttggcattcttagtctcttttccatagaccagcaactcacaagtatggtccaaggactgctggtatttccaggactctttcagagagtacatgaggtaaaaactattttcaaaataaaattaagaatttccatacctcatgagtgaatagtggagtattccagaggctacatggtgtcatcactctgatagccaaggccatatttgcttgtgtgttcttgcattttagaaattttctcggattttaccaaagtttattcaagaagaagtagataatttggatagccttgtgtctattatagttaaatatgttcccaccatgaaaactttaggcacagatgacctccctggtaaattccaccaatcatttaaggaagaaatagtatagaaaatctttgggaaaattgaaaaaggggaaatgatttctaacttgttctgtgaggacagcactacttgatgacaaaaatcaggcaaagatattacaagaaaagaaaactccagatgcatctgtctcataaacacaggtgcaatatttgaaataaaattttaacaaactcaaaagaatgatacataaaaaggatgatacattatgaataagtggagtttatcccagggatgtaaggtaggctgaatattcaaaaatcaacaatataactaatcatattaacaaactaagaaagaaaaatcatgtgattatctcaatagacatagaaaaaacatttgacaaaattgagcatatattcctgattaaaaaactcttaggaatctaggaatggaaaggaacttcctcaacctgatagaagtacatctatgaaaatcctatagctagtatcatacttgatgttgtaaaagaccaaatactttctctctaagattaagaaggcaaagatgttactctcaccattctattcagtactgggggggcctggccagagcaataaagcaagaaaaaggaataacatttagagtagaaaggaagaagtaaaactatcttttcacagatgatattgttgactatgtcaaaaagcctaaggaaattacaaaaaagcttctagaactaataagtgaattttgtaatgttgcaggatacaaggtcaatatataaaatcaattatatttctataggctaacaagtaattaaaatttgatattttaaagataacatttataataacatcaaaattatggaatatttagagataaatctaagaaaagatatgaaagacttttatcctgaaaactacaaaacattgctgagagaaactaatgaagatctaaacaaatggatatgtcatgttcatatgctggaagacttaatctcgtaagatatcagttcttcctaaattggcatatagatctggcacaattctagcaagttgaaatctcagcagaaattgtaaaaattgacaatctgattctaaaatttattttgaaataccaaggacctagaatagcctaaacaattttgaaaaagaagaacaaaattggaggactcacattccctgatttcaaagacttattataaagctccagtaatcaagacagtgtgatgatggtctagaaaaaaatataccagtatagatcattggaacagaatagaatattcagaaatagatccacacatacgtggacaattgatttttgacccaggtgcaaaaggcaattcagagaagaacagataatcttttcaacacatgatgctagaacaattggatatctatatttaaaaaaaaaagagaaaaggcctggtgcggtggctcatgcctgtaatcccagcactttgagaggccgaggcgggcagatcacgaggtcaggagatagcgaccatcctggctaatacggtgaaaccttgtctctactaaaaatacaaaaaattagctgggcgtggtggcgggcgcctgtagtcccagctactcgggaggctgaggcaggagaatgacgtgaacctgggaggcggagcttgcactgagctgagattgtgccactgcactccagcctgagcaacagagtgagactctgtctcaaaaaaaaaaaaaaaaaaagagaaaagaaaagaaacttcaatccatgccttgaaaagacatatatatatatttgttgacatatatatatatatttccatgtaaagtttaactcaaaatggattatagacctaaaagtaaaacctgaaactatacaacttctagaagaaaacgtgataaaatttcaataactttttttttttaaaaacctgtgttctaatttcagataggctaaatgtcaacagagatagcacacataaataggagcacttcatgattctcattacttgtaaaagggagtcccaaacactttgagaactgctgctgtagactttatggcctgttgtatttggtagtagattcaaaacagcatataaacatttccaggattgttggccaggtgcggtggctcacgcctgtaatctcagcactttgggagtccaagtcaggggatcacctgaggtcaggagttcgagaccagcctggccaacgtggcaaaaccctttctctactaaaaatacaaaaattagctgggcatgctggcaggtgcctgtaatcccagctacttggcaggctgaggcaggagaattgcttgaatccaggagatggaggttgcagtgagctgagattgtgccactgcatgccagcctgggtgacagagcaggagtccgtctcaaaaaaaaaaaaaaaacaaaaaacctggccgggcatggtggcacacacctgtaataccagcactttgtgggctgagtcaggcggatcatgaggtcaggagatagagaccatcctgggcaacatggtgaaacccggtctctactaaaatacaaaaaattagcctggtgtggtggtgcgtgcctgtagtcccagctacttgggaggctgaggcaggggaatcacttgaacccgggaggtggaggttgcagtgagccaagattgcgtcactgcactccagcctggtaacagagcaagactccatctcaaaaaaaaaaaaccaaaaaaaaaaaaaacatatttccaggattgttacctgcttcataaaacttcttctgcattatcagcaatgatacttgtgttaaaaaggcattatcagctcacatcaatgtagagtaaagctgagatcttcaccaattgctctttgaaatcaatccttcttataagcttccagcatctagggcttagtatcattggttcaggtacatttgatgaacactcaggtgtagaaatctcaagtgtttatccccagggtttctaatgtgtgccattctgtgttatgacttacagccacttaatgtcaccactagcatttagagacagacattggtcagaataaaagacatctcacagccaccctgtaaggtggcacagtggatgtatgttgttttgtctgcctagcacgtcttttccccttcttcttgtagtagtatcccatgcccatgttcttttccctccttcatccatgtgattctgctaggactgtctagtgcagttccccttctgcctggcaggggttagtttaagaactgggtatgtgatctaagcttgcccagtcagagtccttcctaggacatttacaaacttaagtaggaaggaaaaatccttttcttttctgagatatttgtaagcttgaattgagtccagaactataagaagctgtgtttctcatcacgtgggaaaagactctagacagcactgtccagtaccaatataatgcaagccgcatatgcaacttaacattttctagtaaccacattgaaagaactaaaatgaagtaggtgaaataatgttttaataatgttttacttaacgcattatactcaaaatatcatttcaacatataatcaaaataaaaattgttaatgactcattgtatgattacatattttgtgccaagtctttaaaatccagtgtatttaccctttaccacctctcagttcagactagtcacattctaggtactcagtaaccacatttggctagtaactgccattttggacagtgcagctctacacagtgagaatgaaaggaagccaacatggaaaatgatgagtgataaagatttagagagaaagagtactgtcagtgctgagatttttggttttggtccttgaggtttgagaaactattttggctccagctcctataaccagctcttctttggaatctttgagcccctcccatagttttccaataagtaacttttttttatgtgagtatgatttgggttcctgtcacttatgatcaaaaaaatcttgactcatccagtaagccagtaaggcattattatcttcatttttttaagatgaggaaacctaagctcagagaagttgaatgggttacccagggttatcctaactgtatgaactgtatgtggcagggcctggatttcaattcaggtctgtctcactcaaaagcccacgctctttttaccccaagagactaccatggaggcttcctgtagagcaagccgttttcactggatgaagggttgggatttcaatgcttcacatattctttgtagtctctgatacagtggaactgtgaaaatgcttattttttgacaggaactttttagtggagacccatagtagtcctgtcaacaaatctcacctccctttctttctaaaaaagtgacattagcaagttacttggcactgaatggaacttagtttgctactacgtatcttgtgggcatctgcaggctatcttgtaaaatggtggagtaatctaatcttgtttcatttgaagtatattggcctgtccaggaaactttattagcacctctaaacaattacgtcattaaagggcaagacttagaagccttgttaaggctgtgtaagatctgttttccaacttaaatgaagttaagcaaattcccataataattttagaatgattcagtgttttctagttatcgtaaatgatattgcaaaaagctggaaatcaacatgaagctattctttttcatttttcagaatcagccttttgaatgattcctatactctaatgttcaattgatacttgattcattttagaaaattgtcatagacccatatacttgagaattggcatgtgtgaggctgaagttttatgctagtgcacccaggcaatccataattgcagtaaagaaacatatacttgtctgggtgcggtggctcacgcctgtaatcccagcattttgggaggcggaggtgggcggatcacctgaggtcaggagttcaagatcagcctggccaacatggtgaaacctcttctctactaaagaatacaaaaattagccagatgtggtggcgggtgcctgtaatcccagctactcgggaggccgaggcaggagaaatgcttgaacctgggaggcggaggttgcagtgagccgagattgtgccactgcactccagcctgggcgacagagtgagactctatctcaaaaaaaaaaaaaaaagaaccatttacttgagggcacacagctgaaagttcaacttcatttctttagcacaccatcagaagtttctttattagacaatcataacaaatcaaggcggtttaactttagtcaacactgtaatataaagctatcccaaattaaaatctacaaagcaagaatcctgacttgttcataagtgtgaggtctaaacctgttaccactatcacctcttctcacttgaaaattccactggtgcctctttaatgccacgtattaaacataaaaaaagatactaagtttacattgagagtcttcctattcctgatccggtcagactgctctggcttctcactcacaggtactatggctagcagcaaattataatgccgtaaagaactgtgctcacgaggttctggccgtgacaggagccactccttgggttgtggttctccttaatatcgcctctgttattctaagcctgaatagtctgggatgagggaaaggaaactacatccatccacacacacacagcttgaaggagcttctaggatagctgacaaagttctgtttctctacctgggtggttttgtcctgtagtaattcgctaagctatagataggttttgtgtagttttccatatttgtattttattttgcaataaaaacataattttaaaaagcaatatattgaatacagaaagttttaaggaattatattttctctccatttgccctgcctggttttgccttttgttaagaaacctaggacatgaaatttatcataatgtaagaaaatctccttcagagccgttcttggaaaaggatccaccaatttattcaacaatatttattgaactgtggctgggtgcggtagctcatgcctgtaatcccagcactttgggaggccgaggcaggcggatcacttgtggtctggagtttgagaccagcctggccaacgtggtgaaaccctgtctctactaaaaaaaaaaaaaaaaaaaaaattacaaaaattagctgggcgtggtgacacatgcctgtagtcccagctactcaggaggccgaggtaggagaaccacttgaacctggaaggtggaagttgtagtgagccgagatcgcgccactgcactccagcctaggcgacagaatgagactccatctcatctcaaaaaaaaaataaataaataaaaaataaaaaaataaaaaaaacagccacgataatttattaaattgtgactctgacttaggcattgtattctatgctgacgtatatatgttggtaaatatgataaatgtggtcagtgttcctcactgtacttattagtcatatcagtaatatgacagcttaaaaggctttttattctttagtatattgtttgggaatattattatatatatttatatttgaagtcactgatagcctcttttgtagacatgtatcgataggttatattagttatctattgctgcataatacgttactcgacatttagtggcttaagacaataaacattcattatctcacagtttttctggcttaggaatttgggattgagttagctgagaagttccagctcagtgtctctcaagtggctgcagtagccatctgaaagatgaactggggctggaggatgcacttccaagatggttcactcacatggctgttattaggaaggcttgatgcctcatcacatcggcttctccaaaggctgcttgagtgtcttcacaacatggggcttgacttcttccagaacaagcaatccaaggaagagtgaggacgccacagggccttttttgacctagtgtgaagtcttacactgccacttccttttactcacttcatggaagttatttaggtctagcccatacttaagataaagggaattatctccaccgtttgaaggtaggaatatcgaagagtttgtggacattttaattttattttgtttaattaatttatttatttttgaggcggagttttgctcttgtcgcccaggctggagtgcaatggtgcaatctcagctcactgggttcaaatgattctcctgcctcagcctcctgaatagctgggattacaggcatgtgccaccacgcccggctaatttttgtatttttagtagagatggcgtttcaccatgttggccaggctggtctcaaactcctgacctcaggtgatctgcctgcctctgcctcccacagtgctgggattacaggcgtgagccactgcgcgtggcccttgtggacatgttttaaaaccacacaggtattaggtaggtaggcagagagatagaaagatagttagatactcagatctataataatagctcttgaatgttattaatatattgtccctgtcccttctacttacttacatcaattttataccacggtcatactgaacagttaacctgaacacatcttatactttcttgattttgtgtcttcctcaatctgtaatactccacattacaatttctatctgttgaaatcttacccatcagatatggcattatacaacggtcacctccaggaagagtgcaagtttgaggaaaggcccagaggtggatgagtttgaattctgttcaaggacaaacaagattgttgagtgtggaatgccagattaaaggatttggatttcatcagtacacattaaagagtcatgtcaggttttaaaacagtcaaggtacaaagtggcaccttaagacttcactggggaaggcacatggagggaaggagcataggttaaaggaggctactggaactagaaatgaagtgatccacaggtagcagtacaaacaggaaggaagggcagatgctgggaagagttgaagctccttatggcagaattggtgtaattcacctttgtattttcttgctttatagcacagtgccctgaacacagtgtatactcagtaagaattttcttttttccttttttaaaaaaatttctttttaaagaaaaaataatatatgcgtgtatgtaaaatgatttaatgataatgtagatgagttcttacattatttgagtggacctcgctttttctacttttttttttaaagaaacactgtgatccacaattgtagcaattaaaatcttaaatctaaaagaaacataaaagggaatataatgctagagctcattctatttttattcagtacatatatattacttagtatgatgagactaccgtaataaagaataggaacagacttctgattatgtaatagcctgcaattatttttatggctattgcattccaatcttcttatgcaatatttacaacctacatatgtagcgagggcacaaaatacaagttctaacaatcctaaccataaatcagaatcaaagcatgcagtataacatttgtgacctcccttggctgctgcagacagcctttgttaagaatacataaaatactgagtttataactctgtggtagatctgggattttaagttataaaacttaatcactctctaccccataattaaagattctgtcaagacaatttgatattagtttaattgtgaagatggtgaaaaactcttatattccattttggaaaaataaaaacacaaaatgttttaaatattgtatgagtgtaatgagaatttcagcagattataactacaaaagattatgattcagcctgaaaacataacctatggaaaatcatcaactgtgcagaatgagctcttccagatgacagatcttactaagaaaacctgccaatgaaagatagagaatgctagaagaaaaagaatcccgttgactttcaacatatggccccgacaccgacatatcttatagtttttagtgaatagcaacccaaaataactaggttgataaaaactaaaaaaaatgagtgcgtgaatttaaaaaattctgctttgactttttctccgcttttatttcaaagggtgttttaatggaaaataagtgtgcatgtgtttgtgtatgagagtgtgaaggggtacagcttaattacattttcacttttcaggataatggagactcctggcaaactgaataaagatagctatccatgtatatttacatatcagtgagaaaagcttcttcatcatcatctattagcctgttggttctctcagctacctcatacccctgcatttgttctcttcctctcttgttttctccaggcgtttttcttacatccccttctttagttagccttttcaacaactgcttaaaattaaaggatccactggcaattatctggtttacttacttggtattaggaaattatacaatatgttggaatgttctgtgattgttactcatgtattcattttcactttcattcaataaatatttgttgagtacctactacatgccaagcactgcactagagaaatctatagtttacaggccataccctatctaatgtacttccagatatccttggaatataatggattaaagagttgcagaagttaagcttacaggttaagcctacttctaacacttccttccctgaaatggaactgtttcagataggccttctttctagagagcttagttcttcctaaattccattaagattgccctgctaccatgagaattgtggtgctactttcgagcaggattggcccaatgggaagattgactgccgagtaaatgcaagcagtggataaatgcagacacacaataatgtcagtattccatttctgttgcttattggttgcatgccttggcttcctcatctgaaaaaaatagtgaggctgtaactacatacttccaagagtatctgtgaaggttaaatgagttaatacatgtaactggttagttcagactaccacagagctcttgatgaatgttatttattatcattcttgttactgtgattgttataaaaattcaagtatgtttcttttttgagatagggtctcgctctgttgcgcaggctggatcacagaggtttaattcatagctcactgcagcctctaactgctgggctcaactgatccttccatcttagcttccagaatagctgggactacaggcacatgccaccatgctaaaaattcattcttaaagtaacaggacaaatatttactaattactgtgatttatatatcaaatccaatttgagatattacgtggaatcaacttaaaagaactagacctactcaggcacagtttcaaatagcttcattaaacctaactataatcaaattactttttcactctagtcttccttattgctctaagaaaatcttttaatttgcacaacagctttctagtgtctgtttctgcctgcttcagggtgctatgaaaactatcccctctgttaggtaacctgcaagtttttatctttgagcattcctactataatgccccatgcatgtctctttttctgtggattgaagctactttgtcatgtctcacctccaatggccatacgctggctctcttcaaaaatcctcagggaggtttttattttattcagtaaagaaaaaagcctcatttctgactctcctgtcccccagctccaggtaaagcttgcttactgctgcagtctttgaagtacttttcttttctttttttttttgagacggagtctcgctctgtcacccaggctggagtgcagtggcgggatctcggctcactgcaagctccgcctcccgggttcacgccattctcctgcctcagcctcccaagttgaagtacttttcttatcaatcttaacttgtcaacaagttggctttgcactgaaagacattttcaaaaagaggttaagcattcctctctttatatggacatttaaaaccttgagaacaaaactatttaatttgtaaagttcattgaactttactctcaagtaaagttacactcaagatttgtgcactttagtttttatatacctttagaaaaaaaggtgttaaatcacagttaagagcctgagcaagagctcaagctcttagtgagatcatagcacaccaccacttactgtgtaaccttggcaagttactcaacgcccccgcccccagcctcagttttcttaattattaaatgagaataagatctgccccaaatgtcaccttattagagagttcttccttctctccatgtgccccatcccaatcacaactttcttcctccctctaaaagtagccaccattctgactgttaggaagaaaccctcgacattctttgtcttcatcaccgagctgcccctcaactatggttgagtcttacccattgttttaaattcgatgtcttttaagtctcttttcatttatagattcctcctctattcctttctttttcttatcgttttgttattattgttgttgaagaactcaggtcatttacttgtagtttcccacagtctagattttgctgattgcaggctcattgtgcagttcagcatgttcctgtgtatttactgccaattggcagctggatggaaaggcttaattagatctgagttcaattcctttggcagtgttattggtggtgatgtgttcttttatccgaaggcacatattgcgtgattgtcacttgtttattgcggtggtagtagctgttggtgcatagtacctagatccattaattcactgggggttgcaaaatggtgatactataattttatcattctcttttcatttattaactggaataattttgtaaggagatgcttctctactatttggttatccagcgttacagttcatataggaaaggcaggataaatgcttcttctatttattccgttttcaagataatgaattagcctgtcatccttccaagttgactatttatgtattaaattaatttgaacttatgactttaaatatatttgggtttcaacttactgcaattcttacccttattgaaattcattctcatctttggccagctgtagcctcttcaggttagctcctgaatccttttgacatggccctagtagtctttgatatctgctgtgccaagatgtttgaaattcattttgtatatttcatgacccaaatctgaaactaaacattttttttaaacctggattctgtttgttttgttttgaaacagggtctcactctgctgcccaggctggagtgcagtggcactatcataactcactataacctcaaactcttggccttaagcgatcttcctgccttggccttccaaagcactgggattacagatgtgagcctggattcttttttttttttgagatgaagtctcactctgtcaccaggctggagggcagtggcgccatcttggcttactgcaaccttcgcctcccggattcaagcagttctcctgcctcagcctcctgagtagctgggattataggcacacaccaccacgcccagctaatttttgtatttttagtagagatggggtttcaccatgttggcagcctggattcttttttttttttgaggcggagtctcgctctgtcacccaggctggagtgcagtggcacgatcttggctcactgcaagctccgcttcccgggttcatgccattctcctgcctcagcctcccaagtagctgggactacaggtgcccaccaccacgcctggctaattttttgtatttttagtagagacggggtttcactgtgttagccaggatggtctcgatctcctgaccttgtgatccgcccgcctcagcctcccaaagtgctgggattacaggcgtgagccactgtgcccggccagcctggattcttctaatgggaaatatttagctattacagtttaggctcttggtatgctcattgctaccagattgattatggtttctcagtcttttcatggtacagagctggaaaatataaacttgacctgttaaatgtagaaaactttgaacatatacaaagatagaacgactactgtcctgtaacccattacctagttccaataattatcacaaggttaatctatttcaactgtatctcctctcctgtttcccaaactggattattttgaaacaaattccatacatttaaattaactggtaaatactttagctcctgttcagtttttaatgccatgctgcctttccttctctttctctgctagattgagttctctggtattgagctggctctgccgtttatcagtaggacttaagctctctaatcctccccttctcatcttttgagtaaggtatcgttctagatgatttccaagctttcttacacccttaactattgtccttttttcttttttaaaacatagaaattgctgggtgtggtggctcacacttgtaatcccagcactttgggaggctgaggcaggaggattgcttgaggccaggggtttgagaccagcctgggcaacataatgagaccttgtctttacaaaaaaaattattttaattagccagttgtcgtggtgtgcttctgtagtcccagctactcaagaggctgaggcaggaggaccattagagccccaaaatttaaggttgaagtaaaccatgatcttgccagtgcactccagcctggatgacagagcaagaccctgtctctaaataatcaataagaaatctgtttacttttttgttttttataaatacgtgttcattgtaaaaaatgtatgaatgcatgtaaaatagaaaaggaaaaattcatgaaattctaccccctagaaatgaacactaataataatataatatccatcagttgaggctgttttggtaattttcttaattggcttctttgagttaactgtgtattgtggactcaccacatcctttgggcgggaaaaaagattgtataggattctggattctgataaatgaatgtgtcataatttaattaatggtgctagatagtaagattgtttttaactttttggggagtgggggaggtactcttacaaagagtgctacagtgaatatccatgaacacacagacatatatatctaattgctaattaggataaagtcttatgagtagtattcctgggttaagcaatatccaggtttttatatataaatatatttacatatacatagatacgtatatatttacacatatatacacacacatatatacacatatatatacacacacatatatatacatatttgtaactcccaggatattctgtcagtttacatttcctataatttttatgactggtgctcaaagatctggttatacttggaagaaattgctggggccattaggaattggggtagtggacaattcagaaagtagacatgaatttatttgtgacaaatagctattctcttacccagtgttttcagcctcagcactattgacatttttggccagataattcatttttgctgggggctatcatgtatgttatagaatgtttagcagcattcctggcatctgcctgccagatgctagtgtaattcccctcctgcccccaagttgtgatagccaaaaatatctatagatgttgccaaatgtccccgggagggcaaaattacccctggttgaaaaccactgaatattcattcaacagatacagagtgccttaattctgagaagggagtctaggaccaggacttacaaagcaaaattcaaatttagccttttatgtgtttgtatgtttgtgaataaaacagggtttttacttccctaacccctatatgagaagtcatgccgtattatactgttgataaattttcagtggactgatttccctttctgtggactttctcactatcttttttctttactgacctccatggcattagttggggtgaggggaggtgaaaagcgtgaagtacgtatgggacagaatggtcagccaagctgaccaggaccagtggagggtgcctgttcaccaccccgagactctccatttatttaggtgaatttagcttttcaagctttgtttgagatgtaagttttccttgaaaataataggctttatttgtacttttagtgtacatctcactaaattgatatttattaaagaagttcattcttcttccaagatttttggaagtgggaggtttgatatagaccaagaaaaaggagggcaagttgatggagctcccctaggacatgcttagagtagtcacagatttttttcagttcacggacccttggggacacatctgcattgatgcctgaagattttccttactacaaagtcttaagaaggcagctgttgcccttgcctgcctccgtttttaataccgagtgcacccaatttagctaatacaagttctaacaagcaagcctttttccttgatcacaatggacactttggacttagctgctgggacacacaactgtctggattggactgcacctctgtaaaagctgagaaggctgtttaggttttttgttgttgttttttcttttaagtgcagattaactgggccttcaggctcctaacaaattagtaatagagctgtataactttgaggccctactcctttagtaaacagtggctcccaatacataatgctgttcccttctaagcaaagaatatttgtgtttaggtaagaaagaataaaagtaaggttaaatttcaaagtatggcctctataaaaacaaaaacatcacgtttttctctctctctctctctctttctctgtgcatgtgtgtgtgtgtgtgtgtgcgtgtgtgtgtgcatgcagtgtgtctttttaggggccgtcacctgcttttgctgattgtataaatctcatgtttcacagttttgatagataatggaaaatcattctgattaattgcttaaatgcagtatgcagtatttgctacttatatgtcagaagtcactgcaaataggcagctaattcaaatgctttttagaatttatgattcctgaaactataatagaactattattttcacttcatttgaatgagagactctgtacttccacattgtctcatgtattttttctttcctttgtatagcttattttatattgtatatgttatatacaatatactaaataaatatgttgtatattgtagtttattagatttaattaaaattttttgaggtgggaaattttgggccaggtgtggcggctcatgcctgtaatcccaacactttggaaggctaaggtgggcggagcacttgggcccacgagttagagagcagcctgtgcaacataaggagaccctgtctctacaacaaaaaataaaaatatataaaaattaactgggcatggtggcatgcacttgtattccagcatacaagggggctaaggtgggaggatcgcttgagcctgggaggtcaaggctgcagtgagctgtgatggcaccactgtactccagcctgggtggcagagcaaaaccctttctcaaaaagaaaagaaaagaaaagaaaatctcatccctgtttttaaatgaaattttagataaaatatttttagataaaacattttagataaaaaatttttatggcaacaactcctctttcagtaattcaacatatactgtatttgagatcatttaaatcctagataaccattgaaaatttttattttatatttatttatttatttatttatttagttagttagttagttagttagttatttttgagacagagtcttgctctgtcacccaggctggagtgcagtggtgcggtctccgctcactgcaagctctgcctcccgggttcgtgccattctcctgcctcagcctcccgagtagctgggcctacaggtgcccaccaccatgcctggctattttttttgttttgttttgtatttttagtagaggcagggtttcaccatgttagccaggatggtctcaatctcctgacctcatgatccacccgcttcggcctcccaaagtgagattacaggtgtgagccaccgcgcccagcccattgaacatttttaatagaaagttttatcatctcaattttctctttttactttgtataaagatatttctgtaccatgcactctttaaggacaggctccatgccttattcatctgtatatcattgcctaatttaggtgataagcaaggttttatcaacttgatatattctttcattaattagaaattggcagtaggggtaaatgacttagaaaatctgtaaatattctctcaaatgccactgtctttcatttttagaggctgacaggccttttcagcctttaggttttagagacaaacactaaaattacccagagctttgcctactttctaacaatagtattaaatgtaattaataattaataggaatggagagacgagttagttataaaagtacataaatgtttgtaacaataagcacaacctgctatatttgaatatcttcttacagcatatttaaattaagtttttcctttttaagaactaaagttttaagataagactattgtgtttcgttcctatatgctttatgaacttaaaatatttttatggagtctgtaagctgctattaaaattgtattaacttttggcttttattccatagtataattatccttgattacagactccagaagaggtagtgtacagaggagctgtttatttcacaaaaaacttgacataggattctagaacttctaaggataaaggctgttatttttgagataatttaaacccaaataaatattattttagaggaagattacagttagggtttttttgaggggaggggacaactatcttctgttttgaagaacaaatactcttcattgtgggttgttgtgacacccagaatttctagcaataccatgtttgatcctatctctttatttcctaacctccctctcactccctcaactccaccccaaagaaaattctcaggaattacatcaaaaacactatatcatgttatcagacttccttttcttgattctctagagtgacaatatcttggaaagacaggacaatgttgaacatagttttcataaaattcatgattatatcaagaaaattaaataccaacagagagaaaacaaggatgaccacttggtttctggcttaagtaactgggtagatgtttgcgccatttacagtagtacctccatcctcttttccactttctgggatttcagttacctgggtcaactattgtacaaagaaattaaatggaaaattccagaaattaataatttatacattttaaagtttgtactcttctgagtaacatgatgaaatctcatgacatccggctctgtcccacccaagatgtgaattgtccttttgtccagcatcttcacaatgtacaagccactttgctctagctgtgtacactgcgtgcccttccatcacttagtagccaattagcagatctgatattggttatatcatatctctttatggatgtctgatataaccaatatcagatctgctgttgctggtaccacaatgcttgaattaagttgacccttattttacttaattatggccccaaagtgcaagagtagggatgctggcaattcagacatgccacacaagccgtaaagtgctttaagtgaaaaggtgaaagttctagaattaataatgaaagaaaaaaaccctatgctgaggttgctaagctttacagtaagaatgaatcatctatccatgaaattatgaagaaggaaaatgaattttttgcatagtatatagggggtttgatgctatccatgattttaggcatccactggcaggtcttggaacatgtttcccatggataaggaaggactattgtatttagatgggagaatggggattagagtggggtataggtttgggtgggggtgagcacactgaggtgttgatcaagatttctataataatttggcagtgttgatttggaattgcctttcagacatctaggtggagatgtccagtagctaggatatgcaagtctggcattcagaagagaaactgaggtggaactataaacttgaaagggtttagcatgaaggcatttcttatatccattggaatggttagccttccttcttcccttcctcccttcctctgtccttccatccttccttcgttaatcattaaacaagtggttctcatttagatttatttacagttaatcatatttccagcatgaaccaatttttcaactctcattgttatgtcagctgaacacacaaattaacacatattctccaagaaattgggaaatactgatcctacttctttagcaacttattttctaaatttatatagaaaaaattgcagaaagaaaaaatggcaataaaatcatttctcaagaaccattaagtgtgccagagtttcctcaaaacagaaatttcagaatagtggatacctggcaggggtagtaggtaaggggatgagaaaggtaaggggctacacaggcccttcctttgtatttcatgttatgtttctttatctgcatggtggctagattggcattcattatatcagtgattagactatttcatctaagggaaaaaaaccaaactcttgcacatatttctagagaaagtcttcagaatttgattactccaatgacagtgtttatttgttttctttttgttgtagtacaagagaggcaggaattagaggtaaaataaaagctctttgcttcctttattagtaaatatagcttactaaagaaaagttttatgactaatttttgaattgcagtaaataagcatattatttcactgttcaaatacaatggtctgatcgttgtatattttttaaattaaattgagctctaggcctttggtcaggtaccttaccttcatacttattttcatgggaaatccagcctaattacattgtatggatttacagtgcttattaaggaacataattctctgtaaatgtaagcattgcctttaatttgaagtaaaggtgggtggatttcatttcactgattgagacagtgtcatagacattagaaaataaactgttagggtttacgttttcacataaactctttgaaaaagccggaattatcttaatgttttatttgtagtggtattaacaataaaagttatattatactattttaaaaatatgttacctaaaaaataaattacaaatctaggctcatagttaacattatactgtagatatatttctgcagggttagtatacactgttttgcacagtgaattcttaaaaagaaactataggagctcaccatttaagaaacccttcagccactccttctatacaaagaataatatttgtacattcagatttttagattagatttttaaaagtagttaaattgggcatcttttatcatatttgtctttaattaatggtgtgactctggggaaagtaaagaaacctctctgagctccagtcttatctttaatttcaaaagtgaactagataatctctgaggttcagccttaaaattctgtgatactcatttaaaaataactgtaccatccagcatttcagaaaaagcattaaggacatgtgtttcatttccttaaatgaaaacagattataatgtatgtaatcagagcattgaaaagagaaggagagagaggtgatttcagtaccaaaatttgtctataggatagactacctggatgaggcaaaaggatctatagactacctgcctcaaaaatctctagatataatgagagagatggtaggtactccttgagatgagatactagtctgatgatggctttttttggtgatggctgttgaacaacatgtaaataaaagcagtaatcatgttagaagagaccaatctgtgcctgtgttctgtagactacattgttaagagcatggttcaaatatttgaaagagaaaagaaaactgcttttaaaaccacttacaattaccttggcattctcattttaagtagccatctgcaagcatattaattttattatttcagtgaactccctatttgattaatccgtgacctgatttagtaaacatttgtcaggatatatcttccctggagatacattaagcttggagcatgtaaggcatcttttttcctattcaaacagtgaagttaggaaagtgttgtggtaataatgtgagcacaattgtctaagaacattaagaaccttcgtctggatcttttgttaccataaaaggcaatgtatcatgctttcctgttttgcatggatgagaagggagtaaaaaacaccaaaagaatttttattgcatagaaatatttccttcctagcagttggtgaagcaataatgagcctacaaaacaatcttcctatagctggggagaggagggcaggaaaacgtagtgcagccagccacatagattcgcagactggcaggctggtcacagagcgcctgcttccatccagagtcccttctacatgtaactctccccagggcaaagcgcctgcatgtgcttcttctcacagccctttaagatatacagggcaagtaggagctgcttcttttctagaagaagaacttatccaagcctgtggtgcagacgattgttgtaggcaggctagagccacacttacctgattcccaatttgtacgtaagaccaggcaaggtccactgtgttgagaagatgctttctgtgaatcaaattacttggtacagaaaatgttgctttcagtgtatcttgtggcaactttaacattgtagacatcaccactgaataagatgaatgcgtgggaattgtggatttgaaaacactaaaagtggttatcaggctttagcacatcttaagagtctgcatttccactagcctaattcacactgggcccttctcagcgtttcttaatgctacgctactcccacttcctttcctctgtttccctcacttcagccctaaatgaatttaggttgttgaacagaaatgatcataaatccctttttaagccaaatgaaaagaggcccataatttctttagtttgtttcagacccattacctttcagaaggtcaaacctgcctcattctctaggtgtggacatgatacggataacaaaaaggcatggggatatgttttatcaaatgtcctaaagatgtttttacatgcagtttttaataaaaaacaattatctactatgcataagaactaaagtaataatgtgcaatgcattttgtgctttttaataataaattattagtaatgaagtggagacaacttagagttgattgttttctttggaggtaaggaaacatattgaaactaaacaatagtagctgcctaagatttcatgatgtgacagtggcatattgctatgggggaaaaaaaacaaccatgcacagaagaacaagccattcaccctgatatcagtaatttgaaagtgaagagcaattctttttcagcgtgatatatttttcagttttaggttaaaagtgttgcattccaaggaaggcactacagtgcgttctcagtataaagcaaatagttttgtggtattggttgtctgatgtggttgagcactggtatttcatagctttcaaagaaacattttaaagataaaaagaagagcagaaatactggaaaaggcaatatgtcatctgaattctgttggtgcttaagaacagcaagggctatcagttacccttgagttccagtcccagttttgtcactgactctgaccttaggcaagttatttaacttatttatgcctttgtatcctcttctctaaaatgaatctaatacctgtctcacagtgttaagttgtgaggatgaaataaaataatgcctgtgaagcacttcctatagtgcttggcatgtgaatcctcagataatgatcacagttaaggaattggatggttgctattttcatggttctttagtttacaggttttcagagtattttactagtagactctatgcttaattaattcattcaacttaatagtaaccagaaatagtgttctttcatctggagttgtaattccctcacttgtaagtaatttttctgctgcctcttgtctttactgaaaattgattctgttcgttgctgtggaggcctcacctttctcacttctcctgatatactgtgaaaatattaaaacctaataatttgtccacatgcaccactcttttcagtaatcattgctgactctgtcaaccctagactcattcccactttgctagacaacctcagtacctgggtcttatcttctctccatcctctgccatcatcctccccaattctggcacgtaaaatgatgatccattcatccttcttcagcctgttagagtctttccagctccatttctgctccccacctttcctttttgctgcaccttgtacttcatcatcactgctctgtttctaaaatatcagtactctctttctctgcttaccacgtcctgaactgctgcttcttccactcctccacatctgtggagctagatctgtgccttcagtcattcactcttagactctgctgattgcatgcttagccttgtctcaaagacctactacttcagtaccacctcctcaaccctcctaatcacgttctttgtccactgtgatagtcactgcatgctttcccgctttttgcaatctgctgttggaacattttagaagcaatctgagaaccgtactgatttggcccactacaaatttgtgattctaattttattttgggccctttgtatggcttaacagtagttatcaattcttcagcacatttgttttaataactattaaatatttcctattttctagtctccttatgcttccagtcctaaccagccctcccttcctcttgggacatgatcttgcctcttatttttactgaaccgattgatgttattgctgctgtgtatgtactatcattgtccctgggagattgatgaataaaacattacctagcagtgtttgtgttcctgaggtctgatttggcctgtgggtaactagatactgactcttatctttgtcccagcgagtggccatctttgatatagatgatgtttctttacttgtgtatctatatatttggtcatttcgtgatctgtatttattgagcacagtgacctgtgttaagtaggtagtaaggacaattagaaagagaataaaacacatagccccccttccctttctgtgaattaataatgaagacaaacctacctaattttagtaacattttgttattatacacttggttctaaccatgaatttggttaccttaaaggtgtcctgccctctcttgtgatgcacagcagagtaagatgcgcttgacgggtagcgtggctgtcttttccttctcactccagggttatgatagttcctgttgtacacatggatgatagagacacagcggcaaccatacaggatttttatacttgtactaaggacttggagagggtctaaaggtaggaaagtagtaggaactaccaagttgattagaataacaggcctggaaaggcctctgaagagtgcgttaagagagaaatcatagctggccttggaagggagaggtgtcgtttggtgaggcagtgtgcataggatacctcagggatgtgagtggtaaaggcagatagggcatttttccagaagaaaatatgaatgtcagttattatagaagtgtatagatagaatttgctcaccactttgtgtgtgtgtatggagttgtgtttgaaagcagaacttggatggaatctatggatcaattactttcctcttttctagggttatgggtattgagggaggccaggggcattggaagaaaaaaaatgtgtgtcattcaagtacccttgggtgtcttcattttgggtagtttcctgaagagatagtgttgatgccttttgtgctgttagcattgtcatctgttgctggaaagggtaatcctggagctttgatccatggaatgaatccagggagccaagtgtagactctgaccgttctacacagtagtttaggggccatgagacgtgaaaacttggcctgaggagcccttctgccttctcatagtctattaagaaaccatgaaaaagagaggaacttaacgtaaccttaactgtctacatttttgacactttgccagacctgtgtgatttattttaaaagatagaatgtgtattcaggcactcccagcgtcattttacttagtgaagtattagaagtcaacaaaattaacttctttatttgggttttaaaaaaacggaaagaagacagctcttacagaatgaagggtaacagtactagaaacaataaaaggaaaacattaccatccagttttatactttttaacttctctattttgtgtattttctaacttgaatacagctttaaaatgccatttttagttagacatggcataggaaatgttttaaataacaaatttcagttggggatgaatagaacattacttgtattgtgttaacaaatacataaatgtaaattgttttaaggtgcatattaagctttattaaacaaagagataaatattttgtctctgttaatgttttactcaagtaacagtaaatcttttaagtccaccaaaacatgaaggcattgcacaatgaatggtacattataaatgtattctgcaggaatgatttatgcatctgacttctatggcactgaatttcaaaacctcataaagaagtcattttagagaaatgtcatgctgacctgtgtagacggagacgtaaaatttgcctatgtggtcaacttcatattaacttgatgttcagagttacagaaatatttgaatacttatatattttagatgataaatgcttgtcaaagtaatgaatatttaacatattacttgacttatagactaatgacctctctaaaatttaagatttttagccatacatgattcagtttatttctcgtgtgtcatgcaattgattcttcttgttgtgctacccataaaaactttagtgtttctagggtattgcctcaggatcatcatacactacttgtaattatttgaaaaattcataccaaagcattttaatatatggcagttttaatattttggcatctcctacacattgacttatcagagaagattatgtctttattttactttaaatgaagtactgttttcagagatgatttccttaaatccatctgcactgaaaaaatgtaattaatctgacattttgtaaaggtttcattgaattatattcttgtcttatgctgtacagggataagtacttacacattttcagctaagattagctttaggatgtgttaaggaaaaaagataacagtacatattttatgatcaatatattttaattagtcaattttcaaatgaacttgtccgtctgtaatttgtagacaggatatgcccaagtgcagaaaaaatagaatttaaagcttagacaaatagatggaagaatttgaatctatctgttaaaatctcatagccaagaatatgctgatttgtatatgacccagtgtactaacacatttacacaacttccaagtacagagaaaatttaccttgagctttaaaatataaataatttgtctttgagttcgtagaacagtctttttttcttcctaattaattttattttattacttgtttattcaccacaatgaattaatttagacctcaacgtaaacatgctcccatcttgggggcatttacagttttactttacagatggacaagtttatgcatacatacctgttcaatgcatgtgaatacctgtttgagggctgaaaaaagtttttttgcgtctaacctagcaaatagtaacttttgtgagctgatagaggtcttcttttgcctgaaggaaggagaatattgaaatatgttttcaagggccttatctatttttctagtcttatgattcttttatttaactactgtaaaactgtacttagacagaaataacaatgtaagaacttatttaagatgcacttttccttcccttcaagttaataatttcaaaaattcttcacataagcacgacagtgctcttaaaaatcgccagcacatcttctgtttctaatttagtttcttgaattgtttcccatagcttcatgtatcttcaaaatatctgtatagagtccacttctaattacttactttctaacttaggaaaaaagaaacatttatctcatcttggttttcctctgatttgccaccatacttgagcaatctcctaatctatttttgttccgggaatgcaaaattaattttaatatcagtttaagcaaatcataattagcagagaagcatccttgttaattgagggcttaactatgagaagaccaggagtgagctgtcttcttcattgagagatcttcaaatgccagcatcagttggccatttctggaggagttttcaatttctccagaaaataaatttttggtctcatatctggggatggatgtggagtgtaagaacatataaggcttggctcctggaggccaaggaatgaatttctggtttcagctctgtgatctgaagagctggaatgatgtaggtcccatttttaccacaagaaaaaagctggacagacagattttcatggactcatcagagaactaaggcaacagaacaaacagctatcctgaaatgtggatagagacaggagctctcagtgagtcctaggatgtcagcacttgcttacctgaggcagaagccactagatccttgtaggaaaactagagattttgatgaattgctggaggctgaagctaatgagaacatgaagcttctgggccctctgtcgtacgaggggttctcaccgttttgcaagcttacacagatttttactcctctttttagccttgcctctcactgcaactgccagtacctctattttacctttgggggcttcctcaatatgaggtgttttttttttttgacagagtctcgctctgtcgcccaggttggagtgcagtggcatgatcttggcccactgcaacctctgcctcctgggttcaagcgattctccctcctcagcctcctgagtagctgggattacaggcgtgcgccactatgccctgtctagtttttgtatttttagtagagacagggtttcaccatgttggccaggctggtctcaaacttctgacgtcaagtgatctgcccatcttggcctcccaaagtgctgggattacaggcatgagccaccatgcctggccgaggttttgtttctaataaatcagtaatgctttcggtagtttaatctgtcatctcaaccagaagtcttcatcacaatatcttgttaactgaaaatagtccactacaaaacagaatttgtaccataaatctctaaattttgtttatgtgaacacatagacacacacaggaaagaagtctggcttacatagatgtcatagattatggtgatattttccctctatttgtattttcttatttttttttaacaattctacagtaaaaagtgtttaagaatactcagaaaacaagtgtgtatctataattaatcactagtacttacaatattctctttttagtttgttttctttcagcttgttctcatccagatgtttagaatcctaaatgactgttttctcctgacatttgccattggggtacataaggtggtgactgccatagttctttacaactccagtgattctcttaaaacttgctcttaggatcccttgcctaaccctagggcttaaaggtgactgctctggagctacaggtgtggacgaagatggcccttgggcttctgcaattattctgttctcccaggtgaggagacttttgtaggacagggtggttatttaggaaattctgagctgctctaagccagtgttgcccaaccgtgaccatacctggggagctttaaaaactcccaatctaggctgcaccccagaccaattaaatcagaatctctgggagggggacaaaggcatctatagtttttaaagctctccagggtgatttcaatgtattgctgaggttgtgagctgctgctttaaaggaaacaagtatgtttattcctaatccatttggatcttgagggccaatctggaaaagcaatctctatacccactgtcatctcgatacatatcttgtggggattctgtagccactagcaggccatgttcatctgtgtgtgtgtacctgccttgatgtgacaaatcataagcactaagaggagaggcagcctcttttattcaccattgtatcctaagtctctaaatcagtgcctggcctagtaacttaccaaaagatattgtaaaagtagtgcatttagggttttttttttcctttttattgaaaagggacaaagacaagtggtcaaaacgtcatttcataatacttaatttttacgaactctcctggccccaagtgtctgtgattcagtgaggaaagagctctccttcattcctttgacatgaatatattgactacccattgtttacataaggctgggatggctgtgatcaaaccaacatccacagacatggtacctagagaaataaagcgcggaaagccaaacctatggaagaataacaaatattgcaattcaaaagtgaaaatcactgtagactagcttcatttttccatttaacaactatgtcttggccacctctttctctgctagcactagtctaaatgctggaggtcttgagggcagtttgctaagtgattttaaaatacaactttagcacctgattttctttcttttcttcacagtcagattttgggccagaacctaagtgatagatttctaggcattgtaatagataatgaaatgcattattacttttgaagttatgataacctgacaagaaaaaaatggatatttttattatctacatcttacagatgaggaaacactttgtgcactttaagtaacttgcccaggctcataaaccagtgttgttagctcagctacttcaataaaggtcctctgatttcaaatcttatgagtaagaagacttaatattccactagttacataatggcagaatggttctgattttgtattcagtgcagtaaagttaaatatgctgttaaaaaatttagtgtccacaaattaccttcaatgcgattaatgtttgttttgaaattacctaccagttatcattgttaaactctgtggtattttttttctttgtgtgtgttttatgagttagcattattttatagaaagatttagggatttattatttatattatttatattactattatttagattattctgacagtcttctgtgtcctcagacaagttagcagagcacagatataatacattagtcagaatttttccatttccgtgttcagattaatcttagaataatttttacctgtctttgttaacaggtattatgcttttaacttcttaactcctagtacatgagtaaaaggtagtaatcatgacatagccaaatgacagagtgcttgtatttgccacaaagcatgtagttccttgtaaatccttgagaaaggtaaattatctctctctctttttttgagatggagtctcgctccgtcgccaggctggagtgcagtggcgtgatcttggctcaccgcaacctccccctcctgggttcaggtgattctcctgcctcagcctcctgagtagctgggagtacaggtgtgcgccaccacacccggctaagttttgtatttttagtagagatgggtttcaccgtgttggccaggatagtctccaactcctgacctcgtgatctgcccaccttggcctcccaaagtgctgggattacaggtgtgagccactgcacccagcagtttctagctgttgttttcatgtccgtattttctttcctgtagatagcacctatcggaatctttaattttgaagttgaaatacataggtatgcttctagcttagggtcattccccggggattattatacttctttaagatctctattctttaagatagagatgtcttctggtttacctctggacattttgtgtgtaaattttatgttcagccaaccaaagggcccaggggttagtagcgttattttgttctctgctttagaggacaagggttcaagttccagatctgccatttgctgttagtgtaaactttagtaaattaactttctgaacctgttttctcaccctgaaaattaggatacattatttatttttctattttcctgcattttgggaggatcaaatgagatctacaaaaaatattttcttaactgccaagtgctatagaaatattggatatcagtgtttttttcatctaccataatgattgttattttcctaatacctgagccttaacaatatattttccatttatactacccttataaattgaagtttttaatttcagattttctataaagataagaaagtcaatttgttttcatgttagctttaatatccattaagccttttgttttctagtcctaaaacaataaaaatggggccttatgccaatcagtactgtccttgattttaaatgatgcgaaaaaaatacaaactcctttaatagagagtcttttaaccagatggataggtgatacataggtattagcatctcacagttgcaaagtatcttctgttgcatttgcataggatatatcaggaaagggtgtgggatgaggagagtagactatttttattattatagggttgggaaggagtagttccatctctgcctgtgatatcaaagggctggatgacactggagaactcatttctcaccttgacctattcatccgtctttaaaataccaaagatgttaagttggtgatctccaaagctctttccagttttagactttgctgcatctgaaatgaatatcaagagagtacaggagaattatacttgaactgaaaataataataaacttggagaagttttctttctgagtcttagagaactataaagatataaaaggtaaataaacacaatcctttcttccttgtctatgtgggtaagtgattagaactaggaactatgaaactaaagtgaaatgtggcttagttttttccttatgcatacttgggaaaataatattttgtcaataaatactttgcatgtaatatgcatatataataatttcttgaattaccttacacataaaatgtcacagccattccctgggcttggtatttttagtctgcatgttgctaaaatcagctataaatttcagtctatcaaggtagtccaatagaacctcaatagttgttatgaggtaagaataactctttgtaccaaaatctatctaggatgttaggatgttgcaagaatagaaaattacaaaccattatacctcgtgaatgagcacatagatacagaaagctttagaaaaacactagaaaacagaactgaatattatttttaaaaaggtaatcataatgcattatgaccaagtaaatcaggaaaaaggcaaggatgtacactcttatgacttttctattcaactttgtaatcaatgccataagacgagaaaaaataaataaaagacataatgattggaaaggaagaagtacaactgcctttgtttacagacactgtaattgtgtatgtacaagatctaatgaaatatacaaaaagattgctaggacaaagagtgaatttagcaagggacaagatacaagggtagtagtaaaaataatttatggtatttctgtatactaacagaaaaactggaaaagtatctatatatcaacagaaaaacaataccatttaaaatagcatcaaaaagcataaaatatgaacaaatttgtttaaagatataaaggagctctatagtgaaatttgtaaaatattgctgagagagattatagaagtcttaagacagaggtataccatgggatgggcccaggaatctttacagccccccaggatgctttgaaacagaagcctggttgaagaatagggtagcatgatttttaattcttcgatagtattttgtacctaaccaattaatcttaatatatccaagtcctctctcccttcgtctctgcctctctctctctctctctctctcacgctctctctctctctctgccctgatcatttgtacttattcttgccatccttactggactgtgagctcttacagggtcaagatcataggatcatgttttctttgtcttcatcttctcagcatccgacagtccctgggcacatagcactgagtgtgctgtctgtataggatcactgcccttttgctggtgttatcttcagatcattctttatgattatcatcaaattattaaaaggtagctttttaggaacttacattttaggtaaaatgtacttttcccctattacattagtctcattgaattttaatcattatttttagttatcttgatccagctttgaagagtaatcatttctgttctttaaatttgtataccactttactatcacaaaactctttcacaaagagtattttttatgctcatcccaacaattccatgtggtaggcaggacagatttgtactgttttggttttaggttgttttgttttctgttttgggttgttttgttttgttttagcattttaagagaaggaaaggctcaggggaggctgagaaaagttaaactcttgctcagagtgtcatagctagtaaataggaaagtgggatctgaacttgtgtctttttatttcaaattcagttttctttactgtaccacaccagtcactaccatcttagctgagacacttgccttttttgggtgaagacagcatgtcatcagcataatgtcagcactctgtaacctttatttcctgcatggccataccctgcttttgggactgagagccggctacgacgtatacctgtaataggaataaagatagaacgttaatttccttgtaggtttcttggttcctttacaactttttaaatttagcttgaatttagttttgttatgaattaattattccattgtttgttcacttgttcatttttaaaaatctattaagcaaatgattattgaacatctcctttgtacatctcaggcttagaataagattgggactgagccatcacattattcacagttagtgagggaaacagataagaaattaattgttataatagttaagacaaaagtacagacttcatcgtgaaatatttggaccaaacgtaagaatcaaacattaatgctgctgacagattgggagtacaatagtgtatatgggaagccaggctggggggctgatgcaggaaatgataaccaaattgttctctgtcctgagccaggttgaaggacacattgaaatagccaggagtgttttgtagcctgttcagtgcaggcctaggttggattatcagaacaatggactgacccttccccaaatttaatttaaaacatttaaatcagattttctacaaagttttctattaaaaattaataaaaaatttaaaataacacaaatatctatatgtagagagagatgattgtgtttaaattcattattaacatctgtaatgaggatgatttatggtcactacaataaatgctttattcagagatgtttttggtcttgttcgtggctgtgtctggcccagaataggtactcaatacatctttattggattttaatacatttaaagggatttaaaaattaaatatagatagatggcaatgattgagtttgccacagaagtgtttttaatatattcatatggttctgacctaagtatcctatttttaaaaattataaactaagcatttttcaaatagacaaagaagctgatgaatatttgtattattacaagttaaatgtggattgttatataattatagaatgttaagaatggaagagctttacaaattatctagtcccaccctaaaattaatgtaaatagttagataatatttttatatgactcaaaaatgtttaaaaagatatacattgaaaaaaatctcactcccatcccatgtctttctactccattccctttccggttctctatagacagtcacttttattagtttcttatgtatctttccaggatttctttatgcaaatgcgagtatatgttctcatttattctcttccttccacagaaggtggcatactatatacactactctgcatctcagtgtttttacttaacaatgcatcttggcaatcttttcataccactacgtagctccctcttcttttttttttttttttcacaatgcctattagtctattatgtgttgtatcatagcttcttaaatcaccctttgtaggggaatgatttatgatagccagtctttggctatcataaacagtgctgcaagtgaataaccttgtaaatgcattgtttcctctgtatgctgatattatttataggaccagttcccagtggtaggattgccaggtcaacggaaatgcatttgtaattttgatggcaaatttcctccatagcagtcccgtcattttataggtgaggaaactgaggcattggtagttaagtcaaccactgggagtggcaaagccaggacatatatccaggaggcatttctagaccaagtctgggtcaggtgcctttcctccatgcccctacactagcctataccttccctggcagagccttcatcataggttttgtaactgttggcttactttcctgtctttcttctacactataagttctctgagtgagggcagggcccatgtctacatgctcaccattgtaggtctaatacctagcacaggggctagtacagagttggtgcttgataaatatttgttgaataaatggagacaagcgaagccttctattcatagtccagtactcattatattccatctcacacctttacactcaacgtaaaaaaacaaacaaacaaaaacataccagccagacaaataaatgtaggatatggagagatatctatttagagctgttcatgtgaaaaagatttggggtatttagggttcttatgaaaagatttggtactcagctgtccaaaaatctcatgtaaaacaaggtttcattaatggaaatgctgtttcaagaacaaaggacgtaataattccgacagctgtctctgaggttttaagtagtataatcctgggtgttgcatcctaagaggcttggaggtgaagaagagaaccaacaatggaaggtgatcaggcttgtgagcaatctgaatttctaccaagtactctctgtagtccaaaatagacattagtggcctctctttatagatgagaaatctgaggaccagggaacttaaatatttctaagagtcaaacattaagtagttgaatttggattcaaatctggattagcttcaaaccatagtctgtcctcttactccctgtactcgttgtctttccctacattgttcacaatgggaaagggactcttaataggtctggccaggctcctgttggttcagggctagattggtttgaatctagtagtcctcacaaccgagtgagcaggatagatggggcctaacaggaaagtcttcagacaaagcaaagtttgaatggctgacatctgtctaaaatgccattgttttaaaaagtgaattgtgcacgagttgtgcaaagcttggaaacctattgtcatacatttagaccctcatttagaaataggaaagttacaacaattttaggtattgttgatcagcaaaaaaaaaaaaaaccatattaagctatggtggagaaaataaaggacagctctctcatcttagcgggagtgaggttgagggaaggtacagaaagaatatgagatgtcctaggctttggtgtgagcatggggttgaagcaaataattaccaaatcctttcacttcgattgtcactaaaccagctctccagtgctcttcataaccatttccatatatctgtggtttacatagttgccattttttcagtagtatagaacattccattatgttaacatgtcatagttttgtcagccattctcatactattagctgtttaaattcttcttcctttcctctcttcttaccctcccccactcccttccttcttcccttcctccctcactccttcattttctcttttattttttaatagggctgctgagaacatcttgcactaatttctttcttcctttggattatttctttgaactaattccccagagtagaattattgggccaaaggataaggagagcttgttacatattttaggttgcattcaggaaagattagaccaacttacaggattcccaacaatatgaaaatgtatctccatgcttaatcaagactctgttttctgtgggttgggataggccaaaaactctgccttggaaaataaaccagtctgttaagtaggatggtcaacctaggaaggtgacagtactggataatggcaaggggttcaagctggcagaaagagagatgggtaattgactgaggacatgaataagagccatggggaaccatagctgtagggaaaccgtgatgcctgccagcaaaggacctggggacaggaaaataaaatgcagattcatttaccagagtatgtagaaagtgagttcttgaccataagtaaccatacaggaccctggaaatataaccagtaccaaaatctaggaccagctggaaggtgggtgggcatgtgggactaggaagcagagctttgtgtactctaaccctggcctaattgcatttttatcatttttatttatttttgctaagttagtagttatataatgataccttaaaatgatctttaattacctttatcaagttgtacattttttccaggttcatctctttggaccactttttcaagtaaatctggttattgactctttttaattatatgcagtggatgataaccttatatcacttacatttgttacattgagctcttctgtgcgctctgtccttttgatattttgtattatatttgctatatttttgagtatagaaattttctttttttatatttgaaaatgtctgtgataatattctacttttttggcagttataaagttctctctcttccacagttggagtgaatatgctattctgttttcttctacatatattttcactctctagcctgcacgtatggtgtgagcttaaggctctaacttactcgttgtcttactgtttactctccagttgctcactagcactttcccctctgtaatcggattgcttctggcttgtcgtgtccaccctttcatctttatttctgaattctattttgggttttttctattccaactaataccatatcttcttttaaaataattcttcttttgtaacattttaaaatttcgtagtttgaaaccactatcataactttggtgtttttcctttggcattttgcctacttttccaacacatgttttagtaccaatatcaagttctgtaaaatcagtgttttattaaatctacataataatttagggaatgttgtcatctttactatatttagttttcccagcatggagcaaataatatttcttcatttatctgtctgtctttaattctgctgtcagactttatgtcatctttgaataagtctctaattttctgatttaaattaatacccatttattgaatttttgtcagaattataaatggggtcttttctactgtgttttctggctacggcccatagtatataggcttgtagtagttttagatggatttttatcctgcaactttgctgaagccatttagctaacactagttattttaagttgattttattgagttctgtaatcatataactttataacttgatgatatagagctatgacatatatcaaatgtattttttcctttttccccatgtttatatttttaattcttgttcctctccaatatctaattgcctattcagtcaagtagctacccttgcttccctatgaactaggaaataaaggaatcagcttactccatgaaagtcgcagccagcacataaatggattaaggtgtaaacgtgatattctctttgggagatgaaatggatcccaagtgagcaatattggacttgttggaatgtgttcacatatgtgaagaaagaatgtatcaaaccaaagctagggaaagaataagaaaaaataatgttagagaatttggcagtaactattccagcattatccaaaataaaggatggtttcgccagtgaattttgaataatgtgaaagtggaggtaaatgcagaaggatgaatgtagatcacagactttaaactgtcttggtattccctttggatatactaacaaggttaggatctcagactctattaaaaggcagttcctctaactccccttgttttgatctcttgttcactcagaaacccacataagcctttctcataggaagataatacactgatcttaggggtttggagtattcattccatccttgtgactgtgatttattattacaaagtaataaattgacttcttacagggaaagaatgcagtaaccatacgaacatagagaattttagtaccaaattaattttgatagtaaactaatgagttagcattctggctgtataatgccaccttcccttgagccatggctgtgcaattggtatgcagacagaattgagtttctgtgcccagaaggccaaactctgtccaccaagaacataaactgcacaccccgaggcctcttggggagaacctgacaacctggttgtagtgtgtttgctttgccaaagggctcagaatgggtgttgcagttttctataagcacttgttgcattaacgatatgatttctatactgtccctctttgcgtgatgaattatattgttttccttgtgtctagttatgcagtacaagaacaaaactctgcttgttcataggaaaattattttaatgtgatctttttttctatttactagggtttttatttagttattatagccatactcataaaaaatcattgtgcatatcttgtctgtttttggaaaataagactatatttgccttatgaggtagattgaaaagcataacattcttacctatttttggaaagttccaaaacattctccaacaaactcattggctataggcatctttgaaaacagtaatcctaataacatttcactctgttgttgtaagttgtccattcaggtttgctatttcccgatacctctcttttatcctcttgtggtcttgaatttttatctatttacatttaactaccaaatttactagcatataatcaggatttataatgccctaattaaaaaaaaatttctaacgtatagtcttgatttaatgtgaatttttctgtcttttgtgttgctgcatgtacttagcttatttttacttttgctcttcattttgttttttgtcttttctaattttggtttgatattgattattttctctttttctaaattattttagatagatttttaattgttttgattttttctttaagaggcctgagttttcttaagatggctgccttggccaggcacagtggctcacacctgtagtcccagcactttgggaggctgggggcgggtggggatgccaatcacttgaggtcaggagttcgagaccagcctggccaacatggtaaaaccccatctctatcaaaaacataaaaaattaaccgggtgtggtggcgcgtgcctgtaatcccagctccttgggaggctgaagcaggagaatcgcttgaacctgggaggtggaggttgcagtgagacgagaccgtgccactgcactccagcctgggtgacagagcgagagactctgtctccaaaaaaaaaaaaaaaaaaaagatggctgcctgacttttaaaagtcacctagttgaaaaactatgcttttgtgtatatgtgtatgcccgttcctgccgttgtgagcagattcttttgtgtatcgccttctaatctccaaactcaataaatgatttcagtacatgtaactattcaaataataatatcaggaagcacaaacaagagacactggaaaggagaccatgactagaagagagaagttgctacttgttgagattttgtgcctgcagaagcataacgactagaaagctcgatgccaaatgaaggggcaagtgtgggctgttggtccatgaggcgtaacactgaattcaaagtcaagggcatgtatgtgggcctggccaggagcgagtaggttctaagggggcagctgttgtggaggtactcattcatcatggtcaggaggaagaaattggttttgtacagacaggcaaggatttgacaacagagtttacatacagagaaggcaacagataggtatcatttccagggaagcaggcaaagcccagtgtccacagatagcagggaacaggtgggtcagatagtcccaagatgatctgggataacagtgccaataatggtggctactattactgatacagcagttttataacttctcattttatagttgaggaaatagactcatccaggttttaaataacttatccagccaggttgacatagccagtaagcgatgaagctatgattctcactagtctgtctaactccaaagtctgtgatctttctactctaccatattgcctgatatctagcatgcatggactcattcacacatgattcaaacagctgacacaacagggttatggctgccgaacctatgacagagtttgtctttttttagatctggttttaccatatttggtgtgtgttaacaagaatgggcaggtatatgttggcatgtgaagtgagacacagggcctcccaaattcttgtcactgagatgatgataattttaatgctcctctgcctagttctctgcacccatgtaagttatggagcagagtgagggctgagatagagtctgtctttccaagctgtgaattacagggcctcacctgtggttgtcctatccccagtccatgtggggaacctgcagacctcctaacatgccccatatagtaagccatacagttgtgttgatttttatctcaccctcttagaatttctactgtttgtgcatgttttatgatgttcataatgtattagtacataggttcatctatatagcttataaataaatacatataaacatattgataggaagctcacacatttttttattgctctaaggcaatagaccccaaacctggatgggcagttcaatccccttgtaagttaaaaaatcatatttccttgacttacccacacttactgaatcataatccccagggcagggttcaggaatgtgtgttttttaacaaatgctagaacttgaaccactgcagtagctctctgtagttgctagaaaaaaatcttggtatcaattgttgtaaataaaccattggaaacaagataactcctatagtgttttgaaggctatttatgaattggctgacttgtttattcgtcatcccctgctgaaaggtaggctctaagaggagggccattatctagcttgttcaccagttgttcctagaatagtgcctgacacgtagaagtgcacagtgaatattttttgaataaataaatgaataatgaaacgctttttcactgtgcttgggtaatacatgtccctttttccctcaataccagagaaagaattggtttcagctgtgccgttgtaaatttgaatgatctgataaaaatccttggttactccactgaaccgactgcaatttttttaatgtctaaaacatacttattctcatattttgttacattttaataccatttaagagtagtagaatttggaaggtgacatagagatccacttttatttcattttcatttcaagcccctgtgtctttaaggaaagggctaagctacaacttggtcattctccagatccaagaggaaatggattggagcagttgtgcctttgtagagcagatgttttggttggaaaggctatcagccatctgactcataataaattctcaattccagtaaattcccagttttcagttacagtaggtaggatgcaggaaaacagtgtcttccactttggggtctttgaacttatttcacatgttaccactgttccttgtgcattacaatgtgcgaacagacaaaatactaggggaggttagagcaattccaggaatagactcagtcagttggtgtttttgagagagaccattggaggtaaaccaaagccactgccctctctgacacagtactaaccacaagaaacataactgcattgagttttcttataagttcctatgttaaaataatgattttatataggaatcatgtaataaaataatgattttacaaactgaattatgtcagtttgagtaatctataaacggcctatagttttttgttttgttttatgaggagggtttcctttatccttttcataaaatgctgaaagtaattatatggtcctgatgtgatatctttcattttagagtatttgttttttgggaaaatttactcaatacttgaacttattgagtaaaaaaaaaaaaaaatttactcagtaagcttctcaaagttctagtaaggccttatagccagtgttccagatggatgaagcagaattatgaaagtgatattcaacgtgtcctactttgtattgtgagctgagttgagagaattcattatttacttagtatttttgttttgttttgttttgttttgttttttagacaggttcttgatcctggctcaggctggagtacagtggtgtgatcacatatcactagagccacaatctcctgggttcaattgatcctgccatcttagcctagtagctgacactatagacacatgccaccatgctcggctaatttttgtattttttgtggagatggggttttgccatgttgcccaggctggcctcgaactccagggttcaatccatcctcccatctcagcctcccaaagtgttgggatgacaggcgtgagccactgcacctggcataaagtggtgtcttattatccccactctgtttttatcgaggagtcagtttcttttcaaccatcactgaagtgggaagaatagtgtactcctcacagagatgaaaaggtcccattgtttctccagagagcaacagtcccatttctgctctttatgagagcttcttaggtgatctcttctaccaagtgagacattagaaatttgggagtcagcagtttagttgtccagaactcctaatagttcctaggttggcctttggcttttcttatccaacatcaaattattcacagatcgtactgtttatctttatactcctcctatgtcattttttctttccagttttagctaagtggttatcataaactcaataaactcatttttttaacccttatattctgaggcacatttgtaaatctttagaattgctaattaattcaagatggattaaagacttaaatgttagacctaaaaccataaaaaccctggaagaaaacctaggcaataccattcaggacataggcatgggcaaggacttcatgactaaaacaccaaaagcaatggcaacaaaagccaaaattgacaaatgggatctaattaaactgaagagcttctgcacagcaaaagaaactaccatcagagtgaacaggcaacctacagaatgggagaaaatttttgcaatctactcttttgacaaagggctaatatccagaatctacaaagaactcaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgtaaatcaaaaccacaatgagataccatctcacgccagttagaatggtgatcattaaaaagtcaggaaacaacaggtgctggagaggatgtggagaaataggaacacttttacactgttggtgggactgtaaactagttcaaccattgtggaagacagtgtggcgattccttagggatctagaactagaaataccatttgacccagccatcccattactgggtatatacccaaaggattataaatcatgctgctataaagacacatgcacacgtatgtttattgtggcactattcacaatagcaaagacttggaaccaacccaaatgtccatcaatgatagactggattaagaaaatttggcacttatacaccatggaatactgtgcagccataaaaaatgatgagttcatgtcctttgtagggacatggatgaagctggaaaccgtccttctcagcaaactatcacaaggacaaaaaaccaaacactgcatgttctcactcataggtgggaattgaacaatgagaacacttggacacaggaaggggaacatcacacatcggggcctgttgtggggtggggggatgggggagggatagcattaggggatatacctaatgtaaatgacgagttaatgggtgcagcacaccaacatggcacatgtatacatatgtaacaaacctgcacattgtgcgcatgtaccctagaacttaaagtataataaaacataataataataaagtaaattcagtttgtgatgtcaaaaaaaaaagtattgctttagcatctcttcaatgaggaaaaaggtagattaaataatgtccctggacttacccactgatgaaaactagtatgtgagagagtcctagtaagagggaagaggcagaagatactgactgtggtatgaagaagagaaggcagaaatacttctctgagaacttgcctcattcatctttgtctctcccacaatgaagagcgtggtgccatggacctagggagctactggattgcagtgggaaaagcacaggccatgagttgaaaaacttaagttttttttctagtgctctgtttactagaggaagatcctgaacattttgcttaatctccttgagaaaagttcaaatcttcaaaatagaaataataacagtatttatcttcaagcgttgttggcgatgtatgttaaggtacgatgcatagcacccagacagaaataagccttattaagcaatttcagtaagaagcattgctgacttaggtttgactactttgggcctcaaatcttgactccaggatccagtggagattattccaggtagacttctttgaccaagcatggtgagattctttaatttgggaaaaatagttatatttgggggaattatacataatttatcatgcaacttagtataaatatgtaccataaaacttgaaagcatgtgcaatgggtttctaatttaaaattccagctcctgtctttttttttttttggtcctcttttaattctttcctttaaaagaaaatttcaaacgatctcaaatttataatagaaatgtaagaacaataaaagcacttttaaaaaaccatttgagactaagttgctggtgtgatggccttcacctccaaatactttagtatgtatttcttagaaataaaggcattctcttacatattaataattgcaatatggtaaaaaaaaaatcaggaaattaacatggcatactactaccatccaattctaagatcccattcaaatttcacttatattgtcccaatgatttctttgtagcagaagaattcagtttagttttaaatcatttatcatcattgttattttttgtaagagatgaggtgttgctgtagcccaggctggtcttgaactcctgagctcaagcgctcctcccacctcagcctcccctggcatgacctaccatgcctggttcagaattcagtttagaatcatgtgtgattttagttgtttcactagtgtgtaatagttcctcagtttgtccttgacatttacaacatttttgaagattataggccagttatgttatataatttctctcaatttggatttgtctgatgttcactcatgattagatccatttatgcatctgtggcaggaatatcacagaggtgatgttatatattttcatgccttctctcaagtggcagaggatatctgtttgactcattactgttgatgtgttcacactgatcactttaaaggcagtgtctgttggggtttccactgtaaagttacttttttcccctttgtcattggtattttgggaaggtcctttgaaaccacccaaatatcctattttttatcaagctttcaatttatttagcatggactcattaatttctagttcatttaatggattatagtcagttactgtcattattttgatgctcaatattacttctgtatatctacccaaatatgttaaacaaccattttcatactgatacctccaattccaattcaacacactgggttcattctgtttttctctttatgcatatttgtaacttccttctctgaaagtgataaatctagttcacattatccttaatatgttactgtaacataatatataggttacacacatatatattatatccatccccctttatgtaaccaacttgctactgttgctcctgccccctcccttgggtgtgcactcccttcactctgcctgggctctgacaccctgcaccaagttgcttctctatgtgaacatctttcttcctctcctctggaccactctagagctccctcttccaccatgcattcaacccttgtccttcttgaatccagccttccaaagctcgtagaatactgtaaaacagtctgattatgtcattactcactttgtaatccctttccacattgcccttaaaataaaacaagttccttaactaaaatgcattaaggctgtttacgctctggcccttaaatgtgttcagctttgtctttcacccttctcaccagtatccagtatttcatccttcctgaacagtcccttgaatgtaccatgtgcccttctacttcagtgactttccgtgtgctgtcatctcttccatccacccccttatcctttttactcccttggatcatttggattccttccaactaggaccattacctcttccttgaaaagcctcatgtgatgcccagtcgtgccctctcttgcatccttcctttgtccggctgcaggtgcacatctctcttatcatatgcctttattgtaacaatttcagcctaatgaatagtttagttgtttatttttcccactagactgtgaagattttgagggcgtagatccttagtgcctttaggtgttgcccaacacatagtggggcattaatacatgtttgttgaatgaattctgtattaatgaatcctgaggctggccccaaacttatactcagtatagcaggaaaatggaattgaagacaggagaaaagaaaaagaatcagcaacatccattgcccatgctgcataggcagtagtgggtccagccttggtttatctgaggggaaagtccagtttattttattggagcattaggaggattattttgctgttccgttttttttttaaacatagttttgtttgtttttatgtttgtttattttttaacatagtttgtgaagcctgctttgtactgttttacaggttttcacatatatatatatggcaacatttgatttagcagtagacccaagaaacctagcttaaaggcccaacctagtctgctatcttaattgcattctttcttgcctatttagtataaaattttttgagaacttgtctcattcaagttgaatcattccaatgtgaactagaaatgttaagctgttaatagcttccctggagaattgcaacttgctaggatgcttcaatactttcatcatcatttatgcatcgtgaaatgtcacaatttctgttcataagcacgaaactataaatgttcatcaattggtctatcttaaacctgttattagtttagaaattaaagaaatattcttactaacccaagccagtgataaagtctgactgaatttatggttcttctaaatctgttcatcagcacttctataattagtaaagttctaacaaagccacctactcaatagttatgctaagtccaacatttatagtttttcatttagggagctattaatataatatgttcttccttttatgaatatttctattcttcataactcagtgtagagacacttttgatctctcttcctctttgggatcttgcatttccttttttattcacacagacctcatttagtaagtgacaaagaattttcaaagcaaatttggatatagcagaatgatgtcgtgaaaaaaaaacattgatgcaggaatcagcagtcatgggttttggtttcatctctgtatctaattagctctacatattggacagataacttccgttatctcagttctggaagttatctcagtttctcccttcgtaaatttgtgaaattttggtgttgaaatcaagagttacaaactttactttttaatatactagaaatatttttacaaatgaatctttctcctgcaatgattatataaaacagaatagtagccactacagctgaccaggggaggaagggctgacatggggaccaagggcttacacagggaccatttggtttcccctttgctgctctaaagacacatactcttttttttttttttttttttttgagacagagtctcactctgtcgcccaggctggagtgcagtgatgtgatcttggctcaccgcaagctccacctcctgggttcatgccattctcctgcctcagcttcccaagtagctgggactacaggcgcccgccaccatgcccggctaattttttgtatttttagtagagacagggtttcaccttgttagccaggatggtcttgatctcttgacctcgtgatctgcccaccttggcctcccaaagtgctgggattacaggtgtgagccaccgcaccctgccaagacacatactcttaaggtacatttgatccctacttctcacaacataggctgtcaaccgctgaatcagatgtctaaggtcctttttacctttaacattttctgattttctttactcctgatccctggttataccattataccaatggcacagcttcactgatatcactgacccaaaggggatagtctcgcccatgccagctctctccacctgacgcctttctctggctcatccggggtatatggacgtgaccagtatgaaaagtatttgagaagtaccttgttgtacttttcagtttctactatgattcttcctcccttttatccaagtttttggaatatgccataggtgcttattctcttttctttattttttttattgtggtaaaatatatataacataaaaaccatcttaaccattttttagttacagttcagtgatattaggtacattgataataatgttgtgcgaccatcatgacatccgtttctgtaactttctcactttctcattttataaaactaaaactctaaacctgttaaagaaatcatccccctggaaaccaccattccactttctgtcactgcgattttgactactctcaaacttcagataagtggaattgtgcagtactgtttgtcttttttgtgactggctaatttagttagtataatgtcctcgaggttcatccacgttgtaggatgtcagaattttctttttttgtaaggctggataatattccatatatgtgtacatatataccatgttttgcttttccattcatctgttgatggacacttgggttgcttctactttttagctaatgtgaataatgctattataaacacaggtgtggctgggtgtggtggcagatgcctgtaatcccagcactttgggaggccaaggtgggcagattacctgaggtcaggagttcgagactagcctggccaacaaggcgaaaccccatctctactaaaaatgcaaaaattagccaggcatggtggcaggtgcctgtaatcccagctactcgagaggctgaggcaggagaatcacttgaacccgggaagtggaggttgcagtgagccgagattgcgccattgcactccagcctgggtgacagagcgagactccatctcaaaaaaaaataaataaataaaataaaataaaataaaaaaacacaggtgtgcagatagctctttaggatcctgttttcagttattttggagtatctattcagaagtggtattgctggatagtatggtgattccgtttttaactttttgagaaactgccgtactgttttccatagcagcgatcccattttacactacccccaacagtgcacaagtgctccagtttcttgacattctcgccaacacttgctattattttggatagtagccatcctaatggatttgaggtgatatcttattgtagttttgatttatgttgaacatcttttcatatgcttattggctgtttcttttttttttttttttgagatggaatctcgctttgtcacccaggctggagtgcagtggggcaatctcggctcactgcaacctccgcctcctgggttcaagcagttctcctgcctcagcctcccaagtatctgggattacaggcctgcaccaccacgcctggctatttttttttttttttgtattttttttttagtagagatggggtttcaccattttggccaggctggtctcgaacccctgaccttgcaatccacccaccttggcctcccaaaattctgggattacaggtatgagccatcacacccagccggctgtttctatatcttctttggagaaatgtctattcaagttctttgcccgtttttgaattgaggttgtttggtttttttgttactgagtttagtaattctctgtatattctggatattaatcccttatcagatatataatttgacaatattttctcccatttcatagtttgccttattggtatttgtctttttatgcaaatagttttaaaattttcatgaagtacaatttgtctacttttttatcacttgtatacttattcttaaatcctaaactttgtgtaaaatatcttccactctcctagaccagtgaaacatcatagttcatctgtgttctcctgtttaatcataggataatacttcagtgtgttgcttttcagttctttttttcatctttggacccgttttctttttcttaattgtcagtcctctaagccagtgcttcttaaacttcagtgcacatacaaataacctaggaatttgttaaaatatcccccaggtgtagctgatgctgttgctttgggtagcaaggctctaaatgaagtcatccgctcatccaggcttcagctgcctactgttcacaagttcatgctacaccctcatttgggtgctgatactggtcctcctgtctctacacattttgagctagatgttctgaaaaccggaagaggtagaatgatgtccactgaaaaacatccatagcttactatttagcattatgcagtctgggaaagccagagcctctttcctcaccttttaccacttctagaagatgttcatactttttcttgagatacccattactctttctttctttctttctttctttctttctttctttctttctttctttctttctttctttctttacctccctccctccctccctccctccctccctccctccctccctccctcccttccttccttccttccttccttccttcctttaagttctgggattcatgtgcagaatgtgcaggtttgttacataggtatacatgtgccatgctggtttgctgtacccaccaacctgtcatctacattaggtatttctcctaatgctatccctcccctagccccctaccccctgacaggccctggtgtgtgatgttccccttcttgtgtccatgtgttctcattcttcaactcccacttatgagtgagaacatgcggtgtttggttttctgttcttgtgttagtttgctgagaatggtggtttccagcatcatccatgtccctgcaaaggacatgaactcatccttttttatgactggatagtattctatgatgtatatatgccatattttctttttccaggctatcattgatgggcatttgggttggctccaagtctttgctattgtgaatagtgctgcaataaacatatgtgtgcatgtgtctttatagtaaaatgatttataatcctttgggtatatacccagtaatgggattgctgggtcaaatggtatttctagttctagatccttgaggaatcgccacactgtcttccacaatggttgaactaatttacactctcaacagtgtaaaagtgttcgtatttctccacatccttgccagcatctgttgtttcctgactttttaatgattgccattctaactggcatgagatggtatctcattgtggctttgatttgcatttctctaatgaccggtgatgatgagcttttttcatgtttgttggccacataaatgtcttcttttgaaaagtgtctgttcatatcctttgcccactttttgatggggttgtttgttattttcttgtaaatttgtttgagttccttgtagattctggatattagctctttgtcagatggatagattgcaaaaattttctcccattctgtaggttgcctgttcactctgatgatagtttcttttgctgtgcagaagctctttagtttaattagatcccatttgtcaaatttgtcttttgttgccattgcttttggcgttttagtcatgaagtctttgcccatgcctgtgtcctgatggattaaatctttaatccatcttgagttgatttttgtataaggtgtaaggaagggttcaatttcagttttctgcataaggatagccagttttcccaacgctatgcaatagggaatcttttccccattgcttgtttttgtcaggtttgtcaaagatcagatgattgtagatgtgtggtgttatttctgaggtctctgttctgttccattggtctgtatatctattttggtaccagtaccatgctgttttggttgctgtagcctggtagtgtagtttgaagtcaggtagcgtgatgcctccagctctgttctttttgcttagaattgtcttggctctatgggctcttttttggttccatatgaaatttaaggtagttttttctaattctgtgaagaaagtcaattgtagcttgatgggaatagcattgaatctatgaattactttgggcagtagggccatttttacgatattgattcttcctatctatgagcatggaatgtttttccatttgtttgtgtcctctcttattttcttgagcaatggtttgtagttcttgaagagatccttcacatcccttgtaagttgtattcctaggtattttattctctttgtagcagttgtgaatgggagtacactcatgatttggctccctgtttgcttatgattggtgtgtataggaatgcttgtgatttttgcatgcaataaactggatattgatggaatgtatctcaaaataataagagctatttatgataaacacaaagccaatatcacactgaatgggcaaaagctggcagcattccctttgaaaactagcacaagacaaggatgtactctctcaccacttctgttcaacataatattggaagttctggccagggcaatcaggcaagagaaagaaataaagagtattcaaacaggaagagaggaagtcaaattacctctgtttgcagatgacatgattggatatttagaaaacccatcgtctcagccccaaaactccttaagctgataagcgactctagcaaagtctcagcatactctcttgctttctttatctcttttcttttaaaagcataatgtcagaaaagagtctaacgaattcattctcggtatatagaaacaactgaggagttcttcatcctttcctcatagggctcttgataattaatcacgtattaccttgtaggatctcctattgaagaagaaggaagaaacttctctcattttcatgtgtttatattgacctctttgaggagtgggactgattcttacaatccttctgtttttctttattatgcttgtcacaatgccttacacgtggttggcaaatcatgagtgttgactcagtgaacaccatataatgtgttgtttagaagtttattggctctagttttaggagatccgattatggttagacatggcaaaaagattgctcttgtttttctgcactctagggtttgatcattcagttaagtgtacagatccaaattttcctcctattccaaggcatgatctaaacctggggagaaatggcctattctgcccaaacttataccaactgatttacattggaaagtcaagttaataatttcaatagatttctgttgtgtctactaaggaagtctgcttttgaaacccagttttgaaacagtaatttactggcaaatatatgtagtcattcatatacacattcatacatttgtttttcagatatttattgggtgcctgtttttgtggtaagcaccatactggacaccaaatacaaaatatgaaacaaatacaaaatgaatatattaattcattttgtatacaaaaatgaatgaaacagtcattgctcttaaggaacccaatcagataaatgataacacatatgtaaataactttaaaacacacacacacacacacacacacacacacacacacacacacaaaccaatcaaatactatcatatttgggtgaacctaaaaacctgtaggattttagaggagagaccattacatgagctggtaggataaaggaagtctcatgagaggatatgacttctaaattgaacttaaaagagtaggttcactataatccctgcactttgggaggccaaggcgggcggatcacgaggtcaggagatcgagaccatcctggctaacacgatgaaaccctgtctctactaaaaatacaaaaaattatccaggcgtggtggcgggcgcctgtagtcccagctactcgggaggcggaggcaggagaatggcatgaacctgggaggcagagcttgcagtgagccaagatcgtgccactgcactccagcctggtggacagagcaagaatcgtctcaaaaaataaataaataaaaataaataaatagataaataaaaaaaagagtaggtccaatttggagatttggggttgggggatgtagaccggggagaaggcgtccaggattgagtggcagagcagagacctgatggagtgatgacatggagtgtgggaacctgcagtagttaggatgtatcagcagggtggtagaaaaatgaaattgggaggccgggcatggtggctcatgcctgtaatcccagcactttgggatgccgaggtgggtggatcacctgaggtcgggagttcgagaccagcctgaccaacacgaagaaaccacctctctactaaaaatacaaaaattagctgggcatggtggtgtatgcctgtaaacccagctactcgggaggctgaggcaggagaatcgcttgaacctgggaggcggaggttgcagtgagccaagatcacaccattgcactccagcctgggcaacgagagcgaaactccgtctcaaaaaaaaaaaaagaaattgggaagacaccttggaggagcttaaatgtcaggctaatgtagatggaggagggcttttgaggctgggagaaatatatggtatttacactggttctcagagctcattttctgtacagggccttcccatagacagttccagagggatatggctccaggcctctctttttcaactctaagctgccctttaggttctacagataacaatatgcaaatcaaaagacctctgatcacgtcaaggggagactctctagtgggctccattctctaacgcttgtggtttgtgatggtctccagttaatgagcatgtgctgccaggtatctgaaataacttggaaataaccaattgcttagttgccatgggcacagacagtctgagccaagtgacctgctggctgggtgggtaggaacaaaggtgttattagcttctagggtggctttcccttctgtcttcactcacagagccacctgggaagaatcgctaaactccagaattcacagcaacctggagaggagaggacagggtgtagctttaatagcaggaagaatagcatggttttgaaaaggatatcagaccaagagtctgaaagaaataaggcaagtgaaactaacttattgagcaccttcctcatgcctggatcttgctgggcacttccacgtacatttgcaaaagctgtgtaaacctttttgcttctccaaatacccacatttagcatgtcatatggaaaaaaaatgaaagcatgtgatctctttgacaaaaattttgtctatagctagaagatcatcatattcgtgtagttgttgcatgataaactggcaaaacatttcatgtattcaaatggcatactcctatggattttctgcctttagcattggcacctctgataccttttccttcattgattgaagaggagcagtgagtgcaaggtgttctaaggcccaggatgtgttactgtgctgttttaagtccaccaagatgagaggcagcaagtccagagaactagcctagctatagccagagcctggtactgcaggcagattgctctagcaaagctttcctctggcaggtaaggaggcatgcagcttatctgtgtcctcagagccctttgaggttctgatgaaggcccagcattccacactgtgtagtaagtattcaaataacccagagatgaaagccctttttagcacttaattctgtagagtttgatttaccgtggtgtcatctgtgttcgtttaataatttaccagagaaaatgttggttataagtgaaggaaaaccacttcaaaccagcttaggcatatagtgcaatttattagctttccaaagctaggagcagattgaatagtcaaaccacagtaagagcagggacacagctgcaccaagacccacaggaactaagggtgtggatgctgcctggactctctcctctcttgcctgcacttctcccagcaggttggctttattctctcccaccacagcctggtctcttctatatatgggaaatatggcagctcaccatttcttctgcatctgcagagactggcctacatttagtcacaaatcttgaagaaaggaccagccttttcctagacccatcagctgttcccaggtattaggacaggaagctctttgaggggctttacggattggggcctgggggtggggtctagaagagagagaagcttcctgagagaggagagggtatcaggcaagcaatatcacatatgtccactatatcaactgcaactttaaatcttcctatccattaaaagagccacctaaacgatttaagtgaatacatcttctaccttttctttaagttatggagacgtattaaggatgtggtaaatggtattcatgtctgtttcatatgtgcttaaataaaaactcactattgtttaaacttgttgggctcttggattaaagtctggcacaaggtttttatcagcaggaatgcataacatcacaactcagagaaactcaaagatgtagttcaatatgattcgtaaaacagttgcaaaaattgtaaatagtgctgcagtaaacctatgtatgcatgtgtctttatagtagaatgatttatattcctttgggtatatacccagtaatgggattgctgggtcaaatggtatctctggttccagatccttgaggaattgccatgctgtctcccacaatggttgaactaatttacattcccatcaacagtgtaaagcgttcctgtttctccacaacctcgccagcatctgttgtttcctgacttcttaataattgccattctgactggcatgagatggtatctcactgtggttttgatttgcatttctctgatgaccagtgatgttgagctctttttcatatgtttgttggccaaacaaatgccttcttttgagaagtgtctgttcatatcctttgcccactttttgatagggttgtttgttttttttcttgtaaatatgtttaagttccttgtaaactctggatattagccctttgtcagataggtagatttcaaaaattttctcccattctgtaggttgcctgttcactccaacgatactttcttttgctgtgtagaagctctttagtttaattaaatcccatttgtcaattttcaattttggcttttgttgcaattgcttttggcatttttgtcatgaagcttttgcccatatgtcctgaatggtattgtctaggttttcttctagggtttttatggttttgggttttacatttaagttgttaatccatcttgagttaatttttgtataaggtgtaaggaaggggtccagtttcagttttgtgcatatggctagcctgttttcccagcaacatactgaataggagatcctttccccattacatgtttttgtcaggtttgtcgaagatcagatggttgtagatgtgtggtgttatttctgaggtgtctattctgctccattggtctgtatgtctgttttggtaccagtactatgctgttttggttactgtagccttgtagtataggttggagtcacgtagcatgatgcctccagctttgttctttttgcttaggattgtcttggcaaaaattgatactttaagtaagcccagaggaagcttatcaaatgtattaagagcacacttagggcagtaggggaaactccacactccagattctttctctaaaaacttttatgagtagagaagttggcagaagccaggaagcatcatttgcttccagtgaggaccctggctatactacaaaggattcccctcacccaacctctctggcctccagagtaggggctccatttcacacaccttttagattaatgtgtgactattcaaaagctggtgattctcaaggctgtgtctgttgggtataataactgattggacagtatttggccaacaaaatcttgatcatcattattttcaaagagccaggattttcctccctaaagtttgtttgtatgacatgtgtttcaatttagttttataaacagtagctataaccaatatattaaggataagtacagcttcacaaacatattcctgcataaataagagcagtcaaatcatctttgtttatgaaaataataagcaagatagaattaaaaaaaaacttaccctattctgtattgtgacatctagtagtaatgagctcaaaatgtcgcttttggaagacatgggcaggtggcagcagctctgtcctggtgtcctgggctcaccctgtaggaagtagctatttcaagaacattgcagttatcctttcctgacctgacaatcagtgcttcttattttcactgaatatagttagttaatcatagaatggccctaactgtacattattacaggaaggttgatattaccaccttagaatgccatggtcctcattgatgtcctcagagaagccattctccttccttaattaactgagtccatgtaaagatgtcaggtgaatacatttaatttggcacagtgacttctatagcctttagtctttacacatttgttaattttaatttcttgccctgtactttctaaaagtagacattaaaacacataaagcatatacttttaacctattttgaatatctactgtgtgcctggcgcagacaatatcatttattcttggataataagggaagaagaaatggttccttaagttgctcatgatctttgggccatacagtatttagaaactaaatgtagaacaagtaaatatacagtaaatctttcctgcatgtgagtttccaagttttttgtacatttctttgagcactggtgctgagtctcttctttgtgcccaatagcatcctagaggatatagtatcatgattaagaggctagggtctgagtcagcatacatgggttcaaaactcgtcttcaccatttaatctctctgagcctcagtttcttcatctgcaagtgagaataattagttcctaccttacacagttgttacgaagattagagataatgcatatacagctggaagctagtgactattgagtaaacacggaataaatgttagctgatattactgggcctagtaggaagaaggagatctctaccctgccctcaagaaattcacaatctatttggaatataaaatatatattgctgaaacagcatggggaattcatgaagcaacatggggaaaactaccgagggaggacatagatcacattgtaattgaaaggaatcttaatggagcaagtgaatttacaaaaagagttaaacttaaagccacaccaattaagaaaagaaggagagaaagaactttttaagaaggggaatggcaaatgcaaagatgttagtcaagttctgctaatgtataaagagtggcccattttgtctggactaggtggggagaatatttttactcccatttccgtttggaggaaccaaatcagaagtaactactaaatgctgccttcataagggatatcaaaatatcaagataatttttaaccaagaactcagtatatgttggagataggctgtaactaggcttttggaacccccaatccagtgctgcaacatcctccttcatggagtaaagccccgggtttagccacaggggacccgtttattgcccttcctcatctgtttggctcaacttcattcccttacttttggatttgttttgctttctgactatactgctttccctggctcttgtacatttcccagtatgtttatgaagaggaaataacctaattactgaaatgaccagtgtcattatgagacagacctcttagcagtgagaccaaggtgttacttatgtcactttccttgttcttgactatctcttctgcttagattttatttcattcctaccatattcctaccataacacattgtgatgtctttatgccagtagaacccaaattcaaattttgattggggctgtatatgctaatatataacatagcaagtcaagagcactttttatcttcaatctctgtgaagtaatgaaaggccactgctgattctccataaagccaactttgagcacccttttaaactttcatttcctcctcattccttatcttctttctctgctttaatttttctctataacatttgtaacatactatatattttatttattttgttaaatgcttaaatgaatggtagtaccctaagagagtcttattctctcccacttgaaaaaacttgattaaaaaaatctaaatttatataatttgatggatattggagcctctaaaatactaacctcactttgtatattttaaaataggattctgttttgcaaatttgcatatagtttgtcaaaaactcataacttggtcaggcgcagtgactcacgcctgtaatcccagcactttgggaggccgaggtgggtggatcatgaggtcaggagattgagaccatcctggctaacatgatgaaaccccgtccctactaaatatacaaaaaaaattagctggccatggtggcgggcacctgtagtcccagctactcgggaggctgaggcaggagaatggcatgaacctgggaggtggagcttgcagtgagccgagattgcaccactgcactccagcctgggtgacagggtaggcaacaaaactcataacttttgtatgatgaagtacttacctagacctagtttttggttactcgaggaattacacttaattctgagtctagcttaataccattttaaaatggtgcttacttaggtgggtgtacttcatgcttgtagtctcagctacttgggaggctgaggcaggaggatcacttgagcccaggtgtttaaggccagcaaacaaacaaacacagaagcacttacttgattttcgacatactatgtaatagcgcctgtatagccatatatacccactgagtggttttgctagtaacagttataactttattgtaagcctttttgaattgagaaatacaatggcttttttaccgtcctgttacgtgacctgtgatttgcagtatttcttgttcagctaatgtctttcagcaattagttaattggtagtttgtacctatattgacactaatgttctcaacatatagggacttgttaatgactgctatctttacttgggataattagcatatcaaaggagtagagcataatgataaattgtacttggtttactttcatttccaaggctaattgttgttgttttctacacccttttgatatttgcaaagagcctcaattgagaatagttatgtaaatgaaccattatgatctaaccagaagtattttctcttattaataggtgtatccttggcgatacatagttcagacttgagtttttttttaaataaaatcttaagcatagacttaaggaattaaggagataaatactgagaatcttccctattgaaagcattttccacttaattccatcatttatactgtcagtcctgaaacccaaatatttctctgtttagaaaagctagttcagtggcttatttcattcatttactcattcttttagttatctctgcattaattccattttttccatcagttgctctgtatgtactatgttccagacactgggggtgcaaaaatgaacacgaaaatctcccagcctgccaggaactcacctatagtgaatattcattatacactataggaactcctttaatcaagggctgagccagatccactgttacatctcaccagaatatcatggccgttattgctttaccgtacgtgtgtcagtgcctggcagacttttataaaggtgggggacaatagtcttctttagctttatcagattcggtatctttcctcccattttagccttttgcagtttcaaatggtgcagatacagagccctgaaaatgtatacttgtacgtttttaaatgtcccctactatgctgtaaccatcccctgttttccaaatgctgccattagtggttacagtaatcatctgtaatgttagcttctcagaaccatggtacaagagcttcttttctaatttcccagatgggagggaacacatgtacatgcttgttagagttgcagaaactagaaacagcactgtgtggatttgtatttttggaattctatgggcttgtttaagcactcaaattcaaacttagatatccattaggaatcaaataccatttcggggaaatctcatgtgccacaccaacaggaataacacatataaaacgaactcctggaaaaaactagtttcatattcagactcatgttttatgtacttttttcaggatgccagatgataaatgttgattatataaactagagtcattccgtttgtttggaggattgtctctaagcatttccgctctttattgaaatagtagtgaaattgaaagtttaaaagtcagaaagggaagtaattataaattacccataggcatatggaataaagcccccaattataaaggattttggtggcccctggttctttgcagtgtgtttttgcaaggttatgtgatttgtaatcatagcctctagccttgaccttacataagaaaacttagtcattggggaaaggtttctgaaagtaaatgttatttcttttttaattgtctttttgaccaatctaactcacatagggctacttctacacttagatcataaaatgaatttgttcctatgaatgtcttcaagctcagctttaaccttagttttagatgtttgacgagtgttaaagtcatattatacaattgagtagtttctgttcgttgcagaccctgagtgttttttacaattttcattctcattttacagaaaagaaagttcaaggttgaatactctatcatctataaaagagcaagaagtgatcagtaagctcagactcctgacctgggctctccttttaaagtcactagttctggaggacttggtgtattaacaaggccaggagcagggagccagcatttagtttctagacattattggtgacaaaaaaatttgtaaagtaggttcctgaaaaatctctagatgtagagaataaaaattagggaggaacattccctttgttcactaatttattcattcagctaacattgagtggtttccatatgccagatactgtgctaagatcctgctcttacccacttatccccctcctcacccagttagaaacagaacaagaccaaacaaagctatacttcttatatcatgccacctaaaaatatattccagaggtattgcaaatctacaatgtacaaataaaattataacaatataagatgaaaaactagagaagcagttatagaatctcagagttattgaccggatttaactctgcaaaaatctaaattttctgtgatggcagaagagccctcaaatgaagtaaaaagtcaaaaagagaaaataactttagcacatgtgacagaaaaagattaagaaactcaatgaacaacgacaacaaagactaagaaccttaaagcaagatggataatggatttgatcaggaaatttacaaaagaaatgtagatgaccagtaaataagtaaaaagttgctcagcctcattcattgaatctaaatggagataccattttccagattttaaagagtggtaacagccagtgttatccagtgattcaggatgaggggaagcaggcttatacaaactcacaggtccaaatgtgaattgttgcaaatatttttttattttgttatttttattttattttattattattattttttttgagacagagtctcactctgtcagccaggctggagtgcagtggcaccatctcggctcactgcaatctccgcctcccgggttcaagcaattctcctgcctcagcctcccaagtagctgggattacaggcatgtgccaccacgcctggctaatttttgtatttttagtagagatggggtttaccgtgttggccaggctggtcttgaactcctgacctcaggtaatccacccacctcggcctcccaaagtgctgggattacaggtgtgagccaccgcgcccggcctgttgcaaaatttttagaaaataatctgtcaaattcttttgaaatgtaaaatgttcataacctttgacccaagaagctcagttttaattctctatttaaaaatataagttccactactaacaaatgcacacacacaaatgtacatacactgagacaagcatacacacacaaaagaatatttattgcagcactatcaagtggccaagaattgtgaacaacctgaagtttgttgctaaggaaatggtttaataaaaaataaatccatgccatggaatattatgtggctatttaaaaagcagttgatagagcgatatgattcctttagggaaaacaaaacagaaggttaaagagctgtttatatgcaaatgtgtatatgtttttatgagcataaagaaagtagtttgaagctacctacacacacagttaatattggttaccttgaaaagtgggggtgagagaggggtggaagagcttttactttataaatttctgtatggtttgacttgttaagacaagcctaaattttgtaatctaaaatttttttttaattttattttattattattatactttaagttttagggtacatgtgcacaatgtgcaggttagttacatatgtatacatgtgccatgctggtgtgctgcacccattaactcgtcatttagcattacgtatatctcctaatgctatccctcccccctccccccaccccacaacagtccccagagtgtgatgttccccttcctgtgtccatgtgttctcattgttcagttcccacctatgagtgagaacatgcggtgtttggttttttgtccttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctatcgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcgcctgttgtttcctggctttttaatgatgccattctaattggtgtgagatggtatctcactgtggttttgatttgcatttctctgatggccagtgatggtgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgcgaaaattttctctgattttgtaggttgcctgttcactctgatggtagtttcttttgctgtgcagaagctctttagtttaattagatcccatttgtcaattttggcttttgttgccattgcttttggtattttagacatgaagtccttaattttttaaaaaagaaagaaaacggaaagggaagtggccaaagagacaagaaaagaccatcaagaaaagagagtttcgagaggcaagtggtcacccatgtcaaatactgtttagacatcaagtaagaaaagggcagagaagcatttggtgtgtttagtggttacccttagtgggaatggtcttcatgaacttgtggggtcagtagtaggctatcgttgtgggctaagggtaagtggaagagaagggaatagagagtgtgtagatatctcttccaagcagtctgtgaaggggaggagcgagaggagagggaatccaaggagctctgtagagttcaacaagattctttcctttcctttaaaaatgtttcttttttaggatgggagagacttgtggttcttgtccctgtgtatacatgtcacactcatccatcttatacacacaagagaatgcagagcaaggagaccgaaggttccggagttgagcaggatgagtgatggccagcttcccaggatgaaggaaaagaaggggtggcatgacagacaaaagacattgtatttgaggttgaagatacaatgtcaagctcatgagtagtgagtcttttttttttttttttgaggtggagtctcgctctgttgcccaggctggagtgcagtggtgccatctccgctcactgcaagctccgcctcccgggttcatgccattctcctgcctcagcgtcccaagcagctgggactacaggtgcccaccaccacgcccggctaattttgtttttttgtatttttagtagagaccgggtttcaccgtgttagccaggatggtctcgatttcctgacctcgtgatccgcccgcctcagcctcccaaagtgctgggattacaggcatgagccaccgcgcccagccgagtaatgagtcttaaagtctaggtgtgacccttccctctcttgctgctggtgtggctgctgaaccttcctaaggacctatgaactgatccagaaatataggtccgttcttaccagtctctatgagtgaaagatgttaagtgtttaacacatattaagtgtttagtaattaagtgtttaaaatttttatatttgacttggagccactaccaaccaaaaataaattaagggttattaaaatttggtattcacaaattaaaatcaatgtgtgccacgagatttattttaattcagtattttattcagaagtctggcagacacttggtgcttggcaataatcataaagcacatgcacatagttgtaaattccacagttttgattcaggacacttcatcagtgtatcatcagcgttggcttgagttggttataatattcagttcctgctattcttgctttttaattataaattacagtaagtttagttttatcattatcagtttagtttattgtgtgttatttggttaatctcaaatgtttattggtacatacttggatcaacaatgttttgtcttatagtgttcttataactagacttttaagatatgtatgtctcatgattcacatatgaatcatccattatcattttgccaaagtagatgtgtacctaacccccttgtcatttgcttgtatggtgacactcttcatggtgatatgtttcctgcaaatttttgctatttaaatagcttacaacatactgtcaaggtaggtgtaagaaaattactggatattttaatgttttttgatgttgtaggatgtaaattatgtttatagtaatatgtttactgcaacttaattatatttttgctgaattctttgttaccaccaggttcactacccgccccctacctcctgaatgtgggaacaagtgagataggtggaggtctttcgctttgctgtggtgggctttgctcagaaagtttaaaatccatccctctagaggagtgggtaggtgtgtggaaaggatgtgcaaagcagctaagctaaagtggaataagggtaactcacagtcatggcttcaatgccagtggactgtgagcttgacactaataagatgttaggagaacaggtgctgatgttgtgttttcacttcttgtttaaggatgtaaatgaagaccctggagaagatgtggccctcctctctgttagttttgaggacactgaagccacccaggtgtaccccaagctgtacttgtcacctcgaattgagcagtaagtgtcattaacatgaggtagcctggtgctacttcttgctaaccaatatgtctcattctttcttttgccactcttgaactcttacatttatttctcttcattgacttttgttttcttaaaaaattcatcatattaagagtttccattgcagagtaaatgcagttagtacttgccactacacccttttggcaagtgttattgtgcatttagtgacatgaatactgtacctttgtagagagaaaagaataggcagactgagtccaaaattgagactccttccagatgttccctggagttcgaatggttgtagcctacagtgggctgctaaacatctggcccaatttcttacttatttgtaactattaatgttatttgtaaaatgtaactagcctcttcaaaatatttagcaaaaactgactcagaagttagtaaagctaatattaaaagtagatagcttaaaaagataacatgttttattttgctgcatcgaaatagctgcgtataattttacacaacattcaggctacatggcagaagtagtttgatatcgcatttgtgttataaccaagtaacattattcatcagtaatgaattttgtaaggcctgaattcacagtgtgcttattgtgggtgaaatgctttagtagcttattctacttcaaaggaagctgaggttcattgaaaatggattataagcagatttggttgggaacttctgacaggacagatttttcatcagcagagagagtttttacagactctgattgaaatgtattattaaaattctctgtgagtcatttagttacagttggctgatttctgtctgtgagtagatgtggtcactatctagcattcttagtaaaaatactgagccatttttaccccttccgaccttagttgctctaatttataaatcatggacacatcatcttaaaaaccaatatgacacagctgtttatactcaaatatgggagcttatgaacatcaataatctataggcattctcttgtctttttatatatctgacacagcacttagaacaggattttacagtagcagacactcaatgaatgtttaatttttgttttgagacagcgtctcactctgtcacccaggctggagtgtagtggcatgcttatggctcactgcagccttgacctcctgggctcaagtgaccctcctacctcagtctcccaagtggctaggactccaggtgccaccatgcatgcctaatgtttttatttttatttttgtagagaccgggtctcgctctattgcccaggctagtctcaaactcctaggctcaagtgattctgctgcctcggcctcccaaagaatgtttctgttttttgttttttgtttgtttgtttgttttgagacagagtctcactctgtcatccaggctggagtgcagtggtgcaatctcggctcactgcaacctccaccttctgggttcaagtgattctcgggtttcagcctcccgagtacctgggactacaggcaccagccaccacgcccagctaattttttgtattttcattagagacagagtttcaccatgttggccaagctggtctcgaactcctgacctcaggtgatctgcccgcttcggcctcccaaagtgctaggattacaggcatgagccacagtgcctggccccaaagagtgttttattattattattattattattattattttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctattattttttaattgaaaatactgacccatattagtaagcgatcagtggataccagaggcagtagaatgacgtggcataaggcaagggctctgagtcaagcagatctagtttaaacctggttcctgccactcaccagctgtcacaaaatgtaacttctctgagcttgtttcctcagtcataaaatagacataataatacctatttcttagtgttgttttcaggattatattaatactgttcataaagcattaatcacagtgcctggcactacagtaaacactcagcaagtaatagccatgaatattattattattgatacagttcataggagaagaacgagtgagtgtttagcagggataagttggggcagaaaaggagaggatgggtaaataagggagcaagtaccagttctagcgtagccactcattgtgtaactaatgagttaaattacaaaggtgctttggtgatgagcaaagagttaatgaaacaatcgcaagatgtgggcaatatgaatatattagttaagctgcaggcaataatttgccagctcagaaaaacatttgttccagcagctaggttgtttttcttggaagttactacacctaatttgcaaataaacttgctaatgaaatagtctcactctaaaaatctaacgtgtgggaaatgattagggaagggtatattttaaaagtcatttttccaatctccaaagtccagctctctcatgtccttcctcccttttttttctttcttcttcttcttttttttttttttgagacggaatctcgttccgtcccccaggctggagtgcagtggcaccatctccgctcactgcaagctccgcctcccgggttcacgccattctcctgcctcagcctcccgagtagctgggactacaggcgcccgccaccacgcccggctaattttttgtatttttagtagagacggggtttcaccatgttagccaggatggtctcaaactcctgacctcgtgatccacccacctcggcctcccaaagtgctgagattacaggcgtgagccaccacgcctggcctcttcttctttcttacgttaagagctctccacagcatacccttttagatcatttttcggttgcttcccctcatatactgtttccttcagccagacctgagcacttgaagttttcttacattgccagcactctcttgcctctgtgcttttgctaaagctgctccttccatgtacaaggcccttctctaacccctcttcctgttgaaatactatactttttctaaggccttattcaaataccatctctaccaaccattttccctgaggacaattagtctagccttccccagagctctttgtaacactgaatttatattaatcttataatctatatttatattataatctacccatcatagctttaattggtgataaggatttttaaaaatcttttgctgaattgcaagctacttattgagttgaggaacaagtcttttttttaatgccgtgcataaatgcaatacacagttatcaattgcctaattggcagtcttctaggtgaataagtagttctcaccaaaatattggaaaatgcctcactgaaaggtcttatacttttcctggttgctacaaattcacttggtagaactacgtttataataccaaaacaaactaccaaacattcttatatctttaagtagaagttttcaaaatgaggttttagagaaagattaacataaaagaagtaaacttggggtatgacttctataagggcttagatatttgctaaagttattaatacttgtggttaattcttccagagttcagagcatagaacagacatgccatttcaagaaggctgtagtcatgggataggttttgagaactgactgtgctaagctctcatttattttctgtgttttatactatcttgtcaactttgagctatccaagcattgattatcgattcagacttggagagttctttcaggagtcatgggaaaagcatcccatgtggacccgcccaaagccaacgtcaaactcttgccctagctgaggcttgtactccttttggtttctgctatggctctttctaggaagtcccaagccccatgcagtgcatttgacagggagaggctcaggagagaccaatagccccatccacactgggtaaaaattaccaagagaaggcttgcattcccaccatctcctccatgggcatagagagatatcgtgggcctgggaggaaccccattccagtctgactgttcctctgtcccagcttgtccatgcaggaggcaaagatattatactcacgttaactactcccagcaattggaaaagaaaagggctacttttgggtcttgtcatcatatgtaggaaaaaatattgatttgttgtaccctaaaaagactacaaattagacaatcctgacaaaagagaacatcagtcagattcattggtagaagactctgagatgtgttctaatttgatgaagctctgaaatgtgatcccacttctgaagtctgtttgcccagggtcgtggaatagttgtctggtgtccctggcagccctgccgcacgtggctgcacgcccttacgatgcttagatgcatattgtttaccggtctcccactgcgcatttctatgacttgcagagtaaatgcttctgagaagaactttgtgttcttgcacaagggacatttatgaaataaacatatttctggccctatacatttgtcttccaaggaaccaaaaccaatccgttgaattagacacgagtaagttctgttaattaaaaaaaaaaaaaagtcaatggtgagttatgcaaaaaaaaaaaaaaaaagctagtagtcaatgatgcaaattagattttggttgaatattagaaaaggggaaaaaatagtttctaaaccagttgcttttttttcccctggcagaaaagctgtgagttttaaggttacatcatcagagctggcgtgaaacatgctctacctttccctcttccccagactgttggcagttgttgtagtgaacccaaaggttaaatgggcatgagagtctgcatagcactcttccacgaaaggtgtgggcccttttcttggcttgagccactttgtgggagtggtttaaagacaaccagcttcctcattccctgtgctgttcccactctgtgcataaaaagaggacttcagccctgaggcagaccaggtggcatctttcacaagtacagaatttgtttttagaactttttgttaagttacatctgccttggaaatgagtactcaaaacttcccagcccacgaacgctcactattattgaggcctgtgtacctgcaatatgcatgtttgttctttcaggcaacagaaacccaatgagaatcaaccacatgtgaggccctttgctaggtgcttcagaggctgtcagcataaatgaaatgtggctcatctccttaatttcctcaaagtaagagggatcagaacaaatatggcaagttgtgacttgtggattaatagaaaaggcatattaatacatggcatcagaagccccctgttccttcacttattggctggcaatcttggcttaagttaacgtttttgagcttcatttcatcttctgtgaagaggaataaatctaagtttcagtttcatctactccaagtggggaggtagatgagaaaggccctactgtagtgcttggcccatggttgatgcttagttagtgctccttgagaaaatacttattaagtgctataagagttcaagagagtgggagatcacatttccatttgacttggtggagaaggagctttggaagattatggaaagcctggcttttctagagattaaatatgcaatactgtaacaataacagatatgtatttgttcagtactttaaaatattcaaactgcttttcactttaccatcccatctgatcctcatgatagtatgtctatcatgtgttttataatatagcttttttcttccataacttggagtttttagatccttccttgtctccttcactgctactccttccttttttcaacccattaaattatgctaaattgtgcttcctgtgataacatccctagacacttttgtggcattgcctgtttgtggatgacacccagatccccatttctaatctcagcatttctccctgcttacagatctgcttctctaaccactagatagacatgtctatctgtgtgttcagttgacacctcaaatttaaagggcctgaaactaaactcatcattcccccaataagctaatgtttcttctttacagcctgtttttattcatgacactcttgtcttcttggtgcccaggtggtacatcttaaaggcattgaccatacctcatgcccctattagccagccagttgttttggactaaaaacccactctccacaatgtctctgagtcttgtcatgcctactatcattacctagttcagtcttccagttgccatgggtcctgaggggctcttaacttctagttccttcctatttcagtttatccatgtggaactgtcactgtcctttgaagtaaattccagtcctgtaatgtccttgctgagaagcttcaatgcctctctgttgccaagcgaagtaaatgcacagctctccatctggcattcagattccgtgttacagtcctgttcacttttccaccctaggctggactctacgtgtatcctgttgtccagccaagcagaattttgtgatttcccgaacacatcttgtatttttttcacttccataccttgctcaggctgctccttagaccagaacattgagtttatttacctcccccacagggtccgttaaagtcctgcccatgttcttagatcttctcaatcatcacctcctccatggaacatttcctgaccgccactgcctgcctccacaatggcaccacactttttccctgtgtttatgcctcctttgtcatattgcctccctggactctaaactctttaaggcctgggcctcttttccatcagttgagggctggtgagccacagcccctctggccaggctggccctagccaggcccctgcccaagctcaaccacagtctccattgacaggtctggctggagaggcagaaagctgtgacactatgtgcatgttaaggcggtgggctttcacagtcatttcttattgctgtgccttgtggctagccaggaggatactttcctttatggtcgcctgttcatgtttctgagaggtggagccctgtttcataagagcggtttatcaactgaatcctggaggtggaatatgactttgatcttctgtgacctatgtgacctaatatagtcctgttggcgtctccagcctcccctcccctgcctttaccccacagcgtgcctggcagcaaacatggtctcttggaatatttggatagcctgggatctacaagggctgggataaagtgaaacttggctaaaggacctagggaaagggtgaggggaactgaaaattaaaataatactacttaaaattatgaatgagtaaggatattacattcggataaattggatcaaatacgttttttaaaagcaataagcaagttaaatatattggtatatgtgattttatttaccaccaaatttgatatcttaacagaatggaaaatttttattttagatgcttaaaatatttttaaaacaatgagaaaaattgtataactaacaggtatagattttaaagaaaaaaattcttgccttgaaaaaaaatccgtatcagtcttctcaaaaaagagaccttccagatctcttaggctgattttgtgtcaggatttaagtaatagaacgtaatagtaaacatggtttaatttagccttactcatgttttctcgagtcactgagataatcctataataaatattgtgctcctggagagtttttttctttagtcctttgataaatagatggtcctgagtatgctaagacagccagctctcaggagaagatatgtatttgattttggtagagagagctgtcttatcctctagggacttgagatgttcgttttactagtctgggagcagggccaaaagggttcttcatgacttagaatggaattctgaaaagtaagttcagcaagttttcattagtgagtttggccttttgtcttgcctgtgcctcccaaaagatcaagagctcagcctttgctttgaaatattacaaaaaagaaccagaacagaatttagttgggggagaaaatcaatcagccccaaaatatcatatttttggaaacattctggtgtagaactcccacctccctagccacttaagttagtgatatctcagtgtttttatctagcttcctttttaggcagaaaatacacatttagaaagaagatgtatataaatctgtgataattcaaatctcactggtacatgtttcttaaacttgtttgacccttaagttctgtcttaaatttattttgagtcttggggaagttctatgccttatttctcttaaatgctatactcctctctacagcataataattagtctaaagctataagatatactatatcttaatttaaaaaatcaggcctagcacctttctgcaaaacatctcaagggttttgtgcagattttttttctgccgtgaagatgagaaattcatgatttccagtttaacactatttcttaacagcaaagcttttcacaccgatcattactgttttatgcagttgctgttcatttatatttattcacaagtaggaaaacattcctcagtggaaggtctgagatgcaaagtgctagttaacaaaaacattgagcaaagaaatcagaaagtagatgggaaaatgcccccaggatgtcccagaactgatggaagatatcaaccctcagattgagaaagtccggtgaatctcaaacaggccaaataaaaagaaattgacacctagacatatcgtaaggaaactgtacaacaccagagattaacagtaaccaaagttgacacagtatgtttaaaggaatagcagattgacacagacctctttgaaaatctaatgagagccatagacttcaccctagaaaaatatatatgcataaaaagtttaaatatagtttggagagtaacgcaccttcccctaaagcaattcctaaacctcatttaaggatctatattctatagttcagttctgcatttttaatgtcttctatattgtctcatgctagaatagtcattatatcttcatatgtaatatttaaagtgtgaattatcatctaacacttcctgtcttcctgtcccccaaatctatacttctcccatgttctttattttcattaatggctttaccctccttctaatgaccctagccatgaaacccaggcatcctatttttgacctcttgctattgcttcccatatctaatcaattgccagttcattttgcttgtgtgtcgtctctcatgttcatctcctcacccttgccccagcctgtttcaagcctctaagtatcttattctttgctagattaatctcaataaaacagagcttgatccctgtcacttccttggtacaacagcctttatgcctctttacaggacagaccatgcaggaaaactgcatatgacattgttctctctgagaagcctcagtgcccaccacactcacagcctgctgtggaccatgtgccccagatacccaagccataggtagtgggaccagggataggtactcctgggaattattcttaatttggaggaagtgtaactatgtttaaacattttttttcagctgggcgcaatggctcacgtctataatcccagcactctaggagtccgaggcagggggatcactagctgggaggctgaggcaggagaatcgcttgaacggagaggtggaggttgcagtaagccaagaacgcaccattgcactccagcctgggcgacaagagtgaaactccgtctcaaaaaaaaaaaaaaaaaaaaaaaagaaaaagaaaaaaaagaggtggagaccatcctggccaacatggtgaaaccctgcctctactaaaaatgcaaagattagctgggtttggtggcatgcgcttctagtcccagctgcttgggaggctgaggcaggagaattgcttgaacctgggagatggaggttgcagtgagcttagattgcaccactgcactccagcctggtgacagagtgagactccatctcaaaaaaaatgagtaaataaaaaataaaaaaaatttattcaacacctcttagtgttttgttgcaggaggactctaggttatccagttagccatattgctagatgtctttctgtattgtgtcttgatgattccagttttctacaaggattgactgggattgcagatgtgctctgaatgacatactagagatattctagctgtgtagctgttgaaatgctttcctgtttgtcttcacttcttgtggttttatattaaacttctatcctttgtgatgacttatctgagctactagcatctctaaacaggactggtaactggtctccctgcatctcctttttccccacttcagtctagttgccacattacagacagagtagtcttctgaaaacacaaatctgatctatcattctcttgcttaaaaacagagtttattacttttccttgtaataaacagagtttattacttttcctcgtaaatgatcactcatcagctttatccaactcaatgcttttcctgcatctctcaggcatatttcttttttttctacctatatctcttccatcttcaagttctagcatttatttctttgtactatcttgaagtctgaactctaagtctctaattcctcctatcctgttgtttcagtgactttccccttcaatcctttatgtcagacacttgatggaagtagaaaccaatgtataaaaaaggtagcttaaggttataaaacagatggtcatcaacactgtgagaccattattccaatatcttccaagtatgaggaccttttattaatgtcaaaaccttttatatgggcataggagaagcgcttgactacaaagaggcaggacaaggcaatttttttagaatggtggaattattctctgttgtcacggtgaatatacaactctacatatttgtcaaaacccatagaactgtatatcacaaagagtaaattttactatgggtaaaaaataaatttcaaaagcatttcatagatccctagggatagaagtaatacttttagcatttcatattaataaatgaattcaaaatgccttttaaatatacttgtattttttaatcacaacagtataagtatatatttgaaagacaaatacatatatacatgtatatatgcacatattgtatatgtgctgtaagtatatgtgcatacatacacacctaacacgtgtgtataaaagatatatgtagctatgtgtgtgtatatatacatatgtatacatatgcattgtcttagcttgtcctgccatagcaaaataccatagactggatggcttaaatggtagaagtttatttctcacaatgtggttgctaaaacattccagatcaaggtgctaataaatttggtgtctggtgatgacccttttcctagcttgcaaatggccaccttcttgctgtatcctcacacagtagagtggaagccctcatatctcttctttttcttgtaaaagtacttattccatcatggggactctaccctcatgaccttatctaaaccaaattaccttccaaaggccccacctcctaatactattgcattgggggttagggcttcaacatgtggattttgggggcataaatattcggttcataacatacacatatatgtatatgtgtgtatatatcacacacatacacacacacagagcatttattcagtcttcaaataatgcttggtgtgtgatcatttagtaaacttgttctagcaaccctaaacccccatgatgccatgaggccaacagattgggaacatttgttataaaggatatataatggatgatcatttttgcaagaattctgttgttcatatttattgatatttgcctaaataagaacacacttttaacttttttcttgctctcgatagctaacataattctgatgttaggaagcagtttttacccctattactgcagaatgagagattcatgaagacctctcctactctgatgcctccccacccaacacaaacacctaggtttcctaatttatttcatgatggggacagaagaattccagaaggagcaaggctctagggtattaaaaccagcacttcagagctttcctcttgtgttaggaccatgacctcattaagctcatgttgttcacagcactggtccttccagggcccctagctctcagattttccatgattttctcatatcagtatgtttccatctagacaatgatcaatgattggtttgttatattaataaagcatcatttacttagttttcagggcagaatatcaatgtggatggggggtatgtcaggtggattttaaaaataaagttgttctacttcatctttgctgtagaaggtatgttatgtccacagcatggttttaaaaggtaattatttagtatctaaagtaatggtatggttcttgattacaagtttggtgtaagtaggcagtgactaaggctcttaaatgtgtaaaattcatatatgaagtggagctctgtacactgttgttggaggaacggtctaacatcaatgttttcagattttcctgtgtgaagttttattaaagagcatataatttgatcctggtatgtctgattttgagtcctgtaatagagggattaatgatcatattggagtttttctagacttgttaaaattcagacacgctgtctttcattagcaacactaatgacttaatgaatggggaagcctttagtttaaaacaaaacaaatgatgggttaacataatattgcaaataggaccataacagggaatgaacctcctgtctgtgaacattctcttttatagacagcttcaacaaaatagaggtcatttttgaaaaagcctgaaatctaccttggcaaatttcagctgagccaaaccattaatttgaagaagttatatgtatcagtggaaaatgtactttactgacaacctttttttccctgcatgcaaagaattttccctcccactttttaatccctcctctccctactccaccctaatctttaaaaagtatgatgtcagattgggtttctttgtgccaagtttttatcctggaacagatttttatagccatgtttctctgagaaaaggagtttatgaccaaatggtgataacacttccatgttttcatttcctcctctgacctagtacttttttcctaactttaactttgtcagagtttagcacaaccaatttaatgtgttttaaagctaaaggaaattattttgagagcttttaaggattcattaactataatatcatcatatattattccttgaaaaaaacagattatggagcatgatattttaaaattttagatttttgtgttcattcaatatgaaaacccttcagaatatttgtgtgtagatagatattttggtgattggtctttgttatttccaccctggtagagttgttcaccagagattgttcatttacttttttcaaactctttcttaaaagtgtagattaacttggccctgtaatttaatgttaagggtgaaaatggtggaaacaactgaaatgatcatcagtagggaaacaacctaattgtccactgacagattattggataaagaaatatatatatatatataaaacaatggactagtattcagccttcataaaggcaacgtggatgaacctggaagacattatgctaagtgaaataagccaagcatagaaagaaaaatactgcctgatctcacttatatgtggaatctaaacaaaatgtcaaatacacagaaacagagagtacaacagtggttaccaggggtggggaagaggtaggaaaatagggagaagtaggtcaaagaatacaaacttgcagtttgtgtaggatgaataaatctagagatcagatatacagcatgaggactataattaataatgttatattgtatactgaaaatttgctaagagagtagattttatgtgcttttaacacacacacaagtaactatggaaagtgatgaacatattatttgttttactatagtaatcattttactatgtgtatgtatatcaaaaacatcatgttgtataccttaaatatatacaattgaaaaaatgaaaaaacctaaacatcaaaaccatattaactatttctataggaaaatatatgtatgtggatactgatgctggatactactagtggctaataccaatgaacactcatgccacatgtgttaagcgctctatacctgttagctcattcagttctcacaacaaccctatgaggttcgttgccactgttgcccccattttatggtgacaaaacagagaaaggatcagaaacttacctgagttctgaagttcattcagaaatagaacttcatctctaccctcaacagcctctttaccttctatcctgacccacctgcccctcccatcatgataaagtctttagtgaaatgcaaaggcacacactggttaagaccactgctttgcggtaacatttgggtttgagccctggttgccgctttgtagtcgtgtgaactactggacgttacataatttctgtataactcagtttctttgtctagaaccctcatagaatctttgccaggattagatgagagaatgtgtttaagtgtttagcatagtgccaggcacattgtaaatacctgatgtattataagttgctgttcttgctgttactgtcatcatcatcaacatcaacatcttcttctgaatccttctttcaaaatgttcagggaccccaatttttgaaattccctctagatactgtgcacagggaccttaggtaataccagtcacctgaattcatttaggataaactagtgaggaaaatgtagaagcagacatctgaagtgagggactaaatatttctctcaggggtcagctctagactttgcttgagtcacaaccccacttcaaacttgagaatctcatgatagctgtaaccatccacaactccctctacccccagataatcttgcatattcttcagaacatgcatggacttgcttgtatataagcccaaatgctttagggatccactgactctgaattaaggctccttctctaaagtttttattgagatagcagtgagatgtccaccggccatggcagtgatacgctggccagggacaagaatcacagacaagagcaatccagaagccacgacactgaagacactgtgctgaacctgttacaaacactattttattcagtgtgcacaatagacctttgggtctgaagacacatggagatattaaggcacacagatgttaagtaactgtcagaggtcaacaatgagtatgtggcaataacaggattcaaacccagatctgttagcttccaaagtccttggtcttacatgctacccactagttccttggagggggctccggaccatggaggtcacacaccagtgctccgagtgtggtcctcacagcacctgcatcaacatgaggttgggatttgattaaaagtggatttctggggccacccacattctgaatctaaagttctgggtgtggttttaggaacctgtgcttttaacaagtacccttagtgatttatatacttactaaacacttgagaatcactgatctttccagtgtggtgtgacttatagacagtgttggacagaaatgaaacaaaggagaaagatgaagcacagacagaaagagctgggaggatgccctgcatgttcttatatctgtaaatacgcatctcttctcctttgtctcagcccttgctgtttaaatctagacccttacatttttcagctatttggctccagcctccccttgcctgactcctggctttgtatattacctctctttcctgactttcactgccttttacaagttgcgttttctgctcatttttagagatacctactaagggccaaaggaaaatacactgtagcagaaacctaaaattaattgtcaccctgggtttaaggcattctgtcattctttccctttccttcactactttttgcctcagcctattcttttatttatttgttagtagttttattgagctataattcctgtacagctcacccatttaaagtgtacagttcagtggttttcagtatatttgcagagttgtgcagccatcaccacaatcaattttagaacactttcctcaccccagaaaagatatcccacaccctttgcagttactcccagttttccccaaccctccagcctttgacaattattaatttactttctgtctctatggatttgcctgttctggacattttatgtaagtggaatcatacaatatgtggtcttttgtgactgacttcttttttttagcataatgttttcaaggttcatccatgttttagcatgtatcaatacttcattcattttcattgtggaataatactccagtatatcaatataccacatttgatttatccattcattaggtagtagacatttggattgttaccactttttgcctattgtgaataatgttgctgtgaatattcatgttaataagtttttgtgtaaacacatattttcaaatcccttaggagaaatgccaattcagaccttttgcccatttttaagttgctttatttttcttgttattgagttgtaagagttctttatatattctggacactagacttttattagatacataatttgcaaatattttctcccattctgtgtgttgtcttttcattttcttgatgatattctttgaagtcagcagactattcttaagctcacttgttgaagttcctcttggctagaattcttgtctacttcctaccctcatcatattttaaagtttttccatgtgcatattagcatttcctacattagatcatttatgtccccgatagcagatccaaattgccatttcatagtctcattgcatttaaaaatacaaattatcagcctaaaataattggcacaggattcatatccaaaataaagaactctttaaaattaagaaaatggcaaaaaatctgatagacagtgagcaaaaaaccatgaacatgaatcacagacaaggaaacatgagtggtgaataaaatatgaaaggatgtaccatcagtggggccactgtagaatgttgagtggctgcaactattgagtgactctggatgttgcccagtctcttggatcttgaggctgaactgggcttttggtcagaactggaggcctaggggattttcagccccctagcaaatccattctgatcctgacttggattttaatctctagaactctcatgtataaaattttcagccatttctaggaattttaagaaaagctaatatgggacttttcagttcagttcagatttaaaagtgttcaggacccccgaagggagtactgaaactaaggaagttttctgaataacctaaacctgaaattggactaggagcagaagagagtagggtctggaggatctgcccatcgcagacctaaaattccgtagtctttttggagatctgaaatgagtgatttttgcacttaatgacttccctctacataatcactaactactggcatgtaagacagaaaatctaagttagttgcagagtgaaaagcaggcctacgtagtccctgaccttgggccacaggattctgaactcgaaggttacagtaggtgccatgacaggtttactctcccaagcccaagaatggagcctctgttcacactgtgctgtcctgtcttagaaagtcaagttgcttccttcttcattttgacaaatcattcttaatgttcttttacatcatttgcttaagttcacatctttgtgatagaactctcattaaacagattaagaacttttaaaaacattatttagattttttttcctccccttaattttttgttttaaagaagaaaggacaagtagcaagaaatacattaaaaagttataatttttccctttaggaaaatctttttttttttttggagacggagtctcactctgtcccccaggctggaatgcagtggcacgatcttggctcactgcaagctctgcctcccaggttcatgccattctcctgcctcagcctcccgagtagctgggactacaggcgcccgccaccacgcccggctaattttttgtatttttaatagagacggggtttcactgtgttagccaggatggtctcgatctcctgacctcgtgatccacccgtctcggcctcccaaagtgctgggataacaggcgtgagccactgcgcccggcctccctttaggaaattattttagtaataggacacatgtctcaacgtggatgttgtactcattttgttttgtgatatggtccagtgcattcttggacatctggcatccatggtccttgcctgctggatgaatgaccccttagtgattgagaccacttaatatacctccctacatttcatacaccccctaatgggatattatcactccaactgaaaaggaaggtaataccttcttttcctttgagttccaaattgtagactgaacaccttgttcaaggttgagaatcttatttcagttcttagaagagatttctaggaatgccagaaatactttactcttattctgtggttgtcaggtccattactttcagatcaagatctcatctcttggaatactgtgtaccgcagaaacagtatcgcattgctcagtctggcacactttaggtttggctctcccactccctggccccttccctgatgtgatgccctttgaatgggctcctcagaggcatgtgctttggtgccacaataaggtaaccaggactgtttattaagcttatgcattttttcaagtgcaggcagccccccactaataagttgcattccaaattgtatgtgtaggttggttatttggactctggaacgtgttttgccatggaaaccatttagtacatagttgggttaccaaggaaactggatgtactgaaggagtccatcaagccatagtgcctgctacatgcagaaccacattttgggggacagaacccaatcctttttctttctttttttgtagctgtcagttgggcagctcgccttgttggaggatgggccaggagctagcagtgatctagctgcagcagattggacctgctcagttcacccagtacaagtccatataccaggagggcccaaaagtcaagtcagatctctctgtaacagacatgcagggcaaacaagagctgtactgtcactcacttctggatcgttacctggaacagcactaagcaacttttcctccttgcttatgaaacccagtccacatcccagagccaggagagctggagccagagtgagcacagtgcacacaaagtgcttgcctttgttcctcgtgttctcaaatatccttgcaataaatgatcatctctccaagtagtctgtgtggacccagtatcacgcaggaaaagccgaccagctcaaactgggtgtggggcttgtccacaaaagcttatggccccatgatctaggttccttattaatagcaatgcattttcctgttatagaatatgtcactcatcacagtaaagagagaatgctaagcccattgtactattccaaagacaaggaatggaaatggtaacagcattattactgtagtgtttttattgtattttaaaaaaattaagccgagtataacttaaatgtttcttgtgcctgtttataaccagtgctgccctgttcccttggtataatggatggtagtctacacactgagtactgggtacgaagactcagctccttggtgttacttccttggaaccttcacctggtgtcctaatcagagtgatggccttcattcccccgtcttgttgtcaccctttggggcttccttagtttagtcctttgtttcctatctttgtatatttgcacaatcacagtagtttaactttacatttatattgtgctttctactttacaaggcacattctctttgcaagctagatagggccggcattgtcatctctgttttccagagttaaaatgaatactcaggcattttaaaggacttgccaaactttcacatccactggcagcagatctggaggtagaacacagggtttccagggcccggttttcctgcgctctttccaccgtatcactccacacgcctgtacagttgccacttcctttagctctgcttatttcttgatgggtggttgttagctgtcttgggattttactcagtgctgaacatctctagtagggtagtagccttccttctctggctgctttagtcagtgtccctggcactttggccctagcatgtacctctcgcttcagcaaattggcatcttgggacaagctcctgccatagtgtatttattagtgaattggtacctttgcatattttatacattgaattaatgcctccaggtattcatcttgatggttaaaatcatattttgttttacatagtatcttttcatcagaagtatatattatcttccattatataggggagactaactggttaaattacttgtctcgaatcttaaccataacagcagaagagagaaggaaactaatttctatgaggagctcatgcaaaccagacactgtactaggtgctttgcatatagaatctcatttcatccttgcaaaaaccttgtggagtaggcgatgttttacattttacaagtgaagacactctagttcagacaagctaagtctgtctgtagttcagacaagctaccctgcaagtgaaaagtagagggaatattacaatctagccttctctgattccaagtctcatgttctatctgctgtcccacatggcttcctcttgccctttgcagggtatcttacagtaataaagaaaagaatgccttggatacatggcaatacagaggggagggggaaaaagctggagtactgccatctccttttcctgacaacagccagaaaagagagaactcactcccttgtctttcctctaaagatcatggaactgttgacacatgttctgatagaagtttgaacttgtaactaagtggaactaaggtaaactaaatggggcaatctgtaagtattttagtggctcttgaaggaggaccagttcgtagacatcaccctctcctgagcagttagaaagctgcttggaaagagctgtgcttctctcttggaaagaccgtgagactagggaagagcgccagccagtgaagtcaggacttctgtgttctggcgctggtttctacctctcactctagccaggtgacccgaggctggtaagtcacttcacttctctggattcctccacttgtaaaacatgagaagtgaactggatggtcctcccagcaactgcagtttcattctttatctttaaagaaatgtattttttaaaaaaaacaatgtgagaatgatgaaaagcttctcgctactcaatgtccttgccaatgatagtttgatagggaacctaaagttaatagctcccacagctctgactctttaaggaaattaagaggccagaaggcagcgttctaatcagatttgtgggtaagatggttatcgatagtagttaatgatggatgaagtgcactgaggctcttaaaagatacttaggatttttgactttactctgtaggttctaaagtaaacatatatgaggtttttaatttctcagatactatacctgcagctctttttgctgactcaagatgatttttggtacctgttttatgcctacatgctccagccagaccagctcctcttgaggcattgaatacctaggaaaaaagaacaaaggaggctggatgtggtggcttatgcttgtaatcccagcactttgggaggccaaggcaggtggatcacccgaggtcaggagttcgagagcagcctgaccaacatgcaaccccatctctactaaaaatacaaaaaattagccaggtgtggtggcaagcacctgtaatcccagctgtccagaagactgaggcagaagaatcgcttgaaacccaccaggaggcagaagttgcagtgagccgagatcgcgccattgcactccagccttggcgacaagagcaaaactccatctcaaaaaaaagaaaagaaaagaaaagaaaaaagcatcccttccctctctacagtgaagtttttctacagtaattcttcaatagtgagttaaaactaattactaatacaagcatgagaataacaataaattagagcaagatagttggaaatgctttgataacatttggtccctttcttaaaattaaaacttttagcatttgctacctatctacctctggatttccctaaatagaaaattcaattcaaatcttttcttggagagaagagtttccaggtctttcttgagatatccaaccccttttggtagtcttcacacacagattttcccccactgttcgtgggcactgacacctcaccagagagtgggcaggtttgcatggggtgacaactggattatttacatggcactgtgaataagtgataagcctagttctgcagggggctgtttttatttcaaaggatgatttaaatctaccatgttagaatatgtaagaataaactcaggtggagatgctttcctgaggcctttaagctataacattctgtctatagcaccccttttctatcccccaaagagccacatctgaaatttagcaatccatttcttcaagatttcaaacttgccttaaacaattgagaatgaagagccatgtgcctctaagagctttgaccacagcccctctgccctgggcctcccagaatttccacaccagatcaacagggctgtggagttttcagggccactgctatcctctggcagcttctcagctcttgctggtggcctcagtaccagctttgatttctctctaggtcaaccctttcccagggaagagttccctcaacttcaagggatctttctcctcctccaagtctaacctccgccttttttgggtttggcgcagggaggggaaattgcaggagctgataacgggaaggaggagctgggagtcttcctcggttttactgtgaaggtgtcttgggtaagtggctggggagacaggaatgggcacaggggatgaactggagagagctcaggatgaatgacactgctcacccattctgaaatcatgctactccaccaacagaaatactggtattttggttataaaaatagtacaatacctgaataccaaagccaatgttgtagtcactgggaaatttctcctgctgagttaaggaagggaagacttcacagaagaggtgtgatttgagctgagtcttaaaggatggtcatcggctactaggcattgagccctaagtacagatccagttcatttcgctggtgattataccaggagttttataggaagtttatatgctttttcttgccagtggttcagtctttaatttagttgggggctggggttgggtagatagttcttctgttgttctgcaaagccatcctcttcatttagctatatctcttgtatccctatttgtctttgtaataaaaccctgtggtaatcacttgagcagttttatgtgttattcttagtgagtaacactttgatacattaacacctcatagcatttcacttggagttgttttttttctcccccatgactttagcatttaagaatgcaaagacgtattaggatttcagatcctgttccttggatgttcctccttacagaagcttattcataaatggcttatttttgcttatgtattttacttaataggccttaaattggtccactgtttgccacatctgttttctaagctgctagttggtgtatttgaaaatacaaaatgtataacaaccacttttgctatctaaagtcttttcttctgccttactttgttcatatacatatagatttcttgacattgcatttttgaaacattttctcaattcaacttgtctttggtcaaaactttggaactagtagtccaaatcttagcctcttaagttgctgctttatagaaactgtggtaaaaattaatacattacacttggtattgctgtctttgagacctctaaatttttgttgaatgtgttgaatcagaattttgctattttattagcaggcttcctggaaccccaaagcagtgcttctcaagaatgttgtcagtggaccacctgcatcagccttgggaacttgttaacagtgtagactccttgaacccatgccagacctaccaaatcagaattttaggggctcagaaatctgcattttcaccagcttcataggtagttgaacacacactaaactttaggaatatctgtcttgaagttggttaagtactgatttatttaggagttactacctaattttctccgggacatgcacgattgagtttttggtttttctgtggtctatcttgatttgaattctgtaaagaatacccttaggggaaagagtagggtcatatttttcttagtattcagcagagttgcacagaaagttggactccagcaatattatcaaagcccaagtcactgtgcctgcttctgcctattgtgtgtggctctttggagttacacaaggacaatagactgacatgtgatgcttggaaatcaccttcctgggtcgtagatcactactgagtacattagacattagcatatagctcacctaagctctggagccttataataatagtaattaacataatgatactttgtacttctcaagtgtcttaaaactgaaggccttaaagtgccatattaaacaaaataggcaacaccttggcaagagaggtcagttttaagttcctcattttatgaattcaaaacctgaagctgaatatggaagtttagcttagagacttcttttggataatgacacattcaacttggagaaacacgaatatttcaaaggaaacatttctgattttaggggaacaggggagtggtggtggtaaggtggttgctattttggcattgcagggtatatcctgagtgaaaacagccacatttggttactttaattaatgcctttaataagtagaggtgttaggctggaaagcattatttttcttacatttctgtgtatgaaatcttatattccttctggtgccttcatttgcctttcctttccttgcccttctttatgtatttttttaaatcattcatagactcagagaatgttcaaaacagcagcaacaacagcaaacttctagctagaagagtcgttaaaaatcatataatcaggtccttttgtttcacaggacaagatacttgagaatagaaaaggttaaataaaagatttcttcaaaatggctcagaaaatgtggctatgggagatatgtcaacagtgtaactattaacagagtttgtatatttgtgttctttttgtcttttcttaagtaaacaagtatatgaatacactttatagttgagaatcagtctttcacagaccctgttttgtatctccgtgctattcctaccttttaaattttattccatttgctttatctgtattcttcctgtatctctcttctctctcttttgcttctgtaaactaatacctttgcaacctaagtaacttaacattacagaaaaataaaattgaagttttaaaaaatcttgaaggtcggcacctcagaaaaggcaggctaaattaaaagataaagaaaaaagtacttggagacttctggaatatttgagttctttttaaaaactacctcaacagctgtagaagtagatagttctttattatcacaatctttaccctccgtttgctcagctgcaagtatatgtttaactagcacaactcaaatggatgatttatggtggcttttgccttacaaataaaatgaagaacagttagttcttaaggtaccaggttaagaatttggagagaaaaggatagggaatttattcatttattcataaataattgatcgatagagaggggtcatctccttatggagtacaccgtattttaatgcaagcagatgagaatcctgatgacttatacaatactgttcttcatcttcatactaaggtgactgagctaaaagtgctgaggtaataaatgtaaaagtgcttaggaaaaatggaaaagccttgtgttaatgatttcttattcaaaacagctcagttctataactatttattgggaatctaaaaacaaatatttgtgtgctgagggccaggtgctggagataatgagctataaagagaaaaggagagacagtgagaaaaaacagcattttctttccttctgggaagaaaagtagaaggatggaaaccctgtaccacacagttccccataccaaccaccagatggggttatcagccacaggcagctcagttgctggtccagagggcttccttttggattctaggaggtggaaattagtaggaagtgtgaaattagttgttgcatacacggataattcataacatgaggtacttacattttaggaaaaatatttacctctattcactagatcacctcctctgtgtgagaagaaaagtagagtaatttgattagatttgttaataaaattatggtagttattagtaatgcttctttttccaatacttgcaaatttatttttggggtaagaacaggtatatttttccgattttgtttgcccagagttaagagagttagtgtgggaaggttattttgtttttctgtgcttgtaattttgtcttcctagttaatttctactcctcccacaagatttgtcgcaaatgtcacctcctctctgaagcatttcttagcacccttctaccagacagttatgaatgcccctttttgtatttctacatggctgtctgtgctcaataataattgttatgatatgaatttaaattaattgtctgcctttctctgctactaattgggagattcttgagaccatgtattatttatatattatttatatttctatacccactgctgactacaaagcttggcaggtattagtcacagaataagcaagttataaatatttgtaaattacagtttttcatagtctatttaaagaatactaagttattaatagttcctgagcagttgtccccagcattataaataagctatcaggagttatcctacaaaataattaattttagaagacttttagaaaggaatatttaccttaagagagaaaggattatagaattaattgcaaagagcataaaaggcttatcttattttacagtagggtctactctcaatgaagcagacatatggaattttaaggcttatttggaattctgattttgtgacttatttacatttttaattggttgaattgaaaaaaaattgcctttttccttaaatgaatatacgtagtctagggacatctttgaggagaaggccaagtttgattctgtattacaaatttttaaatggaacttaatgggaaaatatgattcaccattcaatttaattgatagaaatctctttcacagccaacttttctttaaagtgaattacatatttctctttagaaaacaaatgtattggtctataatttttagacttctgtgagaatgaaaataggatgctcttttatttacagaaaactgtaagacttttttccttatgaaaataatttcccagttatttacctgtgtgtggaaaatttctgtgtctctaatcttgactgggaaagcttttcctgggcaatttagaaaactaaagaaaagtatcattatcttcaacaaacatttatcaagtgcctactatatgaaggtcagattaccagtcctggaaaaacctcagttatccaaaggtgagactcctagcaacaccctggaaaaggaccttgatccctaaacttaaagaaaggaagtctgaagagccaaacaccccatttttaaaatgcagtcagccattttgttttatactgccttggcaaacttagttagcttatttttacactcctagcatatatgagacaacagattcaaggtagacaggctgctatggataaacaagctttgatagcagcaaaaatagacagctacaacaaagtcaaatacaaaatacattaactgataatcctcaatgatggctacatatcatcaatcaagtttggacccaaatgtattaaccctgttcagcaaattattattacttttttgagatggagtctctctctgtcaccaggctggagtggagtgcaatggcgcgatctcggctcactgcaacctccaactccttggttcaagctattcttttgcctcagcctcctgagtagctgggattacaggcatgcgccaccatgcccagctaatttttatatttttagtagagaggggtttcaccatgttggccaggatggtctcaacctcctgacctcgtgatctgccagcctcggcctcccaaagtcctgggattacaggcatgagctaccgtgcccagccaacaaattatttaaggacctgatctgtggggtcaggcaggcctgggttctaatctctgatatcccacctactaatgatataatcatgagtagttatccaagcatgcaagctgagcttttcttctatgtgtcagaaataacatgaaaactatttaaaaaactggaatgatattgatcacaaatataataaaaagttaacagcatttctatttaaattgatcagaagacttaaaatctcaataggtaaaagagcaatgttgttcagtttacagaagaagaaatgaaacaactaatgaacatagaacaatgttcaccctcacctaataataaaaaaactcaaaaataaaaacaacaaaatgtttatatcaggtttaaatcagcaagatagtaaaactgtaccaataaactctaaatgaagagggctacatagggagaaaagacagatccaaagggaaaacaaaaatgaccacttgaataactacatcaacacaagaaagttaaaaagtactgaaatacacactgttgtagtaataaggtagctcctcagtttatgcctcatggcggccctaaaactaccagcagcaaaagtggtttcagagtgggactatctgccaccatgctaaatctcagtaccagtatgagctccttggaatgttcatctgttaggattggcaatatccatgcttgaatttgtattctccatttcttggaccattctgctgtttgtctctttcattgtttggaagtcaaattccttctttcagcattataataaggctatgtaatatagcttgagacttctactacacttgttaatcttacttatctaatgcagcttttgcctgcattattgttaattattgcgtgatttacactttgaatttttacacaggaattgtgggaggttttctaaattgaaaagagattttaagttggcagagtaggaaatttttgttcattctcattaatgcctttgccctttctttctctgtctgaagttatcgccagtggtttaagctgtctggcggccttgattctgctttaatgcatgtctggaaattttactggtatgaaaagcattttttggaactttaacatcatcaacaagttctcttttcacttaaatggctaaaggataaaacattttatctcaaattcctgcattctgagggaattcacttatttcaatttcaggagtttctgtttgtttctaaagaactagtgtaatatgtcattattcattcattcaaccaacaacatttatttgagtgcctatgacatgtcagacagtctactgacactttttaagtcaggatgggaggttatggaataagattgaagatgtccgacactcaagaagagtagagtctactggcagagtcaggcacagaagtaactaacttggacagcatgatgaattttgtaatagaggtgtgcacgtagaaccatagcagcccagtggaaagagctgtgagctctgtctgctatggagtccaagaaggactcaaagaaagggtgacatctgaataagacattgaagaaagaatacaagttttccaggaggtaaaggagagaatggtcattccagacagaagggacatgtgaactaggcatgaatgcaagagggtgcctggcatttttagggcactgtgagtagaccaatatggatgtttctaaaatcgccagaattggccggatgcagtggctcacacctgcaatgccagcactttgggaggccaaggtgggtggatcagctgaggtcaggagttcgagaccagcctggccaacatggcaaaaccccatctctactaaaaatacaaaaattagctgggcgtggtggcaagcacctgtaatcccagcgactcaggaggctaaggcaggagaattgcttgaatcaggaggcagaggttgtgagtcgagattgcaccactatactccagcctgggcgacagagcaaaactccatccccgccgggaaaaaaaaaaaaaaattgccagaatttagttaggtaaaaggtaataatctggaagggttttacatcctgaaagaaacccagaaaatgattgggtttttgtttgtttgtttgtttgaagagaaagagtctaattctgtcacccaggctagagtgcaatgggccaatcatagctcactgtaaccacaaactcctgggctcaagtgatcctcctccatgagccttccaagtagctgggactacaggtatgcaccaccatgcccagctaagtatttttatttttgtagagttggggcctcactaagttgctcaggccagtcttgaactcctggcctcaggggatcctcccacctcagtctgccaaaaacctgggattccaggactagccactgcgcctggccatgattggtttttagtatattctttttagctgggcccgtgcatggagcttagtgtatggttatgtgatagctaatcctcctcgggctcctcagacacctatccaggtatgtattaatttatcttatcatacattgtgttgagaacattttcttctgttcagtcagccacagcattaggctacagaggcagtaatttaagggagcccccagaagtgcacgtatgcacagtcaccacccacacattcacatacttgtgcaatgcacacgatcacacaaatatggctttttttgtattatctctcattattcctaataaaaagttgaacccatgggcggtacttcctaaatatttaatgtttttttttttagcactagcatctagcatgtgcaaatactgcatacacatggatccagaaaactaaattaaatgaacatagaaaggaacatataaattgttttttttttttttttttaaataaagagtaggtaggtgggatgaaatagtgagtgtgggcaaatgggcaaaggatgcagtctggtaggtgttagagacaatggattcctgggagagtgtggaaagtacagaaatttgtaatctgtataagagttgtcagaaagtacatggaagatttctactatctatgcttttaaaaaatatttagaatcatttattcaaattttctggagactaccgcagagttaaaccatgaggcgaggttctctgtgaatttattaatgattaatcatgatggtcccaagtttcccaattgtgcagagccagctttccaacagattccctttacaggaaagatgcataactgggaaattgcataaaccagccagacgtcttcagggaattatgggtaggcagttttctttttaagtggcttataaagcatttgaagaatgccattgtggagcagagagcacatgcccaaccattgcctttttttgggaagttggcacattcttgttttgagttgcttgtaccaacgggcttcactgtgtctcctagggttcctggggggctccaggagtctaggtgctggggtcaaccagtgactcactcagagcttgagccagtttccagtcagatgactccagggaatgggaatggggatgggagcaagagttgggttgggggtaggtagaaagtagaaattagagataggccttcaaggaaattccagtttgctttccccattttcagagtctctggtttggctcaaactcccaaagtgtctcaaagacccttcttccttttattctggagctacttagaacccaaactcttccccttttcaagcaagggttagccagaactgtctatcagacctgtccagcatcttaccctgaaaccccttgggcaatgctgaggccctgcattcctaatacaaaagggagcgcaaatgggtgggtgtgtcctttttggctcttgttcccctccactttgctcttttgcggtcaaaaagtcttgcacagcagttacttaatgccaagctggcccagctgcagctaatttaatcactcatctgttgagtgaggtactattttcattttgcacttggggtaaactgagggcagagatctttaattattttatttagcaccagaaatggactctgatagatataggatgaaacatttggacactcttttgtttgctttccatttgaaacatgattcactatattatatactgcttcctgtgccctaaattagtataaatttaaattttagctactgcaaccttctcttcaaactaactactaattcctagaataaatactagtgatttcaaatgaaaccttttcaattaatgagcaagtggcaaggagttgtaattgtttaaataaaaattatttagaaacttgaaataccgtattttgtctttttaaaaataccagtgggtgtttaggcccacgtaaagagagtacattgctaggccctgcagcgcatacctcacaccgggacagtaaagacaaagggcacctgaaatgtacatggctctcttcaggatgctttgagaaaccagaacttaagtaacggttaaagtagagactccaaagtcagacagacctggatgtgaatccagcctccaatactaagtagctgggtattctcttagcctcctttttgtcaccttttacccaggcatgaggatagtatccacttcacagttttgaggattaattgaattaaaacatgtgtaatgagactactgtctggcatacactactctatggagtcagtgcccagcgaatgatagctcttcctagctcagccaaccctgcaccgggcttcttcctaagtgctgttatgcacataatctcatttcatttccctaccaaccagccaggtaatgctcttcctcgcacactagagcagtgttagttgaacatttgaatttttaagcatcttgactgaatatgacactgcattggtgacattttgatagctgtcactgcatggtttagttccagcatctttcagcacattcagaagcatcaacctttacatgttggggcttctccaacagcaattatagccacaagtggagaaaagctatacatgttctcataaaatatcatcgagatttgtgtcataggcctctagtgacaaagacatgtttaactgctagatgtcagtttttttccccctttcagataaaattaaactgtggagttaccatttaatccacaagtgtaagaataaattggttttttagtcccaattctgtagaaaatcaaaactagtaccaaatatttttatttataaacatttttattgtgggtgtaggcatatctgtgtgtagacagatagaatgaggtgccccccgaaaaaagacggtggtgtcatcttttgtggccagcctagtgaaatcctcactctcctcagatgcctcccagccggcagccaccctgcttcccccatgaccttcttctgagtgtgaagctctgggtgccagcgcttcttccagccaagtcagcaggtgggccaggatcagcttgagaattagttttcttaacagccccaactggccactctcagaataattctgttaaatgtgacctcttgtgttatgtggagtaagtcagtagctggctatcagggagactttagagacccagagagctttatgcctaaggggagaaaaagaacatttttcttgtcttgaggcaggtcacagaaaatgtacacatggtgctggggacaaaggtctaggagaaaagcaaaaggcagtcacccctgccagatatctaatagaatgccagagttagacatgaatgccataagaataatgaaaaactgagagccatgggccttaggaagagaaaatggagtaaatcggatgatagagcaagagaagttgtgaacccagccagaaagaaaggtaagggtgaggcaatctgtccccatcttaacacaatgtactcctaagggtgagacttgtgtaagatcggctgggctgatggagctgggtcagaggcctcagaattggactcacgtggcccaaggctctaaggtaatgtgatctatcgtcatggagatgagaattgaggccatccaccccttgtgggtgttttcctcagggcactgcccattgcacattgctagatcatttccatctggcttcatctctaggcccactgctatgcacctcttagaaactatcaggtggtactgaaaactgaagatgaattttctcatggagttctcttcttagaaactcctagactcagtgactgattgcaaaaggcacatctggcacaagaaaacagactcctacaacttgttgcacttaacatcttgataccaaggatcatagggatggaaagacagtgctaatccccataaacgtgtggtgtctggtcacttctgtgcattccgtgcagtcaataaaatacagtgttgatggaacccagtgcaggtggagtagagcagttccacatgtgcaattggtatttgctcttcttcccttcagtgtgttttttgttgtgtcaaacacaaccgaatgagagttgcccctacacccccacgtggagttagaggagtgcgtcctggcctggaataggtctctctttctgggccactctgtgggctgtctgagcagtggaagcataaatataaacctcgggcacataaggacacacacaggccgcagagcctgtcaagggctctgtcatgttccgagtgaacagatgtttatcccacaacattttttttttccttcttggagtttgtccaatgcattaaaaaaaaaactaaactgtttacactaattattcccttttgctgcctttgcttgttttgttttgctcttttctttttcccatacattaagagctattcgtgtgaggaaattctgcccagctgctttctggaacagatacttccatagcttaaaccaggaaccctttgttcttggatctgagtggagctcagattgccttgtcacatgtatcttggcgcttcttccctgaagtttataggcttttaaaaatccatttcctttttaccccaaagataatcagcttccataacttttcttaaagtaaataactccagatcccttcatggtttcagattttcccgtatgcttcagtcaggattttattcagcaatcatttattaagtacattcttaagtttggtgagtaccataccactgtactaggtatcaaaagagaaaccctttccccttttattggtttgttcatgttttcacttattttttcatttccttcattcaagaaatatttgtttagctcctactgtgtcccaggtacggttctgggtgcagaggaatcagtgataagcaaaaacagacatcgtctttgccttcaaggaattgccagtgtactgcgggagaaagacgtaaagaattaattgcaattcagggtgatacatactataatagtagggtgttcaagtttctttgaggaatgtgaagggtgtaattggctctgcctcaggcatcaaaaataactttacagattactggacatgtgagaggattctacagagagaggacagcacatacagaggtgaggaggtataaagtatggttggttcggggagcttgatatctgaatgcaaaaacagcagatgcaagaggtgaagctggaaaactaagttgggtagccaagttgttaaggtcattttgcatgccaagtttaaaaatctggagtatgtcttagagaaaatggtgggggaaggggcactgaagctttttttttttttccttgctttttttttttttttttttttttgagacagagccttgctctgtcacccaggctggagtgcagtggtatgatattgtgtcactgcaacctccgcttcctgggttcaagggattctcctgcctcagcctcctgagtagctgggattacaggcatgtgccaccacacccagttaatttttgtatctttagtagagatggggtttcaccatgttggccaggatggtcttgaactcctggcctcaaagtgatccacccacctcagcctcccataatgctgtgattacaggcatgagccgctgtgcccggctacactgaaggcttttaagcagagaaaatgctttggaagtaaattgtgtttgctcaaaattcatatgttgaagccttaaccccctagtacctcagaatataactgtttttggagataaggcctttaagaggtaattagattagaatgaggtcatcagaatgggccctaacccaatatgaccaatgtccttataataagaggaaattaggacacacatacacacagagggaagacgcagggagaagacaaccatctacaaaccaagcaggcctcaagagaatccagccctgctgactccttagacttccagcctctacagttgtgagaaaaatcaatttctgtgttgaggccacccagtctgtagtactttgttatggcagccctaggaggtgaatacaccaaggtttaagttttgtaaagataactagagtccatggaggatgctggcttggagagaagagtaacttgaagtaggagatgctgcagtaggagagtaggagctgcagaggtctaggtcatgataataaggttgagtgaccaaaaactactctagcgagttatcctatcaaccaaaatagtgaataccacaggaaggacacattttgggggagtagggggaggggtggatgccaaactagtaaatctggatttggaccgcttcactttggtgtgtgccctggatggctgcatcaaaatgaactttcttaccttctggcctttgattgggttcagcaactagagatttgagggtggaaggagagtaaggagggatatgtctcttacccctgacgtcctcccttctttgcactggcgtgactgtgtttgagtcttctacctatggccacaactccactgggagccccgctcatgacattacagttatctttggtttgatcccagtgataagtaatgcctttcctttgttgccagccctagggtgcttctctatctctttttgatttctcttacgctgtttacaacctcataacgaatgccttcatcagacttgcttccatctcccctttcagtgtgccatctatttcatgccatgaccctgatgagttttaaatgcctactggacacccagggggagatatccaagagacagttagaaatttaggattagggacttggaaatagattgagactggatatagctttagtgttaacatgctggtgggtgtggaaaccatgagttgccgataatatagtgtgaaaagagaaaaaggttcttgattggaatgctggagaagataaacttttcaggaattgacagttttctgcagctaatagaatctcacttatgcatatgttcttcattctgattgtgtgactaattccatatgaatcattcagactgaatacttgcaccgtcactagttatatagataggtactgaagtttgcctttgtcttcaagaagggacttggtgaccaatgaatagtgaaacaatttcagagaaaatatgtaagtagcataatcaaggaaaacatttttaagcatccttaaggatttcataaatgtatttatttctaaatctttattaataacgggttatttttaaatgatgccgtttgcgctgggagcagtggctcatgcctgtaatcccagcactttgggaggccaaggtgggaggatcagctgaggtcaggagttccagaccagcctggccaacatggtgaaaccccgtctctaccaaaaatacaaaaattagccagacattgtggcgggtgcctgtaattccagctactagggagtctgaggcaggagaatcgcttgaacccgggaggcagaagttgcagtgagccgagatcacgccactacactccagcctgggcgacagagcgagactccatctcaaaaaaataaataaataaataaataaataaataaataaataaataacgcagtttgctaagtctgtttggtaggcaacactttgatggctaagatttggttactctatatattctaaaatagttaacctatattccctataaaattgagagaatcatgatgttcagatgctaagtgtttttcctgcactctcatttaatctgtatttctactcctataaggtgagtaccattaatatcttcctcactactgatgaagaaacaggcttagagaagttaataattttctcaagaccacacagctagtaaatgtcagagccaagttctatttatctgaataagagagttttcgctaatacctggaaagactttcttggaccttcctcatccaagggctttttgttacagaggaactcaaggagcccagtggaaagcacttccaactaaaaggtgttcccgtggtctagacgtagaagctgcctttaacaagggtccaccagcacacagtggaaccatttttattataaagggccagaactgcctgtgtcgaatgcataaaatatattctttctattctttggctagtataaaagttatagccgttgtccaaattgaataattcagccagaatctgattttcttggaaggcccatctctcctaggctcactcacgtagtataatcagaggacatttggcactttcaaaagccatagcctacttcttctggaggtctgtgtgtgacatggtgtggcatcataggagcttgcccgatctgctttgtatgggctgtgatcactcctagtggctatgaattttttcctttcatttatgccaaattctcctcccttttgaagtttgaaaggcgaggggcatataaaaaggaagtggttatggcccaaggtcctttattaccttttttgtccaatgcgttgttgacagcagtttacttatcattcttagagggccaaaagcttcattccgatcaggtttctaatcactgaaacttctattttaaatggatttgaaggccctgcctttagttgaaagttttcgagtcagacttgaaaacatcaggaagattaattagtgtcttcacagtttttttcccttcatgttccatctgggcacagatccagtaacttacccaaggagcaggatagttagtctcacccctgctccccaattaattaattcaacccaacttccagaaagataacaacactgtaggtgagggctgagtcctgctacttattccctcattggccacctgtagcctcttctcctgtgatcagcttctcagcaagctgatgaaagacttagcttagctccagtatgtgttatcccactactcatgttaaagacttggttaactgtgttctattatgggcttatttaaaactttacctccaaactccagtaaggattgtgggtcagtttgtaaaagagctcttctgaaccacaccatggagatttatttcaagctgtggtaacagagtaatcctgaaacatactactttaattattgtgaatgtctttggttaagaggaaaaaaatcacttttatttttaaagatatttttattttactctaagtagtgccaatattggtggcaatgtttagctattctggaagataatttaacaatatgtgttaaaaacctttaatactttcatacctgttgctctaggatttcagtatattattgtaattctaacctgagtggagtgtttttacctgacaagcatttattccccaatttttatgttctttgtgacctcttaaaagagacaatataaatatccaggccaggtggggtggcttacacctgtaatcccagtactttgggcagccaagctgggaggatcacttgaccccaggagttcgagaccagcctgggcaacataacaaggcttatctgtactaaaacaaacaaacaaaaacaatagctaggcgtagtagggcgtgcctgtagtccctgggaggctgaggcaggaggatcacttgagtccaagaggtcaaggctgctatgagctgtgattgtaccaatgtacaccagcttgggcaacaaagcaagactctgtctcaaaaaaaaaaaaaaaaatccagtaataagggattagatattacagtgtagcagcataacagaatcctgttagtcattgaaaaaaaaagcaaaaacaaaaaccatagcctgggatcatatttataatacagggcattccaaaagtcccagtatagttttaagctttaataacttcagaaatataaatgctttaaactttcaaaaaacatttatttgaaagtttatttaagtttctttaagatttatttccgtttgtgaatttcagacaataaatttttaatttttttgttttagttaacatttgtcagagattaacagaaaaaattaaaattaaaatttgaaattttataaataacgtgttttataatcttaattacaaacaaaagataagtgagggtgataatttattaaaacagactttaaaaacaatatatacagcttgattctgattatataaataatatatacatgcatgtgctggaaattaaaaaggaaatctgtatatcaaaattaatagtggttttctctggagtggtgtgattatgtattgttttaatttttctctttgctttgtctacttttcaagttttctgcaatgaatgtctactaatttctatttagaaaaatgtcatttaaatactttaaagaatagagccaatattttgacttactctgagtcaaagtatcacaattagtgtatataaaaagctaggaatattaacttcatctaccaattgccattaaagtaattaatttagctattaatactgaaaataaagaaaaattaaatataagaaatatttcctcctaaaatagctaaaagctatgctccatatctttatgtttgattgatagtatcacatttttaagaagttatttttagatgtttatgaactataagagaatcatataaaaggaatagctgtaaagggggattagagggctttttgttgttattattttgtattttgtcattctaagagattaaacaaagattcatgaatagaagctagaatggaaaagaatttaactttgcaagaaattaatttctcccttacatcttataacgttttttaaagtagagaaaaatcaaataggataaaaggactacagattcttaaaaaatatgtttaagtaaagaacacggtataaaaggatatatgcttcagagtacatttcctccaacccgagtcccctcgtcttccagttccccttcacagaggcagtcagttatgtatgcgtgtccttctatgaatatacaaaggtatgtgaacatatcctttctgtcatttggatggtagcatgctgtacatactacgttgcagtctgctttttaaaatatatatatatatatatcttggagattgtaccatatcagtccatatagattcactagttggttataacagttgtttaatcatccttactgatggatctgagtttactttctgtcttactacaattaatgatgaatatctttgtacatacattgaagactactgttctaatagtcgtgtctgtcaaatgatgaaagatgatgatgggtttctcacatcctgataatacctgatagctttcaaagcacttcctatatgttttttgttttggaatgatctactttcaggaatggttagcgacccactactggaggtggtcaaccactgcgtgcatttacaaggttgctatgaagagaggatcagtccctgaatggtgccttctggctagggagtggaggggacgggctgtcctttcctactttcctgtctagtagatcttcccgtaataaaggcattttttaagcagcctgttttcttactatcttgaagacatgggaaaggagggaaatccattgtgttctgattgttttccatgtttagtgctttatgcctgtttttaattggacttttgtggttgagattttcatttacccctttcttggagtaccttccaactctatattaattaataaattatgtcatggatatgtgggctggctctcctaggtatgtgtagcacctggaacatttttagtgattgttaagaggtatgtcagtgaagtttatagattgaaaccttttgttcttcgattttaaaattaatttcattttcttcccctcagcttagaagcaatggctactcaatttctttgtatgtataattttagaacaaaggactttcttaatatgttatatgctattcagagtttacttcagggatgtgattaaaagggaatggaagccaaaggaactcaggaaatggaaccctgctaaacattacctgtgtcttctgtgttttgttttgttttgtttgaaatgtgtgtgtgtgtgtgtgtgtgtgtgtggtgtgtgtgtataatccagcatactatccttaatagaattgatcattcctttttttctggatctgtagcatcatcagatgtgtgcattcatttaggacttcgaagaacatcatctgcaataatatacgtagttttgtcctccctatctttaattgttccatattcactgtgttaatttttctcatcaaaacaacaaggacaggttcttaggagagtatggaggatctcctctgaagggttacagagcagggaagatgcatgtgtgtttcatggctccctacccaccccgtgtggccctagtacatcccatcctgcgtgtatctactttcttgtctgatttctgtggcttcttcagacaagaagcacactacacagtgactgggtcagaagtccagggctgcaggactctgcccaggcatgtctgttttccccaaagtatcctagaactgcactttctatcaacttatgtttccctgtgaagaaaaccttgtctcagcgaggtgtggctgttctcagagtactgtgtgtatatgcacgtgggtgggtgtgggtgtgcatatatgtgtaatggggacgaacgagtattcctgtaccttcttgttgagtagaagaaaaacatcaagttcaaagtatcaccagcagagcattccaaatatgctttccgggagtttacaatttaaagcagccttaaaaatctataaccttgtgtattagtcagctcaggctgccataacaaagtgccatagactgagtgacttaaacaatagaaatgtatttctcacagttccagaggctaagaaatccaaaatcactgtgccagcctggttggtttctggtgcagcctctcttcctggcttgcagatggcagccttctcgccgtgtcctcttatggcagagaaagtttgtgaactgtctggtttccggtcttataaagacactaatcccattgaaccagggccctaccctcataacattatctaatgttaattacatcccagagatactatctctaaatattatcacactgaggattaggattttaacatttgaattttggggtgacacaaacattcatttcataacacctcccttgagttagccttgtgggggttgccctggtacaggttaccatttacttctgataagactctaatttacttttggcaaaaactgactaaccacatataaataagtgattttatttaccttttcccccatttggtgcatacaatttaccatgtagtccaagcctttaggcctcacaagacttcagctcaggaccaggtaggctgccagttcgtcccccatatccaaacagccccgggagagagaagggagagaatttttaaaatgacaatcctgggatgtcctacggtttagagcactgggaggtgtacttgtagtcattaaaaagcaactgcagtgacccagcatagtgctagtaatctggctcccaggccgttgagcgcagcagggagcaagacttcaggatcacactgcgtgtggctttaatgtgcacagactgacttcatgctgggaccacagcatccctaatctttccttgctgtttttagacttttaattcagcttaggtctagatgttggattgacatgatattgtcctttctgtttgatttatcaattcgtcgtttgatagtatactgtcaagaaatcagtgacagctttgtattgccagtgaaaagtcctgatagcttaaagcattcaatagtacaggttggtacatgacctttgagttttcaaaccttggatataatccatgagaaaacaaaaaataaagacaagattgataaataggatttataagggttgacagaattaggaggatgaagggcaagataaagattaaccatacattccctaaatatacaggtattcaggtgaaaaacaacaaaaaaaaagttattgagggatgagatcccttgcttttgattagaatggtaccttccagccaattcaaataaaatcgctcaagctagtttatctgtctgtgaagcacatttctctgaatagttttaattttcctcttagtcttcataacaaaatcataaatgtagctttctgtaggactgtgttctaaacctttgggaaggccactcattcactaattaaacaaaggtgatatagcaatgaacagagcacacaaaaatacctgtcctcgtggagattccattcttatggaggcaggcaatatatgtatatatatataaaagaaatatggtgaaaaataaagcaaggcttcaagagggctgactagacgcatccggcacttgcctcctccacaaagaggaaccaaaatagcaagtagataatcacactttgaatagagaatctaggagagaacactgggattcaacagaaaagtggcaggaaacacccaaggcaaggaaggagagggaagcacagccgggatcagctagaagccctgagaggctcctcagtgtggggaaagggggagagatccccaggggtccacatttccaccacagagtcctgcaatcccagccatgggagagcctcttgaccctcagaggctctcagactaacatggggagctgccttgagaccatgctagggaattggtccaaggagggaactcacactgggtcccacatgcatcccctgagtcctaagcagctgtagcgtggtacgattttgagagcccagccctcaccagacagcatcctttcctagggcctgacagcacctgcgtctccacatctctcaagccccactgatatcccactgtatctacctagagggctactgtggtgtgatgccccagcactacagcacacagtatcctgtatcccaggaaacaggcagtgcagtgcaccagggagatctgcctcaggacaaaggaagccaaaatgcatgcttcccagagcccaaaacctatctgcctaaagctattgccactgacagcaaccaccatcccaactagcggcagagctgtagtgcaattgcatgtaccctgaggactggctcttcccactgctgctgtggctactgccacagctgtcaccattaggaaccgaagcttatgctccccagagcctgagagccacctacctgcacctgctgctactgacagcaactctgtccaccccctgcagggctgcagagcacttgcacacaccctgaagacaggctttgcctgcttataactaccactgctgccaccacccgagcactccacctgggggcctgaggatcaccccaccttgtgcaccatagcctgcacaggaggccctgagtacaagcccaaccagcctggcactgctaccccctcccagtacccaagcatgccttccagtgtcttcgggattatcccaccctgtccccactgccagcatttgtgcactcctgccagggacctgaagatggcccacccagcctgttgccaccatcacagccagcacccacctgcatgttctacctggagtcctggggattggaccacccagcttgtcacagccactgctaacacaaatgtgtgccactggggagcctcagggttgtcccaccactgccgtggccatcatccatgctatgcatgctgcctaagagtgtgagattttgtccacactccagcctaccactgccactgctggcacctgagcaagccacgtggaaacccaagaattggcccacttggactcactaatgccaatgcactcatacactgcccaggggcccaaggatagatacccttggcccactgctgccagagaactggctcacatggtgtccccatccccaacaaaacctcaccacagcctctactaacaactgcagcctaagccactgagaagatcacaaataccactgacactgtttacggctgaagaaataatacagaaactacactcctgcatgcacccagaatcaaagttaaggttttctgaccaactaacaccatacatacatcttcaggaaaaagtcttcccttatgaaagtcaatccaaaaagttagaagtgacttttgcaccaaatgtgcagatatcaacgtaaagacacatgaaatgtgaaaaaacaaggaaatatgacacctctaagggagtacaataattctccagcaacagatactaatggaaaagaaatttatgaaatgccagaaaaatataaaagtaacgatagtaaagaagctcactggccaggcacggtgactcatgcctgtaatcccagcactttgggagggtgcagtgggtggatcacctgaggccaggagtttgaaaccagcctggccaacatggcaaaactttatctctactaaaaatacaaaaattagctgagcatggtggcgcacacctgtagtcccagctacttgggaggctgaggcccaagaatcacttgaacccaggaggcagaggttgcagtgagccgagattgcaccactgcactccagcctgggcaacacagtgagactctatctcaaaaaaaaaaaaaaaaaaaaaaaaaaacctcactgagatataagagaacacagataaaccgtacaaagaaattggaaaaacaattcaggatgtgaatgtgaaatttaccaaagagatagatatccttaaaaagaaccaaatggaaattctgaaactgaagaattcaatgaatgaaataaaatatttattcatgagcttcaacagtagactagatcaagcagaagaaaattcagaacttgaagatagctcttttgaaataacccagtcagaacaaaaaaaaaaaaaaaagaagaaggagaagaaattttaaaaaatgaacaaagtgtatatgacatatgggacaccataaagtgactaattcaaattttgagtgttccagaaggtgaagagaagcccaaaaggcatagaaaagcctgtttaatgaaataatagctgaaatctttctaagtatagcaataaattgagacattcaaataacaagaagttcagagattctcaaacagataaaatccaaaaaggttcttccctgcggcacgtgatagtcaaactatcaaaagccaaagacagaaaattctacaaacagcaagagaaaagtgtctagtcacatgtaaggaaacctccatcagactaacaagagatttctcagcagaaactttacaggccaggagaaaatggcctattcgaagtactgaaagaaaaaaaaaaaactgttagccaagtatactatgctcagcaaagttatctttcacaaatgaaggagaaataaggtctttcctagacaagcagaaactgaggaaattcatcaccactagtccagccctacagtaaatgcttaccagggctctacacctgaaagtgaaaggacaatatctatcatcatgaaaacacccaaaagtataaaactcactggtaaagcaaacacacaaatgaggaagggaaaggactcaagtgttaccactacagaaaattaccaaactgcaatgataaacaataatagagaaagaaacaaaggatatacaaaatagccagaaaacgattgaacaaaatgacaagaataagtcccctcatatcaataataatcttaaatgtaagtggattaaattttccactgaaaagatacagactggctgaatggacaaaaaaaaaaaaatgacccaattatatgctgcctaaaaaaactcacttcactggtaagacatatatagactgaaaataaagggatggaaaaagatattccacacaaatggaagccaatagcaaacaagcagaagtacttatcttaatatcagataaaacagactttaagtgagaaacagtaagaagagataaagaaggtcattatataataataaaaagatcagttccacaagagaatattacagttctagacatatatgcagacaacactggagcacccagagttataaagcaaatagtattagatctaaagggagagatagactccaatacaataatagttggagacttcaacatcccactttcagcattagacatattatctagacagaaattaacaaagaaatattgaatttaaactgcactttagaccaaatggacctaacagacatctacggtatattctacccgacagctgcagaaaatacacacattcttctcaacagcacatggaacattttccaggatagaccatatgttaagccacaaaataagtctcaacaaatttctaaaaattgaaattataccaagtatcttctcagactatagtggaataaaactagaaatcaaaaagaagaagaacttcagaagctgtacaaatgcatggaaattaaataacatgctcctgaagaaccactgggtcaaggaagaaattaaggaggaaatcacaaaatttcttgaaacaaataaaaatcaaaacatagcacaccacaacctatgagatacagcaaaagcagtgctaagaggaaagtgtatagcaataaatgcttacgtcaaaaagtagaaagatttcaaataaacaatctaatgatgtacctcaaggaactagaaaagcaagaacaaaccaaaccaaaattagtagaaggaaagagataataaagatctaaataaaaaagaggctacaaaaaatacaaaggaccaataaaacaaaggttttttttttaaaaagatgaacagcagcaaaaaaactcctagctagactatacaagaaaaaagagagaagacccaaataaacaaaatcagaaacaaaaaaagaggacattacaactgataccacagaaatacaaaagatcatcagattctattatgagcaactatatactaatacactggaaaacctagaggaaatagatacattcctggacacatacatacctaccaagattgaatcaggaaaaaacagaaaacctgaacagatgaataatgaactacaagattgaatccgtaataaaaactctcccaacaaagaagtttaggacaaaatagctttactgccaaattctaccaaacttataaaggagaaataacattacttcttctcaaactattccaagaaactgaagaggaagcaattccccttaactcattctatgaggccagcattaccctgataccaaaaccagacaagaatgtaacaaaaaaaggaaatggcaggctagtgatgaacacagacataaaaattaccaacataacactagcaaatcaaacccaacagcacatcaaaaaaggtaatgtagcatgattaagtgggatttatcccagagatgcaaggatggttcaacatacacaaatcaaaagatacgatatagccatcatcagagtgaaggacagtagccatatcattctctaaatagatgcagaaaaagcattggataaaactcgacgttccttggtgataaaaatctcaaccaaccaggcattgcaagaacatatcttaatataataaaggccatatgtgacccatagctaatatcataccaaatggggaaaagctgaaagcctttcctttaagaactggaacaagacaaggatgcacactttcaccagtcctggtcaacatggtactggaagtcctagccagagcagtcagtcaagagaaagaaataaaggcataacaatcagaaaagaggaagttaaattgtccctttttgcagataatgtgatcttatatctagaaaaatctaaagactccaccaaaaaatcttagctgtggtaagcaaattcagtaacattgcagaatgcaaaatcaacatacaaaataaatagtgtttctatacaccaataatgaagtggctgaggaaaagaataagacaatctcatttataatcacttcaaaaatatacctaggaataaatttaaacaaggaggtgaaagacctctacaatgaaaactacaaaacattgatgaaagaaattgaaaaggatacaagcaaattgaaaaacagcctaccctcatgaatcaaaagaattaatattgttaaaatgactatactactcaaagcaatctacagattcaatgtaatctgtatcaaaataccaatgtcatttttcacagaattagaaaaaactatcctaaaattcatgtggaaccaaaaattaggctgaataaccaaaggaatcctgagcaaaaagaacaaagctgaaggcatcacactacctaactgcaaaatatattacaagactatggtaatcaaaacagcatgatactggtatgaaacagacacatagaccaatggaacaatataaagaatctagaaataaatccttgtatttacagccaactggtttttgacaatgccaccaagaacatacattgcagaaaggacattctcttcaataaatagtgcatggaaaactggatctccatatgccacggaacgaaactagacccctatctcttgtcacatacaaaaatcaactcaaaatggagtgaagactaaacataagacctgaagctataaaactactagaagaaaacgtagagcaaatgctacaggacattggtttaggcaaagattttaagtctgtggcctcaaaagcacaggtagcaaaaacaaaaataggcacatgggactatattaaataaaaaagcttctgcacaacaaaggaaacaaatcaacagagtaaagagacaatctgttgaatggaagaaaacattgacaaactattcatctgccaaggactaatatccaaaatatgcgaggaactcaaacaacagcaaaaagaaaaaaaatcacattaaaaagtgggcaaagacatgaatgtacatttttcagaagaagatacgcaaattgtcaacaggtatacaaaaaatgctcaatgttactaatcatcaggaaaatgaaaatcaaaactacagtgagatagcattttatcccaggtaggatggcaattattaaaaagacaaaaacaacagatgtctagtgaagatgcagagaaaagggaacccttatgcactgtcagtaggaatgtaaattagtacagccattgtggaaaacagtatggaggtttcttgcaaaactggaaatagaacttccacgtgatccagcagtcctactactgggtatttatccaaaggaaaggaaataagtatatctaaggagatacctgtacccccatatttatggcagcagaaaaaacaattgcagtactatttacagtaacaaagatatagaatcaacctaagtgtctatcaaaggatgaatagatagagaaaatgtggtatttatacacaatagaatactacttggccataaagagtgaaattctgtcatatgcagcaacatggaactgcaggttaagtgttaagtgaaacaagctaggcacagaaagacaaatatcacgtgttctcatttatatgtgggagctaacaaagttaatctcatggaggtagagagtagaataatgggtacaaacatatagttagaaggaataaattctaatatttgatagcagagtagggtactcttgttaacaatgtattgtatatttcaaaatagctagaagaaaagacttaaaatgtcccagtacatagaaatgataaatactcaaagtgatagataccctaaataccctgattttgatcactacacattctgtgcatgtaacaaaatattacatataccccattaaaaaagtacagatttaggttggtacagaagtaatttcagtttttgccattgaaagtaatggtaaataaaaattttattttaaaaaaagaaaaatatgcaccaataaaattttttttttaaaaaaaaaagacaaaataaagcagggaagagagggagtaggggttggggtgggagtgcaggatgaggtagctattttggatagggtggcaagggaaaagcttcactgcgaaagtgacatttgagcagaaggaggtgtcagagtgagccatgaggatttctgggggcagagttctccagggcggagaatctgtgagcacaaaggcctggggtgggagcttactgagagtgatcaaggatcagtatcccagtgtggctggagtggagtgaagcaaggaggtggccatggagccagggagaaagatgaggtagcagtagtgctgatcatgtagggccttacaggccgctttaaggacactggcttatactctgagagactcactggagtgtcttaagcaggcttaaggagattgtccccaggaatctctctatttgggggagaatagcgtgtgcagggatgtgtcagagctgatgatctcccacttagggacaggagttcttctgcaagaagatattacagggtctgtatagaaacatttccaagatgccaaaaagagttgggcgattatgttacattttggtagagccactctcctggggatctcacggtttctgctgaaacatatcacacacacaatcatagctgcacagtgctgtgatgaaacatcactagggtacctccactccccatacagttaggaaactgtggaacagagacatcctcccgtgttcagagtcacacagcctagatagtggcagtggtaggactacaatcatggcagatcagtgctagaaaggctttagagtgtctgtatgtcattcagggttcccagccttgagaagaggacctgctatgcagttactgcggactgcaaattcacatgtacaccaactgttgtttgtagactaaataaataacatctaacatctgtataccgttactttaaaaacgaatgttgactctgctgtgattaataaattggaagtttattttcaactgttactgcatccaaagtaccttttttcattatattttctcactgcacagattcttaaagtatatctgctgttgtttgattagtctgagagaggttttgatgtgtgaagtgtccctcgtgcttgaaaagattgggaagcacacatctagtccaacccttccacttactttacaagatagaccaaagcccatgagggttccctttactgccttagggttgggaagattgtcagtaataaagtagggaccagatcctgattctttaggacccaaaagtgagtgctttgtttttttcttaagtatatcatattaatggttcccattaatccagaacatccctatgaattagaaaaatccacaaaatatggtcaggcgtggtggctcacacctgtaatcccagcactttgggaggccgagtggggtggatcacctgaggtcagaagttcaagaccagcctggccaacatggtgaaaccccatctctactaaaaatacaaaaaaattagctgggcatggtggtgggtgcctgtaatcccagctacttgggaggctgaggcaggagaattgcttgaacctgggaggcagaggttgcagtgagctgagatcgtgccattgcactccagcctaggcaacagagcaagactctatctccaaaaaaaaatttacaaaacatatttcttccctcaatgtaaatgaaggtcatataatagtgaggcctgaagtaagcgagcaatagctgcccagtgggacagatgatggtgcctgggcttactttacaaaaaacaacattctccagctcagccaccttatcatagactcccccatcactggttcagacagcatccaaacaggctcagcaggtgtttgctccattagaattcttacatagattttgcagacacactgtcaaaccagccacacagaattttatgttacttttggatgaagatcacacacacacacacacacacacacacacacacacgtacattgactcgtttgtgagagcggagggcagacaccagcatctgttaaccaaatggtggtatacaacatgcatgtcctgtttatgtttgtgtatgtgcttttcctttccatagttgtttttcgtctcctttgggtagacctagcatcagggagtcagagtgttgttatttgctcatagagacacacacaactcttttcttcatgcttgtattcacacaaaactaactcctagtttgttgaacaatgaaagtttgcatttgggcataggagataagtacacacttgctcacatggatcagtaacactttgactattgttagccttcttttgaaaataaaataaatctctggcttaccgtgaaaactttacagatccaggaccattgtggcatcaagaactaggactgcctcctattgttcaattttccagatgcatgtctgtctttctgtctctgtctctgtgtctctctctctccctccctccctccctctctctctctctctctctctccccccctccctctctccctctctctctctgtctctctctctccaggtattttttttaaatactttaagttctagggtacatgtgcacaaagtgtaggtttgttacatatgtatacatgtgctgtgttggtgtgctgcacccatgaacttgtcatttacattagatatatctcctaatgctatccctcccctctccccccaccccatgacaggccccggtatgtgatgttccccttcctgtgtccaagtgttctcattgttcagttcccacctacgagtaagaacatgcagtgtttggttttttgtccttgcgatagtttgctgagaatgatggtttccatccatgtccctacaaaggacatgaactcatccttttctatggctgcgtagtattccatggtgtatatgtgccatattttcttaatccagtctatcattgatggacatttggattggttccaagtctttgctattgtgaatagtgccacaataaacatacatgtgcatgtgtctttatagcagcatgatttataatcctttccccaggtagtttatgtaggaactatttaatgttaaatgaatcattaggtaaagtgcgtatactacttcatgagatggctttaattaagtcacttattttcttaagactttatcttgataatttttttcttggttcataatgaaatggaaaagatttgtgccttgactatcctgaaacttttatgttactctcacaagtttactgaagctgcaaagaataaataaggctatttaaactatggtgactataacccatttatattgagaaataagcctttcaagaggttaaaaatagcataaaggcaggtacataagatgcttgtcagctaaaaagacccacccaatttaaagtaacattaatatattaaaaccccatttcttatctgagcatatttatagcagaacaaaactccagagataaattcatctgccttcagacagccgtacacctgaactccaggtggatgtttgtgtttgggtctgtttctaggtggaatgatctcatgttctcccttaccacagaattgtgcaacactgatacacacctgtgttttgatctttaaaatctgtcgtggtaacatctcaagtaattttaaatagcttcgtggatgatccagattgcacgtctgccagaaacatccttgggcacagttttggagctgacttggattcctgcaatactaaactcgagtcatattgaaaatatactaggccttgggttctgttcctttcactgagacttttatctcgatgcatttttttgtataagtaatccccttggccagcgtcagtgcatgagatcttaattatcattaaaagagagtgagatgaagtatttagaaactaaagcaagttacctggatcaccacatttctgtcattgcacaagtatttgaagaattattttttttgctcttttttttttgaattgcagaaatttatgaaaattagagacattgtttaatcttcttgtgccatgagactccatcaggccatctacaaagaccactgggaggctaaggatcacttgagcccaggaatcgtgctcttttaaatatatctttttcataaaagttattttaaaatgtggcagtttaaaatgcctgctgaaagagttgatcttacctgtaagatcacagatttctttctttaaaagctagtggatacccaacttgtaaagcaccaaagtaggacttagtgtgggaatgttaaggaatgaagcagagttgaagacatggcttatttcaaaacacagtgactcatgaatgcaaagtaatgcatttctgttatgtttgcagattcatggttaattccgaccttagcttaaccaccatattttcagggcaaactgttgatgtggtaaatttttttctaatgtatttattttattctagttattatgggtaataccaaaaatatgtaaaaagtagaatagtgtaatgaaccttcgatacccatcatcccacttctatctgtggttagccctgtaccccactcacttcacagtccccatgtccttcactggattgtttcaaagcaaattcacaagtatgtggtatgaatttttgtctttatgggaacattttagaggatgttacactttagagggtatcacccacatggagagcaaaagaaagatgagaagtacattctaaagaaggctgggtgtggtggctcacccctataatcccagcactttgggaggctgaggcaggagcattgcttgagcccaggagttcaggcaacaaagcgagaccctgtctcaaaaaagacacagagacagagacagagagagacagagagaggggagaaagagagagagtatgtgagagagagggaaaggaaaaggaaagaaagaaggagaaaatggagaagcgaagcgaagcaaggcaaggcaattgaaacagtagtgaagaagagtggtagtatatcctgttagcctgtactatctattgtaacatcatggatcacaaggaattcaacatttttttttttttttgagacagagtcttgctctgtcgcccaggctggagtgcagtggcatgatctcggctcactgcaagctccgtctcccaggttcacgccattctcctacctcagcctccagagtagctgggactacaggcacccgccaacaagcccggctaattttttgtatttttagtagagacggggtttcaccgtgttagctaggatggtctcaatctcctgacctcgtgatctgtccacctcggcctcccaaagtactgggattgcaggcgtgagccaccgcgcccagccggaattcaacatttttaataatgggggcataggtttttgattgtgcatgctactgcaactatggtatgtgagtcttgattcctattttctatctctcatgagcacctctgcaactcagcctgaatcttgcctatgaaagtggcagaagtgaagctattaagctcctagagacccatagagaagggccactagagcatcttgagggcaggagccatgttggtttgggtagcactatagtggcttgcacagtgcctggcacatatttgttgcatgagtggattcttatatccacagaactgtgacttgagtgagtgcaggagaagttgtatagctctttccacatacagttcccccaaccagagtgctgtaaagacaaagcagagtcccaggaacagttcatgggattctttgtgctttgagtctttcagtgtaaaatttatatatctatctgaaatcttaaaaaacttggtaatgccctctggcttttaccaaaagaattgaaacacactcacatacacaatatagtcattaccattctcctaaaacagaactttggaatttttttttttttttttttttttgagacggagtctctctcctgtggcccagactggagtgcagtggtacgatcttgactcactgcaacctctgcctcctgggttcaagcgattatcctgcctcagctgcccaagtagctgggattacagggtcacaccaccacgcccggtttattttttgtttttagtagagactgagtttcaccatgttggtcagactggtctggaactcctgacctcaggcgatctgcccacctcggcctcccaaagtgctgggattacaggtgtgagccactgcacctggactggaattattttttaaagatgcttttctattacttttgtcatttaaaaggactcaagtatttttccccgggcgcaggcagtagatatatatgtattctttggggttgaactcaagtttgaaattttaatctgtagactaggtagcctctgaggtatgtgccactgcatgatccataccacaatgcccgcctcgttcatttgctctagaaggctcccatgccatcatttgtgagcatgtatcaccttctccattctacctacacattggcataaagtcccaaccctctaattggctcaccacttaaaaagccctattgactgcttccttaaacagccttgtattctttgtgataaatacatttgaaactgatttactctggggtgggcggagggaaggtttgggagggaaccctacattttaaggacttgaaaacaagttggttatatttttaaactatactgagaaggggatagggtcagaacccaataatggacctgaaatcactgaaaataattcttggatattgaagggtaaaatttggcctatgtcttgtaaacagctgcctgtatcccgtaaacaggctcagtcagatgctaacagatatttgtcaaaattgcacatgccagagattgaaacggaaaatggacatgagccattttggagttaggctttcccaacaacaggcctcggggctgtttaggttctgccacctagatacacgggggatggtttcttcagtgttttccttcctcatgagctcccaaaggacaaggaagcaaatccacagctccttgaagccccttagtccctaagctacagttgaacacagcaaacacatatttaatattgtttttatctgcttaattgtaagttagtattgaacacagactagtttcaaagttttatttgcttaactttatgagtcctttcattaaaaaaaggatttctctgcctgggcacaatggctcacgcctgtaatcccaacactttgggaggccaaggcgggaggatcacctgaggtcgggagttcgagaccagcctggccaacatggtgaaaccccgtctccactaaaaatacaaaaattagctggggatggtggtgcgtgcctgtaatcccagctactcaggagtctgaggcaggagaatcacttgaacctggcagttggaggttgcagtgagtcaaaattgtcccactgcactccagtctggcgacagagtgagactccctctcaaaaaaaaaaaaaggatttctcttctgtttgcttatcaatactctaagcattatggatttacaaataaatataaattatagttttcattcccaaagggcttgcaatttagttgggtagataagacatgtacaagaaagaattaaagaatacagcagcatataaaaaattatttaagttttgtggtgcaattagaataaatggtactgattaagtattataggcggtaagagcaaaagagaaaacatcagcatggactagaatctttggatcctggcacatggtagttgcacagaaaatatttgttgaacagaggataggccattaaacaccatttaaaatagcatcaaaaatatgaagtactcagttatacatttgagaaatgatgtacaaaacccatataccaaaaagtataaaagataaattaaagaagacctaaataaatagagaaatatattgtcagtgggccagaagtctcagtattaagatgtcaattcttcccagagtaatcattgatctatagatctacagattaagtagtcaaaaatctcagcagacttttttttttagggattgacaagccgattctaaaatgtatatataaatgccaaggaccgagaatagccaaaacaacttttgaaaagaagagcaaagttggaggaaggacttgcaatacctgatttcaatacttactataaagctacaataatcaaagcaatatggtattggcataaagagagaaaaatagataaatgaaactgaatttgataatgagtccagaaatagacccacacatctatagacattcagtttttgacagagttgcccaggtagttcaatagagaaaggataatcatttcaacaaatgatgctggaacaactggatagccataaccaaaaagttgagcctcaatccttaccccatagcatgtacagcattaactcaaaatgaatttatagacctaaatgtaagagctaaaattataggtattgtcttagttcattcaggctattataacaaaatactatagattgagtagcttataaaaaacagaactttatttcctacagttttggagactgggaagtccaaaatcaagcaccggcagattgagtgtctgatgaggactcacttctttcatagatggccatcttctcacatggcaggagaggctagctccctgtagtctcttttaaaagggctctaggccaggtacagtggctcacacctgtaattctagcactttgggagcccaaggcaggcagatcacctgaggttgggagttcgagaccagcctgaccaacatggagaaaccctgtctctactaaaaatacaaaaattagctaggcgtggtggtgcatgtctgtaatcttagctactcaggaagctaaggcaggaggatcacttgaactcgggaggcagagtttatggagagccgagatggcgccattgcactccagcctgggcaacaaggcaaaactctgtctcaaaaaacaaggggggggcggtgctgtaatcccatgagggcagagccctcatgatctaatcaccttccaaaggttctacttactaataccattaataccatcacctgagggttaggatttcaacatatgattttgggagagacacaaacattcaaactatgacaaacatctagaagagaacataggaaaataatcttagtgaatttgggcttagcaaaaatttcttaagtatgatacataaaacaacattaaatataaaagaaaaatcagtacattacacttcaccaaaatcaaaatatttgctcttcaaggcacggttacaaaataaaacagccagccaacaaacccaaagaggagaaaattgcaaaacatatatatgacaaagaactgttatccagagtatacaaagaactgttacaacttaggaataagaagacaaacagcttaatacaatttaggcaaaagatttgaacaaatacgtagtcattggggaaatgcaaattaaagccacaatgagattaatactatacacctactagaatgggtaaaatttaaaagtttgaccaaaacaagcattggcaaggatgtagaactggaacttttatggaaatataaaatgatacattgactttgaaaaacagttggtcagtttcttacaaagttaagcatacaactgccagatgacccagccattctactgcaggtacttggtcaagagaaatgaaagcatacatctacacaaagacttgcagatgagtgttcataacagctttatttataatagccaagaggtggaaacaacccaaatgtccatcaacagggaatggataaacaaatagtgggatatccattacaatggaatacgcctcagcaataaaaatgagtatactattggtacgcacaacaaaatggatgaatctcaaaatagttatgctgagtgaaagaagccaggcaaagaagagtacatgctgcatgatgtactatttatataattataagtatacatttatataaaattctagtgaatgcaaattataatgacagcagaacagtggttgcctggggacaggagcagtgtagttgtggaagggagagattacaagagtaagaggaaacttaggaagacgctatatacgtccattttccttattgtggtttctcaggtgtcaaaagtcattaaaatttgaaatgtacaattgtacatcaattatttctcaaaactataaaaaaaagaaaaaagaactgattgcctacatggccatttttcatttgcatgatgacagaaatcgaagagctgttttcaacatgagctcagtgtcccattgatgtaggcaggagattgttttttggttttttgtgttttttttgagacagagtctcactctgtcacccaggctggagtgcagtggcacgatctcggctctctgcaagctccgcctcctgggttcacgctattctcctgcctcagcctcccgagtagctgggaccacaggcgcccgccaccacgcccagctaattttttgtatttttagtagagacggggtttcaccatgttagccaggatggtcttgatctcctgacctcgtgatctgcctgcctcggcctcccaaagtgctgggattacaggcgtgagccactgcgcccagccaggagattgtatattacctttaatagagaagctgcacaccaacatggcacatttatacatacgtaaaaaacctgcacgttgtgcacatgtaccctggaacttaaagtataataaaaaaaaaaatagagaagctaatgcagtcacaatttatgggtctttattcatttgactgggtttatagctcttttttttttttttttttttttgaaacagagtctcactctgtcactcaggctggaatgcaatggcgtgatcttggctcactgcaacctctgcctcccgggttcaagtgattctcctgcctcagcctcctgagtagctgggactacaggcacgtgccaccacggccagataatttttttgtaattttagtagagatggggtttcaccatgttggccaggatgatctctatctcctgacctcgtgatccgcccacctgggcctcccaaagtgctgtgattacaggtgtgagccaccacgcccggcctatagctcctttttatagcttaagatggcatttgtttcatgaaaattgctcttaaaaaatagttctgttggctgggtgcggtggctgacacctgaaatcccagcactttgggaggccgagatgggtggatcgcctgaggtcaggagttcgagaccagcctggccaacatggtaaaccctgtctctactaaaaatacaaaaaaagtagctgggcgtggtggtgcgcacctgtaatcccagctactcaggaggctggggcaggaggcttgaacccaggaggtggagattgcagtgagccgagatcatgccattgcactccaacatgggcgacatgagcaaaactctgtctcaaaaaagaaacaaagaaatagttctgtttatggtacctatgaggaataaattgggcacattaaaaaattagattgattagattttagtttgttcaagatagaggctaatatctctgcactcttgaacctctacattcttgagccctaggtggtaggcaaggtgctggatttatgcaccgtgctaagtgggcccaactctgccttcaccgagggatctgaaggcctggtctagggctctggctctgacgcttaataaacatgtgacctcggcaagtcatgtgtcactgagcctcagtttcctcatgtgtaaaatgacagtaataataatacctatctcacttgcctcagaattgatacaagagcatactgctctttaaaagctgtaaagtggcatgaaaatacaaggagttgttatttctgttgttctcctgctctggatcccaaaatgcttatccattgctcaagaaaaccaaaggtatataatcttttcaatttataagaaggaaaagaagttacgtcacgatgtaacttctgtaacagatgatgtcactaaaactgatcacactatggccatgatccttcaaaagcagttttttctctcttcctcttttccctcctttgctttctcattttattccattaatttagtcaacagatgcttgctaagtacctggcaagtgtcaggtcctgtaggcaatagaaataaaacaaggaagaagacagatgagtcactgcctctgagaagctgacatatctgtgggaggctgtggtgcagtttgacaggtgctatgagaggaaaagcatgaggggctcgagagcacctgggaagaccccgtaaccaaatttggggggtcaggggaaggacacttgaggataagtaagggttagccactcagagagcgggcgggagtgttccagtcaaagggaacagcacgtgcagaatgcatggaggagagcttcgtgtggctggagtcagagtgtgaagcctggtcagtgagagggaagtggggaagtttcccaggacagatggtgttggggccttgtaagccacggtgagagctgcagggagccatctggttccctgcctatagttttaagcaggaaatcaacatgactgacttgccagtttactgtctgtggtaaggcttcctgctctcagctcccagagttccttgtgaagccgtgttggtggtcaagattaagaaggttgctgacctctttctaggcaagattttcttggatagaacttagcttatggcaaccaaactgactttgtttacattgttttctgccaagaaaacagaaacctctccaaataaacagtgactattacttataaataggctaatgaaaccgtaattttcagtgtttccctcacaatttgttgtatgattacaacgtagactttttttttttttttttttttgagaaggagtcttgcttcacttgtacccaggctggagtacggtggcacgatctcggctcattgcaacctccgcctcctgggttcaagtgatttagctggaattacaggcacgtaccaccatgcctggctaagttttgtatttttagtagagatggggtttgccatgttggccaggctggtctcgaactcctaacctcaggtgatccgcctgtctcggcctcccaaagtgctgagattacaggtgtgagccactgttacttgccaaatttttgcagtcttaatagaaacagggttttgccatgttggccagcctggtcttgaattcctggcatcacgtgatccacctgcctccgcctcccaaagtgctgggattacaggcgttagccaccacgcccagccaacatagacattttaaatggggatcatataccagagagaaaattgtgctctagcaagaagaccagaaatacttgaatagagaggaacctctctgagcttaaatgcaatgggatttttttttcacagtaagataattaatttctgttttcattttccccagtgctacattggcattgggggataaaaaatatacccttgggaaggtgtgctgacttctgcagtccacaagaatactattaagaatgtgtctgcaatttgtgcttatttgtgcttgtgttgatctttcctttatttttttattttacagctttaagtttctttggacagcatctcttactatacttttcaaatgtcttgctctcttatagataataataacataaaatctttacataatttcccccaggtgtcaagatagtttattgtctttttgttttgacattcagatatctgtctggaaaaaaaatctctatgacatgagaattctaaagtttaaaggacatgaggacagtgtaacaaactcacagattcatactgtggcaactgagggaatggtttccatccttttgggtggagaagtctatcaagagggccagggtcttcaggtacagcagtgaattgttgttgaacaaaatatcagtgtctatttttatcgtagatacatagctgtaatatatatacagttcggatatagacagcctgtctttataaaagtgactgtcataggacagtaagtgtatttgacacaggccatcagcagaaatgagagtgccaagttggacatagcacaattttctcataaaatagtgaaaattcaagtctacctaattcaaaagtagttttgagcaagcctaatgcacatataaaatattagttcaaacaaaccaaacacagcacccatgcaatatctcaaggatactgttaatagtgccagcaaggtggaagatggtatgctgtcactgccataattataagctggcatcagtctctacatggtgagcattttgtttcttacaacagtgtacaatgaactcaaagttaagaatttttggctgggcgtggtggcttacgcctgtaatcccagcactttgggaggccgaggcaggcggatcacgaggtcaggagatcgagaccatcctggctaacgtggtgaaaccccgtctctactaaaaatacaaaaaattagctgggcatggtggcgggtgcctgtagtcccagctactcgggaggctgaggtaggagaatggtgtgaacccgggaggcggagcttgcagtgagctgagattgtgccactgcactccagcctgggcaacagagcaagactccatataaaaaaaaaatgaattttttacaaaaaagcattaacatatgtgtgtatgtgtctgtgtgtatatgatttggttaagcatggcatttggaaccaaggactctggttaaagtactcactctgccattaacgtgacatgtatctgtgagcttgtcactgactcatttttcttttctcacctcagtttcttcatctttgaattgacacaccagtttatcaatgaaaaggtaagctgtaggtcagatatgatggctcaatgcctgtaagcccagcactttgggaggctgagacagaagaatcacttgaggccaggagtttgagaccagccttggcaacatagcaagaccctatctccacacacaaaaaattgtttttaattagcttggcatgatggcttgtgcctgtagtcctagctactcaggaggctgaggtagaaggattgctggagcccagaaattcaagcctatagagctatgatcacactccagcctgggtgacagagtgagaccctgtctttttttttttttttttttttttttttgaggagggtcttactctgtcactcaggctggagtgcagtggcatgatctcagctcactgcagcctccacctccctggcttaagggatcctcccaccttggcctcccgaatagatgggactacaggtgtgtgccacccacctagttaatttttttggtattttttatagagatgggatctcgctatgtgtgtatgcccaggctggtctcaaactcctgagctcacataatccacccaacctacacctcctgaagtgctgggattgcaggcacgagccaccacacctggccaagaccctgcctcttaaaagtaaggcaggagactatttcattcttctgagaaacaacatcaggtatagaaagactttcttttgagtcacattgactcttgttttaaagccttgcttgagcgccggctgatacatatcctgaccaatttctctagcctctctgagcttgttcttttatttgtaaatgtgcagctaatagtatttaacttgctaagtttataaaagaaacagtgtttatgaaatcataaaacagaggactttgtgctttgcaagtgctcaacgatgttttctaccttttaaaagtaccaaaaacacttgctaaaaaatgggcatggcagattgatttaaaacatttcctctttacaatgatctagatgtcctacccttaaacctaaatgagaaatggaaatgaagtaaaagggatgagatagataaattgctgtttttgttagaaggaatcaaagaattgtgtctgttacagccatagtagagagtactagtaacaaagccccattccatgtcagaatcatttggagaacttttaaaaaaatacatgttccaacttctgtttctcccagtatgtatgactcttcctgagcaaccctctagctaaaaatctggaaatgaaataagataaaataaaaactgaaagtaacacaacctcagaggccagaaataatgtttaagcaagatccagaagagtaggtcagcactaaagacagctttcagaaaacccagacatctacctagccaccatgtcctttaacttaagttctgataacctaattaggtgtaggagacaggagctaaatccaaggttttgtccaaggcgggaaccccgtaagtccatatgaaattgagacccccaaattgcaatagcctccatgtaaggataaattagaaggtaatctgtgctacagagggagaatgcaaggaaatatgcttatgttgacttggtttggggtagaagggagaaaaagctctccgctgaaaattcactaccacaggacagctttttttttttttgagactgagtctcgctctgtcacccaggctggatggagtgcagtggtacaatctcggctcactgcaagctccgcctcccgggttcacgccattttcctgcctcagcctcccgagtagctgagattacaggtgcccgcaaaaaatgcctggctaattttttgtatttttttagtagagacggggtttcaccatattagccaggacggtctcaatctgctgaccttgtgatccacccacctcagcctcccaaagtgctgggattacaggcgtgagccaccgcgcctggccaggacagctttaaaggaaatttgcagcctggatttacaatgatcagaacggcctgaaaaccatcaaccaaagagtgttctttagcatcatcttcaattgttggtacctgaggtaccttcctgctgtgtgtccatagtacctgtccttccttctcccccttgcctttagctccagtgactaaataccagggaagcctgagcctgggcctgtgttgcccttgagagattagatcgtatagttggccaaaacatttttcactaatatcagtgttacttcagccctttaagtaagcagagacccactgtggtatcaacagtctttggtcttgacttgcaggatacaagtgggaggggaaaataaaaaggaaaggaaaaaggagaactttttaatgccttacctgtatttagaatctgttctagtgacaacacctcccctgcccccacctgtcctcacaaaacctgtaaaaaacctaaagcaggtccactctgaactttagggaggaaggccaggcaatgtggatgaagagtatggtaatttacctaagattattagaatttttggtttgtcggcttgaatgtgtgtacctgttaccatggttctatcccagcctttctttaagtgccttgtttttgcacttcttggattcctttttataatgcagtgctaatccctttgctgggtcagcatcgagggcaaacaattgattttagaagtgctgtgccagttggtgtaatcccagaagcaaggtggcgtgtgtgacattgcatgctgagttgacatcttagccgacacacatcctttgctctttcgttacgtgcttgtaacaagttgcatgttttatgtgcatattcttggctaggctggcacaggtaagtgccacctagcccttcctgttcccagcctacatttgctgtttgagtggctgtggatttttctagcagatgacagtctttgttttgaaattttaaaaattcataaatgactttgttcattcttatccaccaaactcctagaattgtgcttggcaaatactaagcactcaaattttttgaatgattattattttgtttagactataattagggcccggaagatatgattgaaactaggtattagcttaaggagatgaggttgactaggcactagtgtcctaagctaaggctgaagaagagttcaggagtcgtgttgaccctttagttggcagtaaggcaagtgaggaacagaaaacgaacttctgtggtggtccagggccaatagattgggttctaggaaggcagcggtgggcagcagtggaagtttgaaggacctgcagactgattagtttctggccaaaatttaggagccattgttgacaggtatggaacgaaacatcctggaccctaagacctaaacaagtgatccttatctaggattggcaccaaggcattgtgtggagctggacggttcctaacacctgttattttataaaataaatattaggaaacccctattcattttgaatgtgttaatgaaagtgaactgctaatcacagttagcacttgtatcttttctactaaatgtgtgaaatgtgccttttagggaaatataatacacattttcattcttgtttaccttcttcatacgtagctggtttagaatcaactttccaaaacaaccctacctatcttctaggctgttgacagtgattgacagtgaacaacactaaaagaaggagaagccaggacaggacattgtatttcttcactgaattcctttccccttattagtcattgctgactctcctgtattcatttttcactgatcatcattcaccatttccatctcactgagtccaagtgtctctccatacatgtttgtcccttattaccctctactaatggaaggctacaaaagctaatttgttagagaagtgaatgaaatataatgtcatctataaatattagctctcttcttcactccctgttaataaaagcagtatatcatttcagagagaagaaaagaccaggacctatccatttgtaatcatactgtgcacacattcaattagccagaggggtaaagtgcatattagtaggcagcctgggagtttgctggagcaattaatcggctttgtcatctataagtaatagtttaaataactttctcttgctcccttgactgaaacagccaatcagattcaagcaatagatagcatccttaaccttcccaaaaatagacttaacactacaatgtttgtcttttcttattaaaagctctatgctatgtactagtttaccaggtatctatggggttttttgtttgtttgtttgtttgtttgttttgagacagagtcttgctctgtcgcccaggttggagtgcagtgatgcaatcttggcccactgcaacctctgcctcctgggttcaggcgattctcctgcctcaccctcctgcatagctgggactacaggtgcgcaccaccacacctggctaatttttttgtatttttaggagagacagggttttgccatgttggccaggctggtctcaaactcctgacctcaagtgatcctcccacctcggcctcccaaagtgctcagtttacaggcatgagccaccatgcccggcctctgtgagttttttaatggggagagcaaggggaggaaattttggtaataaccaaggatccgtgtcctgtgttccattttttaaaaagtagtacattattgtgtggtattaaattgttttttattttttttaggatttgactataaggaaagaaattccagtatgcaacatgatagcagaaataaacaagctgtcagattttggaaatgaatatgaatttcattttctttggtcctaatatcacataatgattgtttttatacaaaaataccatatggctaatgtggacccaatctcaacatttgtttgctgccttacacacacatttttatttatatttctttttttatatatggatcttcaagtgggatgccaagagagacgatatttttgaggaagtcagtgcacagtcaaagaggatatgaacccagtctaggtgttacatggtgccctaatattccgcttgcataagaagaaaccttttgtttgtggccttagttgtcaccaggagaccattgttaattttgcttaaaagctcttctgttgtgtttaggtggctttttaatataaaggaaagaaaaaaatgaagaacaagtttggccaaactcttaacatttggctctatcaggagtctcatctccgcttcgtagcctcaactaatcctccacagcctcttgccagagatttcttaagtcttaagacttataaagacgctggcaagaaactgcggtgcatcagcaggaacaggttgcaaaatgaagacaaagcctctggcaagacacaggaggattaatagaggccaggccatgaaatagagatgaagccccgaatggtgaaagatctctgaagtcacagtacagatacagaaccggtgttctgtcatttgggaaatcatatgggatgagccacggggcccagttggccaggggaacaattgggaattgcaggtcaggagcatcctttgccagaggaagttaaaagcttttagaactgggagtgctcagagatcccagaacaatctctagatgtaattcacacctctactctgataaggagtgtgagaccagatggaaaaccactactgggtcagagagtgaaaataaatcctagagaagatgccagaaagatttggctaagcactacttaatggaataaaattcgtgaccggggtactgactgtgttcctaatgttggattattttagccttgctctattagtagtcctcagctttgaacccagcctctctcccttcctgtctcttcccacatcccattgagtccccccttccctggagcttccccctcctgcttccctcccatgcccctgccccttccctgtcttctctctcttcctcccatttaaaatgttactttttctcaatagctttatcaaggactactttcctataatgttgagtaggaagttccccaaagaatagaaaaatctgctttaattccaacatctagttgcttcagaaacagctgggtaaattggacttacccaagttggacttagtaatgttgttctagtttatgcgatgggaacattttagttggggcttttgttcattcatcacatgcagctgggggaggaaatggcattatttaacttgtccatagtgtatctttaaatatgaaaaagaaatggaacctatgaatacaaataatcaggactctcatcctttctttagacttaaaaagagagaaaacaaagacttaaataaacatcttcaacaggtagtacaatgtaaaaagcctgtaaaacattgccacaaggatatatgccttgagtgcttcaatcacggggaatattcctcccatgttttactgcagttaattatggcagagcaccagcatggattttgtaccttaacctcacctgtgtcctccacccccccacagaaagaatgctttcctattgatgaatcattatgggggcacatcctctcttgtgtgtagggtaagaatgtgccaaaattaagacgtactggaattaagaaagccaaaatgaagtgtcacgttgagctaaggtgacaggttgtaccttgacctttataatgaattcacttaatttacttcttttagtcctctccgaatatgttcggccttgtattttaggatctgggtttctcatttcaaagcatttatcaattaattctgtaagaaaaggactcactttactgctgagaaacagttgcgatcttctctagtagttagaaaactcaattcagatcaccatcatcccacagcctattttattccatttagctacatatgtcaatcatgaatttttggaagaccctcatggatgagtaccaaataattcctgcaaatggttttctactttcttgtgtgagggtgggtgtctctggcaccttgggttagagagttgaattcatcatactggttagttgatagcacattatcatcaccaccagtcggtgcatggctttgcttttgttttcatctttttactttttcatcttccatctccactcttcccattcccattaacaatgttcttatttatttatatgcccttaaaaatatagtaggttgttttgtggcctttacataagagacgtttttcatttacataggtgatatactaaggttctcattctgtttcttatattcacttggctttatgcttttaagagctttccttttacatttaggttgttgaacctgattgccatgtggggttccatagcaggcatccaccacactcttctttccattcccatggtaataagcagcgcagttgtcttagcttgccagggtgaacatccttagagcactgccagattgcccttccggaaaggctgcgccagtttagaatcccaccagcagcacttgccaatgcttgtcctcctacatccttgccaatactttgtattacccaaatttatcatttttgccaatcattacgatatcttgctttaatttgtatttctctgattactggtaggctgatcattgtttatttgcttttatccatttaagcttccccttctatttttttaacctatttttacatttgtttcttatttgttggagttacttacatattgtgatactaatcttttatttgagtctttgttattatcttttccctataagttaccagtctgttcattttgtctgtaatgtccgtctttgaacagaaatccttattatttatcctacttaaatttttgtacctttctagagaaaaatgtaattttgtatttgcattaagctagaggctggcagtagatggtatgaaaatgtgatgtttaggccaagacctcagagaattctagaaccgttctgatctctgaaacaagcattgttgcagagtgaattttctgcaaaccttcgggagaagtataagcacaggggactcagcagttacccacagtatgtgccagggctagagtcatttgtggggaccctcctggctctttggcctatttttttttttcaacatacttaggacaaggtcatttcaaatgcccagataagtgcagagaaatcagtcattaaattctaactcagcctgaagtttcactcggtgggaaatttttgaatataaatgtcttgtgttaccatataatagtagtgacttatagttttagccaacctttattgaatgcttactatgtatcaggtatgttctaagagatgtacatttattatctcattcagtctatgcatcaaccttatcaggtagttatgacagaagtagtattttgaattcaccaaatcccatttcatattcctccattctggacacatagaaaacaatacctcgcagccccccgtatgggcctggaccttgcatgttaactaattcttgtcagtgatatacgagcagagttgacagtgtcactttcagtaaaaaagtttttttttaactttggttaaaaaaaaaaaacaaccttcttattaaaatcagattctgctgtcattcttttctatttttttttggccaacctggatcactgggtcattgaaaacaactgtcctagatggtcattcatgcacgtagctgactttccatgatttattgttgtaataagacactctcccattgatatagggaaagaggggcatttgttactgcagctttgcctaacctagcctaactaataaagtaagtaagtatggccaggcagggtggctcacgcctgtaatcccagcactttgggaggctgaggtgggtggatcatgaggtaaagagatcaagaccatcctggccaacatggtaaaaccccgtctctactaaaaatacaaaaaaaattagctgggcatgatggcacgtgcctgtggtcctagctactcgggaggctgaggcagaaggatcacttgaacccgagaggtagaggtcacagtgagctgagattgtgccactgcgctccagcctggcgacagagcaagactccgtctcaaaaataaaaataaaataaaaaataatttaagtactattattacccctactttacagatgaagaaagcacagggagattaacttgcccaagttccttacaatgtatgtctgataccagagcccaccatttgagcttcagtgaagctcttcctatgaaattaatatggtcttaagtctaagctcaattaggtcccaaaccttctgtagagtatggagtgaagctaagtaactttgcttgttttaattaaataatcattagcaatctatgatatttatatatatctcacttacagcaataatggatgagtagaaatttatttctcctaaagagcagtagaataatttggctagttctagaggagtaaatggcttttatcaatacttcagcttttaaaatattaaaaattctgttgctggcttgcttttcaaattagtttgttcaaattattccatttgtttaaatttttccgtggaaaaatcaagtaggaattaggaaggctttcgtgtaggactgacgttgaaagaaggataaaatcttcaaggctggaggggtttccaggtaaaggggcctacaatgagcaaatgcatttattttccagtatttgttgagcacccactatataccaatcacttttctgggtgcttggaatatgtatttgaacaatatagacacgaatctatgttttcatggtacctatattctagcaaaggtaggaaaggataggacagttatttgcaaagctgccaagttgccacagaggaaataaagctcaaagataaataggtacccttgggaacctgaatgccagcctgaggaatttgtgtgtaattcagcaagaaatagagagccaggagacttctgcaaaggggtgaggtaccatgatccgagctgtggcctaagactctccattagacaaacagaattcggaatattagagtgatcaggaatggagaattaaatatcgactacaattgtccataccttttctgaggcttagtttttcttccgggttcttgatggtggtgatgatgttactgactgatgaggtggtgagcggaggctgaaaccccaccagtgctccactcacccagctgctcttctggccaagtcttgtgtctttccttcggcacattcctctatccagaggaaggggcatctgtttgtcgcctatcttccaggggtgacatcttttataaattgcacaaagattctttatatgcctgcagcagccttgattaaatggcagcactaggatttgaccccagtcctacctaactacgaacgctgtgtgattttgccagtgtttactactcttacaacattatttgccactactcttacaagtccttgccagtgtttagtaccattacaacaactactccccctactattgctgctgctattatgaaggaggagagggaaagaatagcatctgacattctttgagtgctggctgtgtgccaagcacagtattcagttatttacatgcattatttcatttaatcatcacagtctccctgtgaggtaggtactgttactatgttgccaagtgacagaataggaattgaagccagtcgttcagactccaagtctgaggacttaaccactacactagtatcttccctgaatacttaaggatgaaatatcttagaaaacaaaactgctgctctattagaagtcacataaaactacaaaaattatttaaagcaacaaacttgaggccaggtgcagtggctcacacctgtaatcccagcactttgggaggccaaggtgggagaattgcttgagctcaggagttcaagaccagcctgggcaacatagcaagacctcgtctctagtttaaaaaaaaaaaaaaaatcctaggatgatgcttctgggaaaaacagcagcagcaacaacaacaacaacattagctaggagtgatggcgtgcacctatagtcccagctactcgggaggctgaggtgggaaaatcacctgagcccagggattcttgattgcaccactgcacaccagcctggatgacagcaagaccctgtctcaaaaaataaataaaaataaagcatccaacttgagcaaggaatagcatcaatccagtaccttgtcatagcaggtgctcaaaaaatatttaacttgattttcacagataaacattttgaacattggtacttgaggggaaaaaaaataaggctaaatcagagaatatgattaaaataaatatttttgtgaacattttgatggttatttctggatacctccaaaggattttaagtttgattggatagcctgttaatcagatctaatctcacttctttttttaaaatacaggtatgtctagttcactgttaattactggtgtgcttctctgtaacttaggaccctcaatttttttgttgtttttatttttgtttcattttgtttctgtccttcacaaatagaaaaaagagagagaatacatacatacaaagagagaatacatatttcctaagcatttcatcaaaaattgtgagggaggagggtgttaaaggctgtgtgtgtgtgtgtgtgtgtgtgtgtgtgtgtgtgtacacatgcgcacacacttttgagaatggggttgatcacctgcagcagatttcactgagcagtgttaggaagatactttcaggcaggtcgttagctcctggtactgctttctagggttaatgcaggtgcaggacagcctggctgcagtcagagtgacctggagtgggacagagggatcccagctcaagatgttgtgtctgtatcaggctgtttatatttatgaaatgtttcctaactggatattgctataaaagaaaaaagaaagctagattattgagtttaatttgtaagctctgtaggacagtggttttgagacctttaaattttgtattgttgtttatttgcagaaagattctaaccctagtttgcacaacttagaatcagaacccagcctgatgggactgcctgctgacccagtctttcccacctccagaaggggtgccctgaggcactgcctctaggcaaattcttcctttattgtacctttcctacaatttgtttttttcctttcttccttccctccttttctccttcatttcccctttccctccctccctcccttcctctttctttctttcctttcttttctttcctttctcttgcacatctgcatgagtgctcgcccttttctcatatttttcagataatcatgtaagttcctgaacagttctagcttgctaacagttgtggcctctgagtacatacataggatttcacaaatcttcctaggtgagcaggggctctggagttgccaggtggggagatgaaatggtaacctatgacatgtatctaaatgccccagtccctggtgaacaattgtaggattcacccgtctttcttctttgttccttggtgccctttctccttggaaattggaagcatgggcaagttgttctagtcccaactctgccttcaggcttggtgttctcaggcaagtctgaatgtggctgggcctcagttgcctgaaatgtacagtgaggctaaattaggtctgagggtccctagcaaattatttgcaacaatacaacttttgatattcatggccagctcacttattcacagttgctgtcattcctcatttccacagcttagagaccctttactaaagggtctaaaggtgggcaagctaggagtatgtgtccatagcggaagtcaacatctctctcagtcccctgattcttccttagagtggggtggagtgggaatgatgattatttggtttacctctgaggtcatgttttctatagtagctgcactgggtggagaaggttatgattacctattagcaatctgctaggattgtcatcttacaaattggaggtgggaactttgacgataatagagactttggactttagcctgatcttcagattccctgtggaaggtgtggcctgaggaaaaagggttaccttgataaggaacagtaataatttttatatttctggacactgaattataagcattgccaactgagagggaggaggggaggcctgccagatcagtagactgtgacgtatatgctctaagtgtatggttttgttgtcatgttactcatccattcaacatgcattcactggacacccatgtgtcagacactcgtccagccattgagagttctgtattcctcagggctgaagactgtatgttttttcttagatatttggcctgcagttagtttcctgccattaggagacagtgattttgttgatcaagctatagaattcaatcctagggattgagatatagacatgttttacctgggagggagattttcctttttggaaataaaattatttagtaaaataatcttaaactctaaggttagatattaatattttaaataattaatatagagagaaatctaaaagaaagcaaaggtctagatataattaggtaccttactcacatactcttaactgttctaattgttaacctgtgattccattcccattgtgtgtaaaagaggaactctccattctttttgcacttccttccttgaatgtagaagtccttaggcttatatatggctcactggcactgtggcttcccttaaatcttttcatcctttcaatacttggcctcttgaaaaagaacagcctgcaagggaaggcctgtcctccctggttctcctccctgctttcctgccttttattaatttataaggtattcagtacctattatgtgcctgggatggagcctggtcctataacttggagaataaataggaaagacacgtttgtgccgtgagctgctcacaatctagggagggaaaacaacatatgaagtgctaaattatgctacactactgcaagttttgaatgtggtgtaccagaagaatagaagagagtgcttgtaacttcctgaaaggctagggtgtagagttttcatcgaggtatggtgatggttgagctaagtattaaagaaggccttagagtctttcatttggcaaaggtggtaccaggagatagtatttcaccttcacaactcaagagaaagatgccaaaagcatgtgctccagggattttggttttcaatgaaaaaagaatcattttctgtttttccccttcagagagaaagcattataaaatgcaggagaaaggaaaagcgagggcaaacaagcctccctcatccaaatagtgccaatggaaggtcctggattaggtgttccatgaaactgaagtacagtagcaaagctgtcatgaaatacttttggccagtcccttaaaaatgaatctccaaaagaatagtgggtaagagtgcttcctcagggcagatttcttgaaatgattatatttcttctaaacaaaacattttaaacatttgaggagaacacttaacagaaattttggaacagaaaaataaagttatttcatcccagtgttaactcttaattccttatgcaagtaaaggccagtggtaaagacaattcaaatatttgaaatctgatttcagaatgtaatctatatgatttggttctttaagtgtatcatatacttttcttggatcattaaaatgagtttgtattccctgagcaaatagttgccaaaaacagaggggacacagaatttcatctgtcatcctgatttcgcattggttcccaaaaaagagagctgtcagttaggttttgaaaactctagactccaagagatcaactgctgtcttcatgttgagttagttgggacttaaaaataattttttgattgagagttttcaagcatacatagaacaagagaacatagtataatggaccgcagatagtcattcttagtatttaataacatttggtcatacttatccatgtatagttccttccttattatcttttttttttttttttttgagaaagagtttcgctcttgttgcccaggctggagtacagtggcgtgatctcggcgcactgcaacttccacctcctgggttcaagcaattctcctgcctcagcctcccgagtagctgggattacaggcatctgccaccacgcccagctaattttttgtatttttagtagagacagggtttcaccatgttcaccaggctggtcttgaactcctgacctcaggtgatccactcatcttggcctcccaaagtgctgggattacaggcatgagccattgtgcccggactctgccttcttttctttcttcctttctttttctttggaaggggtcctataatattatattaaatccaatcacagacattgtcatttcacttaaaagattcccatatgtcttaaaaaaatatagaaaaattttgtatcacaatactgatattatatataacaaaattaccagtaattctttactgccatttaactcagtctacatttagatttcctcatttgtctcaagtgtctttttatagtggttggtttgttcaaatcaggattcaaatagtctatagcattagatttttttttcccataagtctcttaatctagaacagtcctcaccctcttgctgtttttcttccctgtaaaattgacttgttgacaaaaccaaatcagttgtccagcagaatgtcctatattctagaagttcctgcctactttctcatggtggtatttaacttattctatcctctgtatttcctgttagttggaatagcttgagatatttgcaaattattttggccattttttaaggaaatataaacattttacaaatttcatttcagccattcatttattcagcatttgagtgcctcctatgcaccaggcactgttctaggttctaggttcattgggctatgctttgttttcctagcaattcttttgttctagaggaactgcacacttgttttttaatttaggttttttcatccataatacattctcatggttcaaaccttagtaattataaaagagatgtagtgaagtctctcttttaccctctccctcatcagaccaagtcccagataattacattttaagtttcttatatcctttggaatttttttcctacatttatcagataatatgagcgtgtattctaaaaatataatatttctagtttatctttagcatcaacattaaaagtagttttttaggccagagtcacttgataagtatatattctttttatccttgaaactaatccttccttatctcctgctcccgaccccctcatttttgggcaaatgatagtagttcaatttttaatgtaaaatagtagagatttttattctagaaaacattgtccagtatcaggtgacacttaacaatgttattgacaatgctgttaaaatgagaagtattagaactgtgttcctgaaatcataaaatcttactgagggtaattcttagatcttttaatttgagctacagcccaagaggcttaccaaaaggtgctaggcaattattaatcttttatggctgggtacagtggctcacacctgtaatcccagcactttgggaggccaaggtgggtggatcatttgagcccagccaggagtttgagaccagcctgggcaacatagtgagaccctgtctctacaaacaaaaaatacaaatattagctgggtgtggtggcacgcacctgtggtcccagctattcaggacgctgaggtatgaggatcacttgagcccaggacatggaggttgctgtgagcccagatcatgctactggactccacctgggtgacagaacgagaccctgtctcaaaaaaaaaaaaaattaaaaaattattaagcttttatatggagatgtctatttggggatctggtaagaaactgaacactaaagaagctaccaagaactcagtggatactatataggagctttcttgatctacagcggtagtttgcataagaaatagaggcgtttgcctacctttttgagacatacatgcaaattgttagaagtaatggaatttcagtaacttaatatatgagtaacatagagcatttagtgagaccaagggtgggaatgctgtattatattgagaaaagggggagtatataatattaataaggaatataattaatttcttgccagatcagacctaattaacttctactaattatttaaattttgctttactttattaaaatatgcttatatcccatttctttttaaaaaattgaacttaagatgtatattataggattaaaaaatagtaatagatatggaacatcagaattaaaatacatttttggtttatttatatgtctaatgtaagcactctaagtttttattattgttgtttctttcttcctttactggaactcatgcttggttctatcattgattgcttggatataaaaagccactttttttatctgtaaaaggaaaccaggagatgaaatttacttggttttctatgttttttaaaagtactctagaaatggagaagatccattactagaactttaacttgctttaaaaaaaaaaaaaacagcactttttattttgaaataaaggcaggaagttagcagaaatggtgcagagtcttatgcatccttcatctggctccctcattggtgatattttatatggctgccgtgcaataatcagaatcaggaaattgacattggcatgttactgctaactagactagaccttagtcagttttcatcatctttttaacctgcattcacatgtgtgtatgtatatgtgtgtgtgtgtgtagcttagtgcaatttaatctgatatatagattcatgtaaacaccaccacaatcatgatacagaactgttctatcaccacaaaagaagtctcttgtgctgcctctttgtatttgcattatatttaggtatttctttttattttttgagagcaaataaaaatgatattacatttttaattttgatttccatgtgttcattgctggtatatagtaatacgattaacttttgtgtgttgattttgtgtccaacaatcttgttgaccttgtgttcatgagaatagttctgtgagtgtttttatagattccttggaattttctttgtagacaatcatgtcttacacaaataagggccgttttattttttcctttctgatatacgtatgccttttttcttgcttcattgcattggctaggacttccaataccattttgaataagagtggtgacagcagacaattcttgccttgttcccaatcctaggtggggaaacatttagtttttgtcattaagtattatgtttgctgtaagatttttgttgatgttctttatcagcttgggtaagttcctctctattcctagtttgctgaagttttttttttttaatcacaaattgtgttggattttgtgaaatgcttcttctgataatgcttatgcaatttggcaagtgaaatttttcctgtgactgttgccctccccaagcactccttgcaggccccatattgccatgcttaaatatgataaaaggagaaagattccagagaaagcaatttgggatatgaattcatattattgttaattctacatcaatgaatgtcaagcagaatttattatatactgctaactagactagaccttagtcagttttcaccatctttttcactgcatttacttctgcgtgtgtgtttgtgtgtagctttgtacaatttaatccaatatatagattcatgtaaggttctggattttgtagtttttctcctttcatagtaatatttattgaggtaggtagagagcaagggattaggagtgtgcactttggaaccagactttgttctaatgtggcctttatcatttactagttatgtgggaccttaagcaaactctttaacttgtctaagcctcagtttcctcaactttaaaatagggctaagaaccatctaatgttgtcaagattaaatgagataatgtatgtaagaggcttcatacttatgggcatttaatatgtgttagctgttgttgatgcagcactgatatgtttaacaatttattaaactctcttacattcaaagcattctgctgggcatttgggatgacacagggttatatgaagtacataattcattttagaagaatgtgctatttaattttcaaacatctcgttgtttgaataaatgaatgaaaacttttttatcttgcatccatccaagaccatcagtctttggtttttacccttccactccttccctttgtcatttatttttctctttctctctcctacccatttccctctgtctttctcactccctgttttttaggtaataatcaagctgtcataggtgaaccagtttctgcccctctgcttctttctgctctcatgggagttcctcctttcctttctccctcattttactttttcaggttttcatagttaccctgtaactgtattttaagccagctttccctttaatgttttccatttccttgaggaacctcagggtagccccactcatgttttactctcctgtttctgagccaaaaggaccatgatcttgactaagctctctcagagacacctgaatccaaagtaatgctaattttgaaatcaatgacattaacctctaaaagctttgatggtgcccagaattatttaatagaatcttcactaaattttccacttctctcttaattttcttctaattaaactttattttcttcaaataacagcatcatgataagttaaaagctttgacttaatttttgtttaattgccatattttaaaagaacttatttctattattttctcagtgcaaatgtacagtatttctgccactttatgaatttttaagaagttttcatgtgttgtcctaagaacctagcctcctttacaatattatttctagaggaaaatgcattctgtaaactcctaacaaataagccaactctagtgactccttttgttggtaaattgggtacttcttgtactaaatgttccaactggtagaggattgcaatttttgcaggtattttagagaaccaaaccagcctgtaattgcagtatttagttcatcttccttggaatgaaaaccatctaattagagttgccatgacaactctgttttcatgcagtataacagacctattgatctgaagttcaggttgatggagcatgtgtacgtgttagtgacagaagccaacatccaatatcgtacagagtgttggctccatttccctcctagcttattttctaccttatgcactcacaagtatttattaagcacctactgtgtagagagctcagagaagcccatgaaatattcaccataagaagaaagaaacagttataaaaccctatcgtggatgtagaataaaaccccagtaacttaccctctccttcataatctggccttttcctggacatttgactctttcttctcccacctccccgatacccaccactttggccacactggcccctttctgtgtttcaaacacttcagcctcatttccacctcagggcttttgtacttcacattcgctctgccagaaggtcatttctccacctctttacatgtttggctccactttatcatttgagtctcagtttaaatttatttccacagagaggctttccccgattgccctaaagttgccacctgccgtctgccctcatccattgtcatgctctttgacattatgatatttctgtttctttcttatattattattgcattgtctcttattagcatatacttttctatgagagtaggatatggcagtgtcttgtttactgtcatatctgttaatatttgttgaatgaatgagtcatagagtgattgaatatcataatggtcaagaaaagtttcataaattggcactgatttaagtgctttggaagacagtggatatggctgggcagaaataatgctcagaggcattttatgtgtgaggaacaatctatactcaaaagtactgtatgggtcagtttgttcaacaagagcatttctgagcatccagttgaactgtaaggaagggaccacttggagagtgattctttaattttcacagtagccctgcgaacctaattattatccccatttcatagataagcaaactgaggcttagggatgttttaaacaacttgccccaggggcagtatactaagtgatgaaactgaatttcaactctacattgccagtccaatttcagagcaagggtgcttaaccacctcatttttctggttcattcacacttcagcttaatttttttaaagtttttatgtcatatcatgccatatatctccatgcttttacttgggatgctgactttcctactagaagtaaattgcttgatgttcagtctataggtatttattgcttgcctactgtgtgcaaggcattatcacatattaacagcattaattgaaaaaaatcacctagccagttacagtgttcgagaaaactaaactcattgaactcatattttctttcttaaaattctctgtatcatataacagtggatctaatataaacataaaaatttaaagggtagtttacagggatttttgtgtaactttttatgttgatatttaaacttaaaagagaaaaagttgcaagaatagaacaaggaactgtcttattccttttacacagattccctaattgtttacattttgccccatttgccttatgtatttattctctatgtacttacatttttgtatctgctcatttttttcctaaactatttgagagtaaattggggccacattgtacttcacccctaaatgtttcagaatgtatttcctaagaacatggacattctcttatataaccacagtgcagttatcaaatcaggcagtgtatcattgacacagtactattatctaatccacagtccatattctaattgtgtcagttgtttcactaataaccctgttagctattttttaccctggaccaggatccaagccagatcacacattgtctttagctgttatatctctttattttttaaatccggaacagtttcttaatctttatctttcttgaccttgacatttttgaagagtacatatcagtcatcttgttccttaatttgggttcatttgatgcttcctcataatcggatttatatgtgtgacatgatgtgtctgtcctgagtataacatatcaaaagtcacatgatgtcagtttgtcccgggattggtgatgttgactttgatcacctggttaagtggtgtctctgtggtttctgcactctaatgttactagttttctctttaataagaactccgtggagtgatgtgttgagactatgtaaatgtcttcctcagactttcacccactagttttgacagccattgatgattcttcagctgcatctttcttactacgtttattagttggctttctactgtaaagaagagctttcctcatttatttatttatccattaacatatgtgtttcagaggggatttattgattctgttttattcaatgggacacacaccattactgtcattattttgctgcataaacaaagcctcatttcatcatgtttccatcaaaaaacagttgtattttgaatgctatattagatttctactgttgctgtaacaaattaccacaaatttagcagcttaaacccatgccaattgattatcttacacttctgtagaacagaagtccagtgcagagctcctgcggctacagtcaaggtgccagtgggccgcattcctttctggagactctagtggagaatctgtttccttactctttcaggttgttcagagagttcagtcccttgcagtcacagaactgagatctggtcctttgcggaggtcagttgagcttctagaggctgctgtccttatttggctcatagcccccttcctccttcaagccagcaatggcaagtccagtccctctcatgcttcaagtttttcctgcctcttcttctgtcatcatatttctctgactcactcctctgttttcctcttctacttttaaggactcgtgtgtctagatggattgagagcccaaccagataattcatgataatctcctcatgtcggggtccttaacctttattacatctcaccaaagtccctttagccatgtagggtaaaaaattcatagcttccagaaatgagggtttggcagctttggggagccatcattctgcctaccacaaatgcctacctgtgttcaaggcttgtgctaggagcttacttctttctgtttaatcagaaaaaaaaaaaaccgggtagaggattacaagcaaagaagcttcagtgagaaattgctttatgtttagttaaaagaaataggcttgtaatcaagagtgggggctgaagagatgatgttgtcgtaacagagcctcaaaaatagtgcttgaaggttgcttgagccgctgcggagccaagcaagcacgtagggtttaatgctcaagtgtccctgctgcaaaatgaagctgtgctgctgctggctgcagggactttggtgagaaaaatcagggccggtgagaaaaaatgatactggatgagttgtggctcagtgctgctgtttcctgaattttgtccctcacttgtctcagcacctgggcctgtttctgacgacgtgctttcactagctagtcactatttcttcttcattttgtaccaaacaagtttgtgtggtaagattggatcttttgatgttatacacaccagcaaaacgaactgattgtcgaagcccagctggtctgtggtgggaggcagtgtgtagcgcagcagcggaatgtgtgggttcagaaatcggatggcctggttcagtcctgtgtccgtcatttactggatgagttcttttgagtcagttacttaacctcccaagccttactgctatttgtacaatatatcaaccttacagggcttttgtaagggttaaataaagataaataaaagaagctcttaatataatgcctggctcatggaaaatgttcattatgtgttagctgctattgatgttcttctaaatagtagtagattttagatcaataacatagagttccatagtctttgggaattaaaaaagctcaacttcacaatcaaactgtgttcttatataccttagtgcctctctctctctctctccatctctatgtctgtctctatctctgtctctcgtattacaaaagtaatatgtgtcagttatagctttccaataccaaccaaaaaaaaaataaataaaacaaggatacaactgggtgtggtgggtcacacctgtaatcacagtactttgggaggccaaggcaggcagtctgcttaatcccaggagtttgagaccagcctgggcaacataggaagaccttgcttcaacaaaaaatacaaaaattagccaggtgtgatgcttgtagtcccagctacttaggacgctgaggtaggaggatcacttgagccccagaggtcaaggctgcagtgagctgtgatggtgccactgcactctggtctgggtgacagaggaagaccctgtcaaaaaaaagaacaactatacaaaatgcaacgtgatcatgtgtcttactgtaatactcccttcctctgcaagatgatctcgtcgattcccaagtgggaagtgaagtaaaaaactcctcacttggatttccctcagttaacctaggtgtctctcctttcaccaccgctgcttctctctctctttcccttttttcctctctctctctctctctctccactgagacccaaggaaaacctctgggacaccaggcagtcccttttccctctaaacttctcccctttctgcttttgtttctttccattcctgtctgagggatgtgctcatccggtgccacatccttcttcttccctgtgctggcatttctctgacttgggtggtgccaccctcttccttgggacagtgggcctcaagtcttagcctcagtgaaagtgcaggggggaaacatgatttactgagaaacacgaagtacgtcgatttagtatgtttgcagtgttgccctattaaatcagtttggggtatttatttatttagttgttgttgttgttgttgctttaatttagccacaaaaaaatgtatgacatattacatactattctgcagcttgcatttttcctatccaatatatcatggccatttgtctgaatggaaataatgaatgtattttttaagtggccctcagaacctgaaggctgctatcttcctggtggctgtatggtactccactggaagactttgctataatgtgttcagctcccctgttgttgattgaaatttgtcgtttacatttgtgatttggttctactcatatgaacttgtcatttattctctccagtgtttgtcttcagtccttcgcctgcctaggaggcagaagtcactcagaatatgcccaatctctgtttcaagtctagagttgggttggtgtgtttgttgttcaggcaatgagcatgcctgcagcttaacagtttcagaatgtgatgggagcgaacttaagggctcgccttgctccagagtgaccctgatcccaagttggttcctaatgaaatgaggaaacatccagaaaagcaagttgtcctgagttagccccagactgtattgagaagcagtcttggtcttgttgggaaagggaggtgctgatgtgagcctggggccccatcgaatggccggaagctctgtggtggaccttacatattctcatgctcagcacttgccggatggcccagaagttgtgaacccttccctgccctctcctctaagactctaaatgcctacacagggttctgtggaagtgttatttttggagagtactaggaatcctgagagttaagagtgtcttgaactgaatccttacaccaagaggcctagattgatggagagcccaaccagagaattcaagataatctcctcatgtcggggtccttaacctttatcacatctcaccgaagtcccatttgccatacagggtaaaacagtcatagcttccagaagtgaagctatgaatattcaacatgtgattccacgtgagtctgagcgaaactactttcggcccattgatgccatggatgcagtattgataccttcacatgctgcaggggcaggagataatagctatgggccagccatacaacttttctcataagtcatgtttgcattcccctttgtgctattaatactgctctattagtacatgtttagtgttttggttttgaagccttaagaaaacagtagcaatccaaattctcaagcaaccaagaaagtggtttccaaaaaagttattaggccaacctcaattatatttggccaattaaattggcattgtccttgtctacagttcccagaaccccttctcttcctgactaaatctttccctttctgttgtgtcttgtgtcactggtttaaagaaagcaaacacatccatcttctggagttatcaggcgcctcagtacaggttcccctgagttctaggcagcctggaccatgaggcaccctggccctgcttccccgcaggcccgccccgcactctgtctggggaagtgtgggcccttgttactattgtggctgttttgaatcatctattttagagaattggctaaaaatagtatttaaattagtggatattttttaaaagtaaaagatgcaggtaaataaattatgttatttagaaatagattcctagttttgcacagatggatattaacagaactgaactcccacttccctgttattaagtaaacaggatatttagtaagatcaaatgtttttgaaatgatagcaatctactgaatatatcttatttttgttaaaacactaaccacacttatagcctcctcaattccctcttcccagtctgctccagaaaatggttcctcctgctttccagctggtttggggagcacactgcagagggggacagtgcccccatccagtgtctgtgtcctgctccccatgctcacctttgtggacatttcctggggcagtagctggcaccagggccaggcacccgggcttggcacctgagctgcatcagcagaatggggaggagagagggtccttacaagcaagcacctgcctacagccccttaaactggctctgcccttcttcccttcattgttcaccgccttgacttgatcgtactctctgcttattgggcagctgtggtgggagtgagagtagaggtctccagaggggacaggaagatcaatgggcaactggaatgacaccaataactcggctcttcaaggtagaactggggccaggctgaatgttgccaaaattagaagagcagcaactttacctattaactgaggtctttaacttctgaggatagaagattccttctgtatggttgaaacagcatttctcaggggtggggcagtcaggtagtctgtccttttagtccatatcagaaccagctatgagcttttttccttcttttcaaataacacatttctccaccctgagattccaatatgctatgctagaacaagggtgggagaaaaggtatgtctcctcccaccccttcctctctccccaagagaaatctctgaagggaggtcacactactttggtgttcagggacagatacacttctactcactgcttgtatatgcaacagatgatgttgaagaagaggctatttcccacattaaccaaagtggcacatgactccatgtgaaccaaaccaaaacaacaaaaatacttaccttcaaacagtttaatttacccagttaatcacaaaagattaaaaaattgctaaatcagaaattctctacctgtaactgatgttttcattgatgatgaatattagaaacattaactatatcacatactccctgaggacatagagtggtgacttgcaaatgttttggtttggaattgtggcaccttattgttgtccctaaatggtttacatattgcacacatttttaatttaaaaacaagaaacaaaacaaccactttaatttcacgcaagcccttttgtgataactgcagacatgagtgtcatagagccagacccctgacttgctgccagtaaaatgaatgtgtctttaaaatttttgcaaacaaatttagtcttaactcttctctggcttactaaattgtgggatgcttcgtacttcagtttgcggtacttgagctttagaagcgtgcctgaatggtgctcaagacactgctgtgggcctctgctgacaatgcaagctctcacaaaactgaacgtttggcccatttaccataaagaagcaaacagtccccatcctaaggacaggcctagcctaaggttaacagtaagagcaacattttgttgcttcattttcctattaagctctgggttgctgattgaagcagaattccaatgttttgacacaccaccacattgttagcacgatagggaggatttgattatgggagaacaagtccaaaaacggtaaattgacaaaaaaaaaaaaaaaaaaaaaaatctggggccctgtttctcaaggcagcttttgtggttgcattcctttatttgatgtggttctttccttctcctgtgccaaacggtgcaatgtggaaaaatgatgaagttgcaaaaaaaggagagtggatagggagtgaactgtttagtaacaagagaaagaaaacagagcttagggatcaaagacaaaaatacctgtttctccaagtaggaagaagaaaattaactcaggggttctttcctgaagcctggataaaggctgagccctgctctcagctggtgctgcttaggccaacccgggctgatcgcagtagagacagggcagccacaagctgtctgtaggtgagaagagcagcagctagagaaagggcaaggctgagtgctatgggttcccaaagacagtcgggctaacaagggtgggcgccagggaggaaggatggagagcaaaggctgccttcagcatcagactgaacacggttaacaccagccagccctgcaggcatcagaatccagaggaggaagcatcagaatcgaaaggaggaagaggcttccatgcaggaacaggattttatttatttacaatttgaaggctggatagcttctctattgtgtggtttatgacattttctgagtgttaaaattatctctttttgcactgtgaaaagagcatatatgattcatgttaatatttctgaggatcagtcaccaactaacagctagtattttgggtgggaggaaggcttttgtaggcagctttttcacctaacatagaagttaaaaagcaccagaatatgcctcaagcttcgttcaaaatcatataaatagctccctcttgcacagttacaatctagtatggttgtgagaactcccacagtccacgagttgcctaatgctcacctcacccttgcctgaaaaaagctaattcctgtggtttacctgctgatggaatatagcttctaagaagtttgaccaaagggcctcttttcatttttgctaataacctattctaggggggtggggtttgcctatatttcttcctggatacttttcgtactttcagcatctgtagaactgtcaaatatttctataatcctagatcaagagtcagcaaactaaaacctcctggccaaatccagcccacagctaagaatgacttttacattttttaaatggttagaaaaatatttaaataataatgtttcatgactcgtaaaaattacatgaaacttgaattttagtatccataaacaaaatgttgttggaacacagccgtgctcattcatttacatattatctgcggctgcctttgcacttcagcaggagagctaagtagctgcaatacaggcattatggatgcaaagatgacaatatttactacctggccttttactgaaaaagtttgccaatccctttccaagaccgttaaactcttcttttccataatgactatttccataaagatatatacatttattggcttttaatgttcatttagaaatttgacttccatctcttttttatattcattggactttaatactacaaatattttttaagtgtctaatatgcttggcattattcttgctaagaataatgaggttataaaagtgaacaaaacagaggcagatcctcattctggaggagattatattctagtgaggagtcatggggggagatgatgagtgaatacgtgtagaatgtcttatgccacggagaaaacgacaacacagaagaccaagtaccagagatggaaggggcttatcttaaatagatggttcaggaagcctcactcagaagctgacatttgagtaagacctgaagcaggtgaagaagcccgccccgcaaatggctgggaagagttccaggcagagagaacagcaggagaactgggccagtgccctgaggtgaaattgccccagcttatccagggaggttttagccccagtgagaagttcagtaggttctgagccctgctctcagtgggcgcctcttaggccaaccaggccaattgactatggggtgtgagagaaaggagtcagcaatgacagaggtttttggtctgggaaccaagagatagaagctgccattttctgagatgaggtggatatgggagtaggttttgggggcagggttgcttgtgagcaggttgagttacaagttctgagttcaagaaaggcctgagccagacagataacatttagaatttgttagtttaaaggagaaatttcagcagtgaacctggctgagattcaatctcaaagcccagatttttttttttaatctccagaacatctctcactttacaactaaacagaactttttatttttttaacctcacgttttctttcctttgcagttcaccattggcatcgcatcaggatctatccctgttcttgcttcctctctaggtagatacccctcaccagtaggcaccctgggcagcctgaaatatgaaatatgcctttctcaatgggcaaaaagctgctcggtgtggtgcaggacgcatggtctgctgtccacattgagaacctggcctcggatccattgccctgccttgttaagtagtgtctgtgtcctcgttacttccagcctcagttttgatttgactgcttccttgccttgccttctgtttacctgaatataaccacactcattttacccatgtgtacatctggcagaaaccaccttttttctggtagtttcaataaatgtcttatctcccatactaggccttaagagcagacctgtgttttccttaccttcctgttgtccacagtgcctttcaagtagtcagtgatcccatgccacggggatgggaggcacatttgcattgaccacaccccttcccattccagccctggccgtgcatcattgcatgaggtctagagcagtattttttcaaactgtggtgtgaggaccacctgcatccactaaggaacaggttagcatgcacattcccaggtctcacctccgacctgctgaataaacctagtaaattgccttctttggggtgggatctgggtatctgagtttttaacaagccctcccaccccctccagattattcttaagcaaatatgaaaactccaggtacagagaaagattacaattccagtttcactgtttccagcttggacaaatcatccatctcaagcctcaggtttctttcttctctctacaatgagtatgttgacacttgctacctgttttgtaaaggtgttgtaaaaactcaagcaaggagcactttggaaacctgtgctaatctcatcttctggtatcttttcattttcatgtggaggtcaagctttagctacctacagattgacttcttgaacacagagaccagtgatgtgcacgtgaagttacctagtgctatttatgtgcctgaacttttagtaaataccaggtaatagaaatcaggtagatacccttctgtgtcctggaaaggcagaaggcttttttcttgttctctacatctttcttggaccatcattaaaacatgtgtgcagtgagaaagaaggagttagaaaaatgtttgtaggttagtctaggataactattgtatgcactgtttttttttccagggaaaatattttaaaggtaattcataggaaaagtgatctgtacctatttaagagcagtaaagccattcattggagttttataacaaactcatagtaaattcactcactcctgacctctggcttttgaaaatagtttcacttcttaaagaaactgtaatgcaatcaacagcaggtagtaggcctggaatcaagatgcaacaagagaaaaaaaaaacttttcttccccttacccttttcgtgtcttgagtgactgggcatcattacaagtagttcataccaactcttagtagaacaacatctgctaagtctgttattgttttggggggcttacttaaaatacttttccacatgctaagaaaatcctgatggtggacatctgttaagattactgccctcttaaaggcttgtttgagatgttaacaaacttacaaaacacatttctgaacaaagacttggttagggttcatgccattagacatactctgtttgcaattacaatagtctcatctttcatattttttaaatgtaaagttctttgcttgcattccaccttctttctactggaaagtgtccatcaagtcctctggccctgaactaatcacttcagttcaggtaccaaaataagtttaataaatattcctggaaacaccctcaaggacttggccagcccaggcatctactaaaacacccaagtcacatgtggaaccagatgtcaagtatgcagataaggacatagaagtcacaaaagtgataaccagagacctaagagtggggtagatttaagtgagagaaacctggagttcgatgcctctttgtcatttaccacctatatgaccttagagaggttctatagcttctctgaagttcccgtgctctcatctgtaagatgggataacacttctctcataggttgatatgaagaatagatgatatcatagaggaaaagcacttaatacaggacatgatgcattagtgcttagtaaatggagttattattcactactctgttctgtggagaattcatttaccaactaaattcctcttaatgccttttaaactcttctcatttatactgtgcctcatcagagaacagctgatcaaaattatccatatagtagtatgccttctttttttctttttttttttttgagacagagtcttgctctgtcacccaagctggagtacagtggcacaatctcatctcactgcaacctctgcctcccaggttcaagtgattcttctgcctcagcctcccaagtagctggaactacaggtgtgcaccaccacacacctggctagtttttgtatttttagtagagacggggtttcaccatgttgaccaggctggtctcaaactcctgatctcaagtggtccacctgccttggcctcccaaagtgctgggattacaggcatgagccactgcacccggcccatatttttaattactccatttaataatggtgtatttttaaagttatttaacttagccatttcaacttttttagactttgctccaaggaggaatgttttctgagtgcttaatcatagttgtcattgtctcaacatttccatttttatatgtccctttaaaagtgagaaacaaaaagtggaatacagtactctcacagagtccttacttacagctataaagtgtgtttagtagaaatattagattagtcacaaatgtaatacagccaggtctgaattgatgcttccatgagcctctgattccatgtgaatacccagattttcttccactggtgtacttaactcgtctttctgatctccttttattttcttgtcctattgtactcacttaaattttctccatattgaattacaccctgattttgtttaactgaaggactgacactcttgagatggctcaaagttgaatctataaaatgagttgagagctaacaacaggtctagaaaatgctttgctagaaaaaaaagatttagctagaaaacagaacaagtccgggcgtgatggctcacgcctgtaaacccagcactttgggaggccaaggcagcagatcacttgagcctaggagttcgagaccagcctggacaacatggtgaaactccttccctactaaaaatacaaaaaaaaaaaaaattagccaggcatgttggtgcacatctgtggttccagctactcaggaggctgagctgggaggatcacctgagcctgggaagttgaggctgcagtgagccgtgatcacgccaccacacagacaacagagcaagaccctgtctcaggaaaaaaaaaaaaagaagaagaaagtaagaaaacaaaactggagcctctccttaatttaatatttatgttcttctgggttttcagaactatgaatgatttttttttagtcccaccaggttactttgttgtgacatatggtatctttaagatgataaaaagtgagatgacaaggtgattaattttatgtataaaagctttgaagacgattttaatcacttattctactatttcagtatattggtagggattagacttttaaaaattctacttcatctttctgtgaaagaattcctaatgaaaaaggacatagactttggaaccagaaagacctgggtttaagcccacctctacaacttacttgctgggttatcttggataagatacttagactcttagaatgtcagttttctcatctgtaaatggggctaattaggtctacacggcagggttgttgtgaggtttagagatcacaaaatgcccagtagagtgtctggcaaaagtgggagctcaataaataacagtgagttgtttcatggtaatggctctgctggcaggccaccaggaaacataatctagtattacagagtgccccagattcttgaggtccctggcattcctctactttggaaggacttatcgttggtaccctagtcgtgtgttcagaatgggaaactcaagtccttagacatagttaggcatacagttagtgtttgttgaattggattgaaggcagcacacattgctttaggatttctcttagcttggagtctgcaggctgcttgtttctacatcctggatgttcccctttccatgcttcaacttccaacggctcctgaatcatactgtggaggaggcagccaggtcaacttcctctccctcagaacccaattcaggggcaaaagcaggatgctaaggctgacccaaatgtctctgacaacgccttgtcatgacccttggacagagaagacttttagagtaaagtctctcttggagtgcttggtgctatttttgtgttaatgtaactctaattggtactctaaccattctaatgctttgagagagatgtcttttttttttttttttttttttttttttttttttttttaagagacagagtcccaatcagtcacccaggctagagtgcagtggtataagcatggcacattgtaacctccaactcctggcctcaactgatcctcttgcctcaggctcctgagtagctgggactataggcacatacgatcatgcctggctaatttttaatttttttagagatgggatctcgctatgttgcccaggctggtctcaaactcctggcccggagcagtcatcctgcctcagcctcccaaagtgctaggattacaggcccaagccactgtgcctggtcaggtgtctttgagagtggtgctatcccactgaactggtgagaaagttgagtagaaccaaagaaagaaaacttgatagaagcaagaattatgattgcgaatcactagcccttctgattttctccagtctaaattatgttttgctcattttacttgaccagtaaggtaaaaccccacgtgggaggaaggggagttgctgtttcataatgggtcagaatcaaaaccccattgtcccaagccaagctttcagacaggctgactccctgcatttttctaagtcaaaataaaaacaattcctttatgccgtcacgttgcagccaagttaagtcttcaatacagtcatgcattgcttaatggccaggacacgttctgagaaatgtgtcattaagcagtattgtcgttgtgcaaacatcatagaatgtaccaacccaaacctaggtagatagtagagcctactacacgcctaggctatctggtgagcttattgcttctaggctacaaacatacacagcatgttactatactgaatactacaggcaattgtaacacaatggtaagtatttgtgtgtctaaacatatctaaacataggaaaaggacagtaaacatacggtattgtaatcttatgggaccactgtcatatatggggtccatcattaactgaaatgttgcatgtggctcatgactgcatgagagatgtgataatttgcagacagaccgaagttcacaaagggctctattagtttcatttgcatggaaaagactagtattaatacattcagtatagacagttcttacatttgagttttagagccaacaagactgacctggaaatgcttttctggtttcattttcatctatttaattacccctaccactggaaaagattttaaaactctggcctcatccttctaatttatatccacagattaagtttcagttctaagaatgatcaactaatttcatgttttattttattccatgaagagagagaaggtaccttctcatcagaacagccctatcacccttttctcctcccaggttaagcctgagcccttgccacacggatttccttctcacccgcttcctccccgcaccactctggggatcagaagtatcagtgccaagtggtccctttcatctcctcataattcttccccagccacttagtgggttagtcaggccctgccttctcttcagccagccctgcagtcccgggaatgtcttgagtgagccctggaatctctgcacagggtgagtttcctgttgtacatgctcagcccaatattttttgattcatgaatattaaagaattagagatcacaaggccttaccaccatcttgcaccctctgaaaacataatgactcttttatttcatggcactttacttagtttattcagcatgatcagggcagcattcaggctatagcaagcttgttaaatatttacccatgaggctgatatttatacatgaatcagcagcacttatcagtgtgtgacactggatgtagattttggacgcttacaagctaagaaactactgggttaaataaagggtgaaatgacgtcctttaaaaaataaactctcagttaaaactatctttcgtagtgcctaaagtgctttgcacctgttgaggctcaccccagacagccaaccaagtcattcagaatcagacctgccagagtgtctggtccatcacatttgagatcaaatgaatctgattgtttggtggttggggtgggagagtactgaggtatgaacaaaattaagaggagttcctgcttgctgctgtgtgggaaattgtaaacggagatgagccgtacatcacagtgtctactttggtgacggtctgaagcctctaggagcccctcatcatttgggatgctggcctggctccctgatagccagacctactgtttcttcccatccctgtagtcttccatgattaaaatccccctcctctcagggaggtaacatatttcagcagaaacagcctgaactccggtgacaggcaaacctgtgttcagatcttggttttacctatgtctagttgtgtgaacctaggcagtattttctgttctctgagcctcgtttttttcacatgtaaaattacagcgatacttcccacctctttgaactatggagagcatttaattagataatgtgataaagcacctagcaacatgtgttagttcttggtagtgaccgaagcagggtgcggaaacatgggcctggcagcagaacacctggcctttggatctcttcacacctctgcttttctccatcattacaggtaatttttgtctaacggctgtatttcggaatgacacaatccaagcagagagagggagagggtttcaagtttaaaggattactcagactgttttccttccatgtatataatttaatgactgattaaagacttctcttgtaatattttatataagtcaaagcctattactgtcaactccagggaagcatccagcttattttctttttcagaattttattatgccaaggattgtttctctaagtgagcgatgagtagcttggatcttgccattctgtatgttatacagatattcaacctgtacctacaggacataaatattgtatttatttttcttgcactgtggattatttttttcttaatcagctttctatccttatgaaatcattagaaccttctggttagatgtgtgccttctgtgttatttgtgcatacacaaagaggagacaaaaagccttcctcttgtttataggaagtcacaggaattttcctagccatctttagagtttaggctaaatctaatccaatgcctactctaagcgtagcaaaaggaaatgatggccttgctgattctgtgcagttgcagaatgcagatgattcattaatgtcatacttagtcaaacactgtcttataattttctcagctgtcagagttgtgcttttaggtaacatctgagtagaaaaagtcaatactgaatatttccactccacattgacttccttgtgtcactcgagattttgttcatttagactttttatttgcatgagcaaacacaaaatttatttatttatttattttgagatggagtctcacttttatcgcccgggctggagtgcagtgtcacgatctctgctcactgcaacctctacctccttgggtgcaagcaattttcctgcctcagcctcccaagtagctgggattacaggcgcatgccaccacgcccagctaatttttctatttttagtagagacagggtttcaccatgttggccagaatggtctcgatctcttgaccttgtgatccgcccccctcagcctcccaaagtgctgggattacaggtgtgagccaccacgcccagccccacaaaatttatttttaccaggaaaattaatttcagaaacctgtagtcaatagggagacaggatgggtttggagtccttttagtagtgttttatacatatatgtgcacattcacatacatactccctgtatcacaaaccctagactgagtcaaagtgccctaaactctttttttgtttgtttgtttgtttgtttgttttgagacagggtctcactctgtcgcccaggctagggtacagaggcacgatctcggctcactgcaacctctgcctccaagttcaagtgatctcccacctcagtttcctgagtagctaaggctacaggtgtgcaccaccatgcctggctaattttttaatttttttttttgtagagacgaagtcttcctatgttgcccaagctggtcttgaactcctagactcaagtgatttgccaacctcagcctcccaaagtgctgggattatagtcatgagccactgcagccggctaccctgaactctttagaaatgattttctaggcagttattgtcacacctttttcttccacttacaaccttgtaactgcagggtcttggataataatccaacattataaataaataatcacaacattaagaagtaatcacaacattaagggattttagggatttttaaaaatatcccatcatattacagagagggtttagggggcttatagaagtatatgcattaaaatgaaattaagaaaaacaaactaaggcaaaaggaaagtgagcataggaaagaagatgaagtcaagatgaagggtgataaatgaaatgtacgccttaaagttctgaacaatttcttttaataattgtgtgctggttcatttaaactgaaaaaaagaatttctttttttttttctttttttcttttttcttttttttttgagaccgagtctcactgtatcgcccgtgctggagtgcagtggtgtgatcttggctcactgcaatctccgcctcccaggttcaagcaattctcatgcctcagcctcctgagtagctgggattacaggtgcccaccaccacacacccagctaatctttgtatttttagtagagacagggtttcatcatgttagccaggctggtctcaaactcctgacctcaagtgatcctcctgccttggcctcccaaagtgctgggattacaggcgtgagccaccatgcctggcctgaaagaaggaatttctgaaagttgtggaaattatttcagaatcaacattgtgtcttagtgcttggatcagtgattattgactgcagcttcttgtataccttttgaaatacaagataatggccgataagctgtagaactagagtgttgcagcaattcattttagttcagtttcaatgtttaatgaataacttatctgtgcccagcaaagaattgggcataatgaagagtataaaaatatgtttcagtaatacttacagcccattaatgttggtaagacatttacccatgccaatcaaaattttctaatttgtactgttgtgtgttatcaatgatgtataatgcaaacatgctaatttatttaaatgaattaaaatacagaaatgtaatcataaagtgaagcccatatacccatcatcattaacctaggcagttggtggccagactttgatgagagaagccaagtctgcttgggggtgtcacttcttaagttgcttgagccctaagagaagtgtccattgtactcttgtcctttcagtgcacttggaggctcctcagctcttcatatcccagcttttccaggaggaggatgtctcattgattacgttcctcaagtatgccacctgctcaccaacaaggtaaaagcaagtccccaactcatccctcttatgagatttcttcctccagtccaccacgtacccaaaatcatcgtgcatgctccatccttctcggaccgactgctcagtttcagcctccatctgacacctgcccttcctactgtgaattacagttaatctgtttctctccccatttctttgccctccttcttccttttctaaggattctgacctccttttccagtcttatcttcatctcttaactttatgtctgggatttaagtcacgtctttcttgaatttcctttacccagtttttgccagatcttgcaccttcttaaactttaaaactttggaaccccattgcttcccaattatccagtgcatgcacacgtgtgtgcatgtgtttggcagtagttggtatccgcgtaattgtttaaaactaccttcatccctctctgtgtttctgtaccttactttttaatagtcagcctttgattcttcccgtcatatctgggagcagttcaccagagtcctgtgcctaggggtaagattcccaagtcagctggtctttttatttttattttttttgagacagagtctcactctgtcgcctgggctggaatgtagtggcgcgatctcggctgaccgcaacctcctcccgggttcaagcgattctcctgcctcagcctcctgagtagctgggattacagacacccgccaccaggcctggctaatttttatatttttagtagagatgagggttcaccatgttggccaggctagtctcaaactcctgacttcagatgatctgcctacctcagcctcccaaagtgctgggattacaggcgtgagccaccgcgcccagccagtcagctggtcttatactcagtcagatgatctaaagcttctcttagctacatcaatgagccatttcattagcaagtagctgagtctaacggttattgttagatatttccaaaaagtgtaagaatatacttgttaatgtccagctagtatatttagctgaaaactagtgatactgatgcacaaacaatgctgactctctttcttctcccacatggactgtgactcagtttgtttagttgccagagtgcaatttctttgctcctgttgacttgttcacattggcttggaaaaatagatcttttgtttgtctctttcactcaaaagatagctcacttctatatagaaaatagtttaaaagtacaataatatttcaagagcttcagtattatttttcaaatgtcagagaaactaaaatctagcaactccaccgtctgtgggcctggcacagattccaggctttaaccctcatgcaggggttgcttctcatcagaccaaatctccccagcctctgccctcctgcaaaactgatcggaggacagaattcttatttacattctggggctttgcactgccttcaaatctgtgtcccagaattatagagaaacatgcaaatttggtcttctagaacggagaagaaaagcctttttaaagctctccaattgagattaatttctagtcatacattttcctcaaaaaaaaattataacaccgttttcccagaaatataagaatcagtcaatttttcttatctggtttcctttcattaattttacttgtcttttgaaattgatgttcttctgtttgctacaaatgaggacagtatgggctgcttttagaaacaatctcttcaaatgaatttccataattatattggaatctatctttatagccagttttgttgtgggtttctgttaaaatggttttctgtttttaaaatcaagtatacagaactgttttcatcccctttttaaacaaagccacttaagcaaacttatcatctgtttttcttttctcaaaataacatttctgatcccgcattaagcctgcaaagtaagcactgtttttataaattgacataaacccctattatataaatagaattgttttacatttaaagggttcaacatggctatcagtaccaattgtgtcaaggttatttcaagcactttatcttgagcttttgttagccatggaaactcagtgtggctatagccaatataaacaattttgggggtctctccttcccactgtttcttccagccatcatgagaacattataaggaatgtgttttcgtgttagaagctggtgggtaaatgactaactttcagatgcctagcttaatgagtttgcaatttttttatagaaactgtcattgggtgataatgaggaaatataaaaaggcaaagcaaaataaaatctcctattgtaatactccttattctgaatatcagaattttaaaatgagagaagtattattctgccttttttaataggagctcaagataaccaaataaccccatttgatgagagaaagctctttacagagtatgtcagctgatgtatgcaaaaggaatgatgggattcaaaaatcatcattttgcagtccctaatgaaatcattgattcagacaaggatctccagtaaatactaaaaccattaggtgaaaggttgatgggaaactaggttttccgctgcttcagagggtatgtccatagactattcactgtggcagagggagcattcccttccattggaggggtctggctgttgtcaccttagccaagtgatcaggcccagtatcatctaggaagttttcttgccaaaaatgttcaacctggacctaatcaccctttagctctaatttctaatttattggaaatacagagagtaaaggaaaaagaaagaaaacagaattgagacgttctacaagactactagcacaatttgttttcttttttctttttttttttttaagagataagatcttgctcttttaaagagatgaggtcgcccaggctggggtgcagtgatgccttctaagctcaatgcagccttgaactcctgggctcaagcattcctcctgcctcaggctcccgagtagctagggctataggtgcatatcaccatacccagctaatatttcttttattttttgtagagatgaggtctggctgtgttgctgaggctggtcttgaattcctggcctgaagtaatcctcctgcttcagactcccaaaatactgggattatatgagtgagattccacatctggacatagcccaatttatttgaaaaattagtgtcatatatgtgcatgcaggcacacacacatacacacactcaaggaggcactatttattatagatttagaaacttaaaaggcattaaaaacaaatggctgatccttaatcatacattgttttttaaaaaacattttgggccaggctcagtggctcacacctgtaatcctaggactttgggaggctgaggcaggctgatcatctgaagtcaggagttcgagaccagcctgcccaacatggtgaaacctcgtctctactaaaaatacaaaaattagcagggcatagtggcggactcctataatcccagctacttgggaggctgagggaggagaatcacttgaacccaggaggtggaggttgcagtgagctaagatcgcgccattgcactccagcctgggcaacaagagcgagactctgtctcaaaaaaaaaaaaaaacaaaaaaaacccatttattttaattcttttgaattaaaaaataaaaataaacattttggggacaattaggaaattttgaaaatggacagggtactagatgaattcagagaccaattgctaaatttgttgggtacaataatggtattgtggttatgtagaagaaagttttattttttagagatgcatactgaaatatttaagagtgaactgtcatgatgtctctcatttcctttgaagtgttgattgataggttgatagatagatggatggctggaggaagcaagtaggcacaatagtcacagttgttgaatgtaggtagtgggaataccggtgttcactttactattctttctgcttctctgaatctttgaaatttcttataataaagcatttaaaagattcccactctacttctcagctttgggtttctattccaggtgcagtacgtgattcaagggtatcacaaaagaagagagtatattgctgcttttctcagtcactttggcacgtaagttctgccctgtttgaacgatataccggtgatgccctcgcttgctgatgacctcaacatgggggcttgattaagaaaatagcacttagttcttacacatgataccttttttttttttgagacagtctcgctctgtcacccaggctggagtgtaatgacatgatcttggcttactgcaacctccacttcccgagttcaagcgattctcctgcctcagtctcctgagtagctgggattataggcatgggccaccacacccagcaaatttttgtatttttagtagagacggggtttcaccatgttgtccaggctggtctcaaactcctgaccttgtgatccgcccaccttggcctcccaaagtgctgggattacaggcgtgagccaccacacccagccccacatgatacctttttaatgccactttgatcctttttggtatgctgttcataccaaagctcccaggatccctttttttttttttttttttcggtactctttggcaaatagtagaatcaaatatcttccctagagcagcagcctggacagccctgaactcaacagtagtaatggtggtaacggtcactttttgtagaactctctacaatttgcatagcacttttcacctccatgccctcacagtagccatggggtgaaccaggcaggcatcaccggcacattttgttgaagaagctctgaaattgcggtaagttcagtaacccaatggaagtcgcgcccctagaagaagtggagccagggcaggaaccccatttccccagcactcaggtctcctgctaggactccactgccaacagtgccacacagatccgggcaggaaatccagcattcgatgcaaaagcggtggctcgcacttgaggttaggagttgaaagcaagcaccgataggggagagggaagcctgtgacaccatgggcgcctctggctgctccatccctgtgcctttgccctttccttctggctgcctgtggctgtgctgccctgcagccctgtttccttaagtaagtcagaggcctgatcaagcttcttctcaggctttgctcagtgagacagggaatgcattttcctcacgatctttagaagatagaacattctacccattgtcgttaacgaggcactaaggattttagaggtctgatgatagcccaccttattccacagaaggcttataaatatataaatatatctagtaatacaaaattaaaattttaaataaggaaattaggaatagggagagaagatgaaaccaagaaaatgatttgtcaccctctgggatataattttcaaaccatggcacaattataagaaaatttctgactcctcaaaccaattttaagacatttttctcattcccataatggaatttttcatttctccgaaatagaagtgtcaataaccaaacagtatgactgcctctcacatgagtctttaatacttaagatttttttcagctttgtgaacattttgagaaagtacttttgatacaaatagtggttaataaataataccattgatcttcttatttttaagtaagattatctttagtatatataattaaacatgaagaagctagcacagtggcctccaaaatgtagtacacacaccccagaagttacacagctcactctattgaagtataagaaatatatgaaaattacattgacatttgctttcaagtctcacttttttaatgtacttttttgtgtacattttattatgcatgtagtacagtagtatactaaaaaggactatatacttgtctttgcctgtgggatgcaggatctgaaaagtattgatatcagcactataacattattgggctaattataaattcatagagaggccaggcacagtggctcacacttgtaatcccagcactttgggaggccgaggcgggcggatcatgaggtcaggagttcgagaccagcctgaccaacacagtgaaaccccgtctctactaaaaatacaaaaattagctgggcgtggtggcgggtgcctgtaatcccagctacttgggaggctgaggcaggagaatctcttgaacccgggaggcggaggttgcagtgaaccgagatcatgccactatactctagcctgggcaacagagctagactccatctcaaaaaaatttaaaaattaaaaaaaaattagccgggcatagtggcaggtgcctgtaatcccagctattcggaaggctgaggcaggagaattgcctgaacctaggaggcagaggttgcagtgagccaagatcgcaccactgcactccagcttgggcaatagggtgagactctgtctcaaaaaaaaaataaataaattcatagaaatataaactaaagaattgtcgacttaagatctgaatgatataccaaccattttttagcagatcacttacccttcagtatcttagttcttttacctttataaggggtataactgttccttccaacttaaactgggcgggcatcaatatcagtggtctgattggcctggtttggtcagggataaggcatctctaaggacatcagagtcctccttgtatggatgagaaagaaaattatatctgtccttagtgtggttagtattgtcacattatggcgacatcctccaggcgctcagctcttgagggaaatggatgagttgaggctacagaattgcgccttggcccattcagaggtcaggggatgttttcttttgacacatgaaatatgcatctcccttcctgaacccagcatccacccatctagtgttgctactttgccttaagcccagtgggaaggacaggggaacacagtgaaaggggacacagttgtctggtgtgattgccctaacccagctcaagaagaaaagtaatatataatactaaatttagtaatactgtcattgcatattactatgtagtgcccagtgaaagtcagacttaacaatcactgtacaggtagtatgctgacatttggcattgtagtgtcattgctgacttgatttcttaatatgtccttctactcataattaatgtaataactcacatttgtatagtattttatgatttatcttatttgtttttcacaaccctgtaatgaattttgcaaatatttttatacttgttttgcaggtaaggaaactgaggctgcaaaggttaagtgatttgcctgaggtcatagtagatagtcaatggcaaagctgtgacttaaacctagatactgtcattccaaaccccaggcccttcctgcattaatcctcacttgccttaaacccatctcaaagtcaataaccctgacttcacgaatatattctttacttggttttattgcttttataccttaattttatgagggttttttttgtttgtgtgtgtatgtttttattacttagaggtgtcgtggaatatgatgcagaaggctttacaaaactcactctgctgctgatgtggaaagatttttgttttcttgtacacagtgagtatacttttgctgtcagcatgtcagcatacatttttaaatgtcctaaaccacatgtaataatcagtactagaaccttttctgtcctgtctcggttccttttactgtagcgtatatatatatttattgtgggatattaaggagaaaatatctctaggccggtggttctcaaccactggagcaattttgcacctcaggggacgtttggcaatgcctggagacatttttgattgttatgactgagggggtggggatttgctactggcatctaatgggtagaggtcagtgatgcagctaaacatcctacaatgcacatgacagcccctcacacacacacacaaaaaattattgaatgcaaaatctcagtattgccaagctagagaaaccttaccctaaacagattctgtttctaattatctttccagtatcaggcctcaagacttttggtattattggaaacatacctgctgtgatcatttggttatcatccttattcaatgaaaagtctacaactttgataaaatgtaatacataacttaaagatggggtaatgttttaatgtatccccaacatcatttcttcatgttcttctgcgtagtaggcatacctaatggtggttgtcacatattaatccatcagtctgtaaacatcgacccagctttctcttgatagataatttagagtctttttatttcctgattatgtaagaaccagtgacccatggagtcaggttcaagttgcaagtcaactgagaccttcattctgcagtaatttggtacgtacaatgttcagtcttcaggccaaggcaaaggagccaactttcccagcttgagttagagaaaagcagtgggtttgaattgacttcactcaaacccatggcttttagaacttaccctatgccttaataaactactgcaggaggaataactttggctgtatttagccaaggcatcagacagtgtaaagatactgactttaagggatttttcttctgcagcagatttaccttcttcgttatgatttgctttggttaaaatagttcttaagttcatttttctatctgattacacaccaatagatagtaagggcagaaaccaaaaaaacatccatagtggcagaaagaagaaaacgtctaagtaaaaccttatcatggtaaaattcatatagagatgatcgagcgcaggccacagttttaaggagatgggcctctctgccttgaggtgttgcccaacaatcaccacttttcaaggtgtcaggcaccttgtcaccatcataacctacagtgtggggccaggtaaggaggaagccccacaatcaaggcctcctggcaatctcctctttgctcagtgtcttcgatggccctactaatctgagcctaacactggtactgcagccaccacttttgattctgaccttatatatccttgctttggtttggcattctgtggcttaattcctttgtgaaatctcacttcctatttgctgtattcactttaccttacgaccttggtcccagtgattctttctgtaacctgatgacccaacggcagatcttgattgcttccttaatttattcatatctcttgtgacttgggaaggttgtctggtgtgattatcctaacccagctcaagagggacctgggccttacctcaaatgatggtggtgacggcctcgtgcctcctgagtggctgtggacaactccatcacagcaggacaattgcagacactaagatgaatgcttcaaccagttccttcatctccaagtgacataatagcctgtcttttttcctgaatctttagtctcctagccatggttctactttctgttgatgtcagatcatatcagaataaggggaaaaatatatttcatggcattgctcaattataacctatgttttccacatgcaactcaaagatgactattctggtggttgctagcaagaagaaattgtcacttgcaatgatggtcagagataaaagaacattcacctctcagctcctgccaactcgtttgtcagtacattcagtaatgtagctattgctgttgcttttgaaggtttattccccacagaatattttctccttggtaccatgtgttcagtatttcttacagctccttctctgcctttctatcttagcttttccaaatcagacatgcagaattgagtcccaaagtcatcttttcatttcattttgaattaccttcttcagaaacatagaacccccaggcactcattagaacagctacccgggaccttgggagttgtttaattgactttttccagtgtttcctggagctcttattcctgtactcccccggctgtttggtccctgtctcttagcatcactgccacactcttggctcttctggcagataagaccctgcctgtgaaccaaaggactttgatgctgtttcctgctccctcactaactcacagcctgtctttaaataaattattttcacccatttccttttttcttatctaaaatataggacttgctacctcggagtgaagcttggttagataatgtgttttacttagtcatgcagttaagcatctgacacttaccttcctttggaagcatctgctggcttggttacaatgcccaagggaccacttgttcctttttctcccttccatgaagatggggaggggaatatgaggtggcagagacttaacaaagaacattgcagtgaattattctgagatctcaagaggtgaaaaggaggaaggaagtgcctggaaatagagccattcccctgtggctgcctctactacttcatggaggttgaagacctagcaggacatgaaatagcatctctgttctccccttcctccctattctcctcgggcccaggataattgctattgataggatagctcctggcaataattatgtgcattttggatgctagaggaaagaggcactcttcttgagacagacagctctgacctcagactttgccagactttgaaaaagcagattgccttaaggaaaagcattgcacagattctgggatctctcaggaggtactgcaacatcctggcattctggcagttccaggagtggggactgtggccatgattgtggccatggagcatttccatccacttattccttccttacatcattcattttcagcatgtctcaaatcttggaactgtagcaggatcagaaacttgctcccatccagaaactatttttaggaaactttcctggccatcatctaagaattattcatagcagttgtataggcaattccatatttgccaaattatgcttacctctggaggtagatgttacctttaagctagtagcttttgtttattttctttttctttttttttttttttttttgagacggagttttgctcttgttgcccaggttggagtggaatgacgggatctcggctcactgcaacctctgcctcccaggttcaagcaattctcctgcctcagcctctcgagtagctgggattacaggcatgcgccaccatgcctggctaattttgtaattttagtagaaacggagtttctccgtgttggtcaggctggtctcaaactcccgacctcaggtgatccacctgcctcagcttcccaaagtgctgggattacaggcgtgagccaccgcgcctggtccactagtagcttttcagaatgcagcgtggcaagagaaccagatagcaaggcgaagtaacagaacaaaaaaaatcctctggggaaaagctacatgctttttttgtgggtcccagtcaactgcactgtaagtagacacacaaggaggcagctgtctacaggagcagagttgctgcttagaaggggagacaattgagtattgagatttgtgactgtatgacaagctgtctttttccattacctataaatctttggtaaatgaccctttgagtcattcagcctggactgtaggccttttctccctggtaaaattcctgttagaccaaatctgaccacttttttctcttgttttcctctacctccaacttaactgagttctgagtttactaagaacctactgcatgctcagtactatgcgaggtattaggggatataagtatataactcagagttgaccttaagatacttacagtaacatagcacagaaattagaaaactacagcctgtgggccaaatcccgtgtcagcctgtttttatagggcccttgagctaagtatagctttttgtttgtttgtttgcttgtttttttttttttttttggaaacagcgtctcactctgttgcccaggctggaatgcggtagtgtgatcttggctcactgcagcctccgccaccttgagttcaagcgtttcttctgcctcagcctcccgagtagctgggactacaggcatgtgccaccatgcccggctaatttttgtatttttagtagagaccgggtttcaccacgttacccaggctgatcttgaactcctggcctcaagcaatctacccgcctaggcctcccaaagtgctgggattataggtgtgagccactgcaccctgccctaagggtagcttttatattttaaaaggattcttagaaaacagaaagaagcagaagaatatgcagcagagacagtatatggtttgcaagacctaaaatatttgacccttcacagaagtttgccaacttcttgtctagttgatgagaaaaaagattaggtcaaggtgaagtacaatggtatgcatttttaaaacaaatattttatgacttgtctactttatgcaagacacagttatatgagagaggctcatatgttatatgtcttggtctgggggaggtcttctttctctctctccagactggagtgcagtggtgcaatcatggctcactgtagcctcaacttcctgggctcaggtgatcctcccaccttagcctcccaagtagctggaactatacataagcgccatgacgcccagctaattttatgtagggacgaggttttgctgtttcccaggctggtctcaaaacacctcgggctcaagggatccacctgcctcagcctcccaaagtgttgggattacaggcatgagccaccacacccagcttcttgtctttcttaatgaagtctaatgagaaaaacagacaataaagacataaacttaacaaatatatacattcaaaaggtgacaaatagcgtgatggaacaaagtaaaaggctatgaatagagaataagaaggagatgctgtgaggaagatgaggaagatgctgtgaggagatgctgtgaggtcttccctatgcttctatagggaagacctcctatagagggtgacatttccgctgagaccttagcagtgattcagacagccaaggaaggcaattccagggaaggcagtccctgtgcaaaagccctgagccctgaggcagcaaagagctctgctgaagcaggcgtggctggagcacagtgagtaaggggaagggcatttgttgaactttttttttttttttttttttagctatctaatattgaattactttcttagcggtttattctagagattacaatatgcatctttaacataattgccttaagattaataataccttcattctggtaaaatatagcaacattgctccttgtcctcccgcttatttgttctattaattgtcatatatattacatgtatatatgttataatataaacacaacaatatagctttttctgtcattactataaacaatcatatatatttttttcttttttttttgtttgtttgtttgttttgtttttgagacggggtctcgctctgtcgcccaggctggagtgcagtggcacgatctcagctcacagcaacctccgcctcccaggttcaagcaattctcctgcctcagcctcctgagtagctaggattacaggcatgtgccaccactcccggctaattttttgtgtttttagtagagacagggttttgccgtgttagccaggatggtcttgatctcctgacctcgtgatctacccgccatggcttcccaaagtgctaggattacaggcgtgagccaccacgcccagccacagtcttatgtttttaaaagagaaaaaaagttatctttggattttgccctgcacattatttccagtgtatctttgcaagactttgattgctgtgttcctccatttcagagctgtaggattggggctggggtggcagtgtttattcagtctaatgaatgataaggttcttactctgatgtttttctttattttaaatgactaatgttcacacagatgtcttagtattattctttctgtatttgtctttaactatctgtttgttcatttgttcattcattggttttcagttgacattaagtaaaaggaaagcaattattttgtttttcagagaacacagtttctggtaagactttttttttttaagccagaggaaatcaacaacttcagactaattctggtagtcatttaaataattctttccttataggcctgtaatcaaggccaataaattagaaatcaggacagcttttgaaattttaagtaaaaatcagaagcttctgtttattgctacaaatgcttctgccgagctctgattttgtcaggctctccaattcctggtataaccaaggaaattatttgcattgatgtcgcactgtcacctcaccactaaaacacaaagctgtcgtagtagcagccactcagttcctgagctaagcgaggtagactttcatctgcccgctatagaaacagtgtttcgtcgtagaatatttagcactcaacaaacaagatggctactacataaatcggtaaaaccaaaactgtgatgttgctcaaaacctgcttacttttttggatacagttcacatctttatataaaggaatatacttgaaaagcaaatcggaatcagtaaaataattaaaattaagaaccacaatgctatgtgttagaatttgtttcaagccaaatctatagaaagtgtaatattattttagaattaccatgtttacctcatatcagacataaagattcttagtttaattttatcatttctagtattaataactatcaggctaggtgcagtggctcatgcccgtaatcccagcacttggggaggccaaggtgggtagatcacctgaggtcaggagttcgagatcagccgaaacatggtgaaaccctgtctctactaaaaatacaaaaattagccaagtgtggtggcacctgtaatctcagcttcttgggagaggctgagataggagaatcgcttgaacctgggaggtggaggttgcagtgagccgagaacgtgccgttgcactccaccctgggcaagaggagtgaaactccatctcaaaaaaaaaaaaagcaaaaaaactatcaaagcaacaggaatgaaaattaattatcaacaaaatatcaaaccagtcagttctctaatattgttccgaatgataaaagaatatggaaaaagataaaagaaaatttactaaatgcctttttgctttaattatgggaactactgagtcctttagatacttttacattttggttaatttttatactgagacttccttgaaagtggttagctctactaggcaaagtggttttcatcttttgattatacacacaagcacacccttcgcccggtttacagttcagagagctccagtccttcagcaaccactgtcactattttgactcaaattgaaacttctgtttcatctttagagtttacttccagaaagcctgttttgtaatttctgacactagtttgagaacttactggattaatcttcactgggaatattgtcttcattataataccttagaattacatgacccctttttagtgaccttaaaggatttcttttaaggaagaaggttgtaaatcacttgcacaatcatgcaatgaatttttcccctgtaccctcttatatatgttgtatgaatcttttcagttgtaattattggattaagtaattgccaaagcaagtgtttctgatcaaagaaaggtcttgaaaaattagcaattttgacttctcagtgatttttgacatgctgtcaaattaacaactgtaactcaagaagtcatcttacccagtgaaagaaaggaagctgtttacagagtaactcttatgttattgatgtagttcagtataaccttttcttagaattaatattaaagtactgttgacattggtgaagcatgggcattattatgttttggtgcagagcttctgctgttgttgaaaataatagcaataacagttcacaggtatggagtgaaggctgagtgcggtggctcatgcccgtaatcctagcactttgggtggccaaagcggatggatcacctgaggtcaggagttcaagacttggccaacatggtgaaaccctgcctctactaaaaaaaaaagaaaattagccaggtgtggtggcatgcgcctgtaatcccagctactcaggaggttgaggcatgagaattgcttgaacccaggaagtggaggttgcagtgagccaagatggcaccactgtactcaggcctgtgtgacagagcaagactttgtctcaaaaaaaaaaaaaaagtatggagtgtataccatgctctagacactgttctcagtactttgcatatgttatgttatttaatctgcagaacatctttctgaggttaattaccagaataacccattttacaaataacaaaactggcacagcaagattaaatgacagagctagtgtttaaatccaggaatagactctagatcccatgtgctaaactacattactctgctgtttcagataattgtttgacagtatccccaggtatgtgtgataaatttcaaaagcctttagagcttcacggaaaccctgtaagccccaagaacaagagcagagggtcagtgtctgcagccatgcacaggtcagagagatatggagactatctcatctctcaggaatggagtggatgtctcagcagagacattactgttctgaagacaacggggcattaagctggagttgttcctcagtggaggtgacaggttgttcacttataatcccctgtcctgtggcacaaactactggctcaaggtagggattcatttttggccattgaaagaacaaaactaagcagcttattaaggaatgaaagagctactgattaccaaaaacgtgatttaacctgtttagacatagtgaatgtggtcagttataatggtttgtcatacaaagttcatgttaacctacaaggtcaaatgcctcctgagaaagaggtgatttagatgtgggagtagcccaggttctaagacggttggaggagtaggaactgtggcaaactgcacactcctttctatcctcttcattgttgatctcggctcattccagccctgctgcccaggttcaagcaattctcctgccccagcctcccaagtatctgggactacaggcatgtgccaccatgaccaaataatttttgtattttttgtagatacggtgtttgactatgttggccaggctggtctcgaactcctgacctcaggtgatcctcccgcctcgatctcccaaagtgctgggattacaggcatgagccgccacgcccatgcccagcccattgttgttttttttaactgaataaatccagacatttctgtgggttggatctgtcctgagaacctgttaattaaaaaaaaaaaaattattgtagaaatttcaagcaaacgtgaaagtagaaagaaaaatatagtgaaccgctatcacccatatcgcagtttgaataccttgtttcttctatcctgcctcctttttaatttcctgaatattttgatgcaagggaaatgttgttttacctataaatacctcactatgtatctctaacagataaggattttttttcaatttttttttttttttttttttgagacagggtcttgctctgtagaccaggccaacgtgcagtagagtgatcatctagctcattgcagcctcaaactcctggactcaagggaccctcccacctcagcctccagagtagctgggactatagacacacaccaccatgccagctaattttttaaaaatttttccataaagacagagtctcactatgttgcccaggcttgtctcaaacttctggcctctagtgaacctcccacctcagcttcccaaagtcctgggattgcaggcatgagccactgcacccagcccagataaggattttttaaaaagatatattgacgatagtattatgacatctaattaattaatatcacctaatacccagtttgtgttcagatttccccatttgtctcaaacgtgggttttttttagcacttgctttgttcaaatcaggatccgaacaagtaagaatccgtgaatcttgaaagcctttctttagaaaataggagaaaaagtgtttttagttatttcatttagaatctgagccattccgtcttttttttaagatggagtctcactttgttgcccaggctggagtgcagtggtgcaatctcagctcactgcaacttcagccttccaggttcaagcgattctcctgactcagcctcccaagtagctgggattacagacatgcaccgtcatgcccggctaatttttgtatttttagcagagatgggggtttcaccatgctggccaagctggtcttgaactcctgacctcaagtgatccacccaccttggcctgccaaagtgctgggattacaggcataagccacagcacccagctgccatccagtcttaatgctagtttttaatagaattcttagcactagaatgaacagttagaggccatctaacttagaagtttttgtttgtttgtttgtttttatatttttgagacatggtctcactcgctcacccaggctggagtgtagtggtgtgatcttggctcactgtagcctcagcctcccaggcccaagtaatcctcccacctcagcctccagagtagctggcattacaggtgtacaccaccacactcagctaatttttgtattttttgtggagacagagtttcaccatgttccccaggctggtcttaaatttctgagctgaagtgatccgcccaccatagcctcccaaagtgctgagattacaggtgtgtgccaccacgcctggcctagctcagaagtttttaacaggtgtttttttttgtgccaaagattcctttggtgaattccgtggatccattctgtagaacagtgtattttgcgtaaaataaaatatactgtgctaaaaaggaaactgattatgtggaacctgttatcaaatctttaaaaagttatgatatagagatgtatctataatcagatatatcatttctttagcagatacatagcttctttgttaacacattaaatagtaatatccagtagcatatctaataaccaccataattttgaaatagtgataaatgtaaataatattttgagatatgggcaacacttacaatttgatataaaaatacctgtgatttctattagtaccaaagttattactgctaaagccactgcagattgttgcctatattcataatagaaggaaatgctaaatttcagttaaaggttgtaaaaacaaagatacacatttatgtaaagaaaatgcgtaaagatacacattttcccatccaaattcccagatgccctgaatccaaggacgctttcaggggcaatgaggagagatgcatggacctcagattgagaatctctgaaaactcttatcatttactgaggtattggctgagtacctggcccaaggtcatgcatgatattagtggaagaataggactagaaacgaaattccttaaaattcaattaagtatttttcatatgtttggatggctcacttctttttttttttttttttttgagatggagtctcgctctgtcacccaggctggagtgcaatggcacgatctcagctcactgcagcctctgtctcctgggctcaagcgattctcctgcctcagcctcccaaatagctgggattacaggcgcacagcaacacacctggctaatttttgtatttttggtagagatggggtttcaccatgttggtcaggctggtctcgaaatcctgacctcaggtgatccacccacctcggcctcccaaagtgctgggattacaggcatgagacaccacgcccggcctggacaggtaagtactttacagcaatacatgtccagtattgtactgttggcatctcagtactggcctgatgtttagcataaggaaaataacagaaaataatgccctgatttgaggtataatgacttttccatttgcatattgtatactcagcaactgcacagattcagctttcatgagttcatagagtacattttcccatcttttttgaggtataatttacatatagtaaaattcaccattttaagtgaacacttaaattttggcaaccacatacaggcatagatctagccccaccatcaagacaaacaacattttctattatgttaaaaagtgtccttgtaagcctttgcagttggtctcctcccctgacttccagccccaggtagccaccgaccactttctgtttctctagttgattctgttttgttttcgatttcttttacttagcataacgtttttgagatccatccatggtgttgtgtgtgtcaatgttttgttcttatttattgctgagtagtatttcattttttcattccattgtttatgcatttaccagatgctgaacatttatttgtttccaagttttagttattaagaataatgctaggccagactcggtggctcaggcctgtaatcccagtgctttgggaagctgaggtgggaggattacttgaggccaggagttcaagaccagcctgagcaacattgcaagaccctttctctacaaaaaaatttaaaaattagcccagtgtggtgacatgcacctgtagtctcagctactcagaaggctgaagtgggaggattggttgagctcaggaggtcagggctgcagtaagccatgttcatacctctgcactccagcctgggttacagagtaaaaagaaaaaagaaagaaaagaagccgggcgtggtggctcacgcctgcaatcccagcactttgggaggctgatgcgggcagatcacttgaggtcaggaattcgagaccagcctagccaacatggtgaaaccccatctctactaaaaatacaaaaattagtctggcatggcagcaggcacttgtaatcccacctacttgggaggctgaggcaggagaaacgcttgaacccaggaggtggaggttgctgtgagctgagatcgcaccactgcactccagcctgggcagcagagcgagactgtgtctcaaaaataaataataaataaataaaaaggaaaggaaagaaagaatagttcttcttgaacgtaattcaagtgcaagtctttgtatggacgtatgtttttaattctcttgggtaaaaacgtagaagtggaaatgctgggtcctatggtgcacgtattttaactcagtaatgtactgccatactattttccaaatgactgtcactttttacattttcactgacagtgtgtgagagtttaatttttccccattctttccaactcttgatattgtcattctttttaagtttagccattataggatatataatagtaccttattgtggcttcaatttgcaattccctaatgactagtgatgttaaacatcttttcctatgcttatctgccattcgggtaagttaatttgtgaagcatctgcttaagtctttttcttttttcttttcttttttttttttttttgagacaggatgttgctctgtcacccaggctgtagtgcagtggcgccatcaggctcattgcagcctctacctcccaggctcaagtgttcctcccacttcagcctcctgagcagcagggactgcaagcatgcaccgccatgcctggctaatttttttttctttttgagatggagtctcactctgtcacccaggctggagtgcagtggtgcgatctcggctcactgcaacctccatctcccaggttcaagcagttctcctgcctcagcctcccgagtagctgggactacaggcacacgccaccacccccagctaatttttgtatttttggtagagacagggtttcaccatgttggccaggatggtctcgatctcttgtcctcatgatccacccaccttggcctcccaaagtgctaggattacaggcttcagccactgcacctggccttttttttttttttttttttttttttttttttcagactgagtcttgctctgttgccaggctggagtgtagtggtgcgatctgggctcacagcaatctccacctcccaggttcaagcaattcgcctgcctcagcctcccaagtagctgggactacaggcacacgccaccacacccagctaatttttgtatttttggtagagacagagtttcaccatgttggccaggatggtctccatctcctgacctcataatccacccacctcggcctcccaaagtgctgggatcacaggtaagctaccgcacctagccggctagtttattatgttttgtagagatgaggtcttgctatgctgcccaggcagtttttcttgtttttaattgggctgttatgttcttacttttgagttgagttttttatacattgggatacaaaccctttgtcagttccgtgttctgcaaatattggttgagaatatttaattgtgtctttcatagagcaaaaaattttaattctgatgaagtcaattttatcatttttaaattttatgagccatgctttttatgtcctgcttaaaaaattcttgcctaaccgagttcacaaataattttaaaaatgttttcttttagaaagtttctagttttagctctaaaatgtaggtctgtgttccacttcaagttaattttgtgtatggtataaggtaagggacatggttttttttttctgtactaatatccagtttgttgaaaagtctagtctttccccattaaattaccttagcacctttctcaaaagtcagttgaccatataagtgtaaatctacttctgaattcttttttttttttgagatggagtctcgcttttgtcgcccaggctggagtgcagtggcacgatctcggctcactgcaacctcttcttcccgtattcaagtaattcctctgcctcagcctctcaagtagctgggattacaggcacatgccaccatgcctggctaatttttgtatttttagtagagacggggtttcaccattgccaggatgatctcaatctccttacctcatgatccacccgcctcggcctcccaaagtgctgagattacaggcgtgagccaccacacccagccttctgaattcttactctgttccattgatctgtgtgtctgtgctttccctttaagtaggtcttgaaatcgtgtagtataagttttttaactttgtatttcttttcttttttttttttttttttttgacatggagtcttgctctatcatccaggttggagtgcagtggcacaatcttggttcactgcaacctctgcctcccgggttcaggtgattctcctgcgttagcctcctgagtagctgggattacaggtgcctaccaccacgcccggctaatttttgtatttttagtagagacagggttttgccgtgttagccaggctagtcttgaactcctaacctcaggtgatccacccacctcggcctcccaaagtgctggaattacaggcgtgaggcagcgcatccagccaactttgtatttctgtattcaaaatcatttagtcttttacatcctttgcctttccctgtgcgttctagaatcagcttgtcagtttcttcacaaaaagcatgattgggattgcattgaatctactgtacctcaatttgaggagaattgccatcttggaaataattgcattttccctttcatgaacatggtatatgttttcatttatttcaatctttcatttcccatagcaatgttttgtagttttcaatatacaagtcttgcacatcttttgttaaattaatttctaagtatatttttaagctatcgtgaatgaagttttcaaaatttttcattttctttcttttttttttttttttttgagatgacgtctcactctattacccaggctggagtgcagtggcacaatcttggctcacttcaacctccacctcctagattcaagcgattctcctgcctcagcctcccaaatacctggtattacaggcacacaccaccatacccagccaatttttgtatttttagtagagacagggtttcaccataatggtcagactggtctcaaactcctgacctcaagtgatccacccacctcagtctcttaaagtgctgggattacgggcatgagccactgcacccagactaaaaattttcattttcaaattgctaattgttaatatatagaaatataattgattttgtgtattgacctttagtaaattacttagaattttttttttttttttgaggcggagtcttgctctgtcgcccaggctggagtgcagtggcacgaggatcttggcttactgcaagctccacctcccgggttcatggcattctcctgcctcagcctcccgagtagctgggactacaggcgcccgccaccacacccggttaattttttttttgtatttttagtagagacagtgtttcatttcaccctgttagccaggatggtgtcgatctcctgatcttatgatctgcccaccttggcctcccaaagtgctgggattacaggcgtgagccaccgcgcccggccaattacttagaatttttatgtatatgatcatgtcatctgcagatgacagttttactttttcctttccagtgtgagttttgtccttccttccttcttcccttcctttctctcccctcccctctcctcctttcccctcccctcccctccccttcccttccctcccttccagtggcctccagacctgacctatgcaatactttattcatttatatattgatttatcccttcggtcatcatgtatttgaggacctgctttggttccggtactgtcaagactcagggataccagaatgaatgataccttgtctgaaatagctcacaatctagtggggaaaatgaacatatgaaaataacaaagaaatattacttaaagtgcatttctaggcatacaccagatgttacgagaatacagtgaagcgtcacccaacacagtaagggaggagggccataagatcattccaagctgagagcctggtgtaaacaaaggcacagagggaagaaatcttagagtggaggtgaggaactgaaagtggtttccagtctcctaaatgtttagaggatcccaagaagtagtaagagattaagctaaagaggcagtcagagggcagaacacagatataacgttgcctaggaggctgacaaatgtgactttatcctaaggatagcaaggagttattgaagagtgctcagtagaaaagtggcatatatttgcttttataagaatacacttttcaggtattatgtaaaagatgatttgggatggagaccagggacctaaaaagacagtccaggcaaaagattagacctgaactagaggagtcatagtagggatagaggggaagaaaaatgtttaagaaacatattggaagtagaactggaaaaactgtgattgatcccaagtagaagatgagggacagagaagaaataggatgattcccaggtttcttttttaggcatctaggtagctgatgatgccatcatcttaggcaaggtttactttaggaggaacagagttggagatgttgagctccgttagggatataatgagttttaggagcctgtggacatccagttaaagaataaatgagagaacattcacatagaacaaaggtgtggtggaggctctcaccagcttaacctagagtccattccaacctgcaaactgctggttgtccccagtccagatgatgctgaactctttggcctggctgaactcttttgtccagtcacatgtcacactggacaggaagtggcttggaactcgaaaccttgttgatacacttttcctcccaaagaggtgatccaaattcctgagatggcccgacctaggatgtactgaaagaggctttgggcagtaacttctaaactgagaatgacttgtggctaaacttgaacccttgccttccagtagatgaaaggtgaagcaatttatctctcgaaagaaaaaatatggtatgattccacttatttgaggtaacagcaagacactgtctcaaaaaaaaaaaaaaaagaagaaaagaaaggaaggagaggaggagaggggaggggattattattattaataataataccattgttatgcataaataatataatttattgagtattcactatatgcaaagtactgtgctaaatactttacaataattccatataattctctcaacagccctgtgaggttgggctacttattatccccattttacaaaaagcacctccagatagtgtaacttgccagaagtcccatagctagtagctgaaggacagagcatttgaaccaagaccatctgattccagatctcttgttcctagcagtttactaaagcttcccaatccatgtgctggggcacactgatgggttagggataggttacagataggctactgacctcttcagtccttgggggagccgcagcccacagtgagtgacctctgccagccttacccattttcctcgagtgccataaaatagtaccattttctgggtaagtgccatgatttgaaaggagttggggagcacagtacaactgtactgtctcttctgtaacatctaccagaccctacacatgtctatggtcagaattccaacctcagagcacgtggtgggtagggatcctaatttctagttactttctgcaaatgaggtgctacggggctccccagtgttacctctgatgctcccaactgtggaactttctctttgtactatgagtcttttgaactctcccagtgttgaaaaggtggattaacaattcccccgtctccagggaaaccacagtacctgccagtaatgagaaactttgcatacaggcaagcctagtgaagataattgccaaaaggaatccgtcagtgtgattgaggccagagaactagcaattacattcaaatttttaaatgccaaccacccatcaatttttgctctaaaccattgtctcgtttcagctttgttttccaataaagatacaagtttagttccatactagtctttccagctaggctttcaggttaaacatggaatcttatctagtttataggacttaacatttgtagagatggggtttgccttttttatactcccaggtaagagctgaatgtaagcatgttctttatgccagataccatactggatactaaagatataggactgaatgggacattccttttctagaggaactcacagtcttatatacacagattccctgtattgaaaaaagaaaaaaaactctttggctaagctaatatttctcattttttatttggctatatgcttggaaacctcatctgtattataaactgtctcctatgtcaggcaaattaaaaagaatttgcaaagtttatccttgagcttttgtttgattgagacctcagaaatgaattgtggtcgcaacaaaagcatctccaaatggcatagtctttgttttatgttggaagaatggagtgggccaaaaccgtcagttcatactgttccaccacaaccagtcaatgagaaggtagagcccatttggatgggatggtgcttgaacactgtatttacaagaagatgaaaacatgctgagttggcctctaaccaaggggacaaaatacttcaaaagacccatttttctgggaggtgaacagcccaagattgcagactcagtggactccacagagagtaaacacaaagactttacatgctaacgttcaaagacagtttaccccaacatcattcattgttttcattattccagaggtcatgggggcttcagaaaaccaacacaatctgaaagaattgcttcttgatttcagcttttcaagtttgattgttttaacaactagaaagtcatttgaaacaacccagacttaactttgctactcagagatagcattagtttttcaatccacatttgacccaagggtgtactgaccagtgggcacagggaaggagtgggagtaaggactgtggcttctaattctggtcttgttttgccctataaagtgtgttagatcagcctcagtctccctatataagacacaattaggccgggcgcggtggctcatgtctgtaatcccagcactttgggaggccgaggcggaggatcacctgaggtcaggagttcaagaccagcctggccaacatggcaaaaccccgtctctacaaaaattagctgggcatggtggcgcacgcctgtaatcccagctactcaggcagctgaggcaggagaatcacttgaacacgggaggtggaggttgtagtgagctgagatcaggccattgcactccagcctaggtgacagagcgagactctgtctcaaaataaataaataaataggacacaattaaatcaattggtgttcttaaacaaaatggcctaagggtcagaaaactgaaaagcgggtagctgctccagtagtcccctctccatgactcctgggtattgccagctttgggggatgggaaagaggtagggcttgaccagaattctccagcatgtacagtcctattcatacacatgcatgcacatatgtgcacacacacacacgacacacgtacactctagtgataacactcagctaacttccctactcttggaactaagcctttgagaaaaacaaaaagtagttgcccctccccaccccacatacaaaacatagggactctctctaagaatgtacctttaacaattttttaattttattgtttgaatctgcaatatattcacctaattttttaaatacacaataggcaaagtcccatccccacctgttcccagtctggcttgttcttctcgtcacttgtgttagtttttttaattaggcctttcagagtttctttatgtaaataaaataaatataagtacatattcttagttttcttctttttttttttgagatggggactcactatgttgcccaggctggagagcaatggcactatcttggcccactgcaacctccacctcctggattcaagtgattctcatgcctcagcctcccaagtaactgggattacaggcacacaccaccacgctcggctaagttttttgtatttttagtagagacgaggtttcgccatgttggccaggctggccttaaacacctgacctcagattatctgcttgcctggacctcccaaagtgttgggattacaagcatgagccaccgtacccagccacctttcttctttctgacttgaaaagtagcatattacataccttatctgcacctgcagcaagtgcttttgatattttattgccatggatgtgcagttcttaacctcccctccatcttggtcactgagttaattcaaaggctcagcacctgcagctttgcagctcttcttcattcataaatgtaagtggattgatagtatcctctgtcattcccaaagtgttattagaaatgtctcttcattgttagtgataagatcttatagtatttcaaagtactttcccatttatcatcttatttaatttgatcttccccaagccccatgaagttggtaggacaggtattgtccttgtttttaaggtaaggaaaccaagggtaaaaggttggcattgtcacacgcctgggtctaaggactgtcctctgtacctgatgccactttatttctgttttccaaaaacaaaggaggaactgccttccatagttttgttaatacttctccatatttaccatataagtctttcatggttgttaaaactttttattttgggataattgtggattcacatgtaggtgtaagaaatagtacaaaaggctgggtgcagtggctcacgcctgtaatcccagcattttgggaggccaaggcgtgtggatcagctgagatcaggaattcgagaccagcctgatcaacatggtgaaagcccatttctactaaaaatacaaaaattagctgggtgtggtgacaggcacctgtaatcccagctacgtgggaggctaaggcaggagaattgcttgaacctgggaggcggaggttgcagtgagcctagattgtgccactgcactccagcctgggtgacaagagtgaaactctgtctccaaaaaagaaggaaagaaagaaagaaagaatacaaagatcctatgtacccttcacccactttctcccagtggtatcatcttgaacaactgtagtacaatatcaacaaccaggataggatactgacattgacacaatcaagaggcagaacaactccactaggaggatccctcctggtgcttttatctccacaagtccctcactcccccataaatgcaggaggcagagcccacccccaggcccagctgttgcttcatttacactgactagacacacacacacatacacacacacacacacacacacacacacttttaatgtattttgaaatggtggttttatcaggaaagtctaacacctataacaagcaacccccagtctctgtggctaacacagtaacgttttatttcctgtgctgtcaattcagtggtggtcattatggatgaaaggaggactctgcttcttgcagaagttctgggaccagcttctctgtctaatggctccaccattccctatggcctcagcatcctccactgcaccctcttcttcaggccagcatggcaggggccataggggtcaggcccagaagtggcatttatctctccaacacacagaatttagtcatttggctccacctcactgcaggaaggctgggaaatttgtttgggtatgcctaggagaaaaaggaaaaattgttgatgagcacatgttcaagaataatcatggcagtatctctagttgtagttgaaactagaagaaacccaaaaacccaaatgttcactgacagaggaatggataaatagtgtcaaatttacattattatacaactgtgaaaatgacaaactgtatctatacacaataaagacgaaatcttagaaccctaatattgactgaaaaaagcaagttccaggagacacacgatagaatttttatataaagagctcaaaaacaagcaaaaccagacaatctgtccatttatttattagggatatagaaatctgcattaaagccatgtttctaaaaaagtgaaggtgtcctggccgcagtggcacatgcctatagtcccagctacttggggaggctgagacaagaggatacgttgagcctagaaattgagtctagcctatcaagactcagtctctaaaaaacaacaaacaaaaatgaaggagtgataaacaggcattttaggacagtgattatctctggagagagaggcagggagacaatggagagagagggatggcaaggtcgcttcagcttgtggctcatgtctttgttctgagagggagcatagattcagtcatgttctgtttttctgctgtgtttcagaccttaagtgtgtattacaagtattctttggtatgtgtcacatattgcataatttttaaaagaatgaaccaaaacattataattagtagtaataaagataagtctttattagttctaagaatgtgacaaggaacagatctattgcttgagaaggtaattctgataaactggttttcctaatgctgtggagttgacccacactggggtggctctacccaagatcacaaatgccggcccccgttgtttggatcagccctcgtgccctggtcttgatcttttctggtcctcctgcagtttcctttaattgccttgaagtttccaaaagttcgttacactcatccattgactcaatcatcttcagaatcctagtatgaagtcttgaggtccactgtagagattatttgtctgcggagaaatcctacaaagctgttattgtgatccttgccaatgaaaggcaagttttacatatctaaatttactaaacactatccctttaaaagtatctcatacctacaaagatataaccaaatctaacatttcagcaaacaaaagctgaggcttgtaaccaacagaagtaattgctatacagttatcacgagaagtacatgcccagcttccagggtaaccacattacttaataaacatatcaaatctcttttatcttaaaagacccaaagaaaccaccccagtaatggttgccagccctgatccatcccttatctgttgctggcaaactgtctgtaaatagtcaatccagaacactcctctaggttgttttttcttgctctctcccttcccccttctcctctccatcttggaagtattcgcctttgcagtctccaccctctgtagagactctgtgctctctgcacccggaatgagtcagcatgtggatacatacctgcatttctagggaaatggactggggttatcagaaaactcaatctgtccaaccatggataaaaatcaagacattttattgcaacccagatagttagctcagcagctgcactctggaacatacagtacaactcctttgggaaatacctagttgggagtgactttcggtctcttgggtaaaatgttcccttctcatacagcaaaccttttgtaaaagggaaacagactccatccaaactgggtggtaactggagataaaggcaggccactcctgtttgaatgtttgtcattttgatgaggattttgtttaacaaggtttctaccttatctgtcttctttcagatttacagctccagagcccataaaagggaggccacagatgtgaacatgggctgtggaaagattagaaacaaactgaggctattcaatagaaataatcttgagatattttggattttttcttgtcatttttttttttttacattgacaatgacatcaggagctctaatagtatttgactgatagtacttagtagtacttggccaactatacatattaggaaaatgctggaaggcatattgtcttgacattatttatagcctgtgttctatttcctttactctatgctgagaaacagggttaagcctattattataattttattagaaattattttattgaacacctgttgggccaaacactgtatcaggtacttgaataagatatggtccctccctcatgaaattttttttttaagagacagggtcttgctctttgacacaggttggagtatagtggtgcaatcatagctcactgctgcctcaaactcctagactcaagccatcctcctgcctcagtctcctgagtagctgtggttacaggcacgtcccagcacacctagctgattttttattttttgtagagacagggttttgctttgttgcccagactggtctcaaactcctggcttcaagcattcatcctgccacagcctcccaaagtgctgggattacaggcatgagccactttgcctggcccctcatgaaacttaaaattaaattatctctttaaaaaggagcaggcctaggaacaagctctttaagtagtggtgtctggcacctatgtgcacactctgtgtggtctttatgttttggagagagttatggctgctgctgctattggtcgtgtatttgactgtacctgaaccacataccaccttcgtctttcctgaaccaagagtcgacctgctgttcacccagatggcatgactattccttcagtctgttgctatcttctgctgtttctacagaagagcctcagccctgaatccagatcacactaatagttgttatttatgaaacactgcaacataaaagtcatgattgccgttctatagcagagaggtttagtgacttgcctaagatcccacaggtggtaaatgcagaaccaaatttaaaccagttctcaaatgtccaaattcaaatgcagctctttctcttctgccttgctttatcttactcacacagtgatgtaatgctagtgtttcttgatccttatactgatatgatcttgccctcttccctgggattcaggaggcaggtctacatgagatgcaggcacaccgagttaatgtgtacagaatatgttccagagccttggagaaacaaaaggctatagcgtgtcttatttggttcttcccagtttggaagatagctgtccataagcacatagctagctctcagtgggatgtctaaggtgtttggcagtgtttgagataaaaggaggcagctgcttcacatatatggacgtcttcagaagcacacaggtgtaaggtcttaggattttcacccagcatcccaaatagaggagatttttgtaaatgcaaggtggtcgagtgtgtttgatttgattaggcctcaggctggacaagagccactacctcccacccaggcaacttcctgctgcaccctggatttgttccttcaaggattccccagccagtcagtgaaccaacatgatttcctctcctcgtggcctgggccctcacagggacagctgtgcttccaattccagtgacatgactctgtcacagtcttcaaataatttctagttttctttttcaaagaaagaaattttgagagctctgtccacacattgtaaaggaaacaaccctcttaaatatccatgccctttacagtgaatattccattgacatattaaaccagaggcagtctcatgattttgaaaaggattttggataaatatagaaggcatgtatcaccccaaatccatcctttatggagtcattacttaaaagggaaagggccaaccaggcaggttaacaatatggtacaatacagaaagactctgcttatcagtttcaaaattgtacatttaaaacaagttctcaagtttcagtttcattttatgtatgcatttatgctcaagcttggtaattaccctcagctcatgacatttataccaatcagtaatgtttaattatcccagatgattactccgtcagttctaggcacatggtggaatgtagaggtggttcctaccttcaagagcattaactttcagttggcatgtgtggagagatgtggtagatacaaatacattttggaaggggaggggaaggagagttatgttggctggtagagaattgggagaattcttttgggaaagcatccaagaggaggtggttttaagattccactttggaggctgggaatgatgaagaggagacaaaagattccttctgggatttagaccagcttactgttcaaaaagcaacaatgaaggtctgtgaccataatatgttcagaacttcaattcaaaggacaaatagaaatcaaacacttatccatgaaaaagttgtaaaaactaaattaaatatcaagttttttgttttaggtttagaaatgtggttgctgggtgtaataatttggacatgtcatgggaaaatgatcctttaggcaaaatcctttaaaacttgtagctttgaggaggaaagtggagtagtgatggaaccccacataacaaaagggacagcctgttgcttaggcaaaggctgcaagataagaggaacgcgaactggctcaactcaaggattcagaccttggtgtaattcagaacagtcaaatgaaggtgacttcagacttctgtgaagctcacttttgctccaaagagtggtgggagcatagcagaaagtcaagaattggacagaactttttcagtttgactgaagactcagcggggctccacgtaaaccaacagttattgagcctgtcccatcccagaggtacaggataatgcaagatggtccctgctgtcaagctgctcattgcctggcagggaagtttctgagaccaagaaagcccacagtgggatagggacttccgagggttctgtgggaatcagaagggagcacctccctctgcgtgagggagctggggaaggcttgacagagaggccattgaactggggactgacgtggctgggacgacatgtggagggatacaggtttgggaaatggagaggctgggatctgtctcactggaggagggcaagtgcaggaagtcatccatggccacactgcttgcagccagtcttctggaatgccgtggaactttcttactctggctgtgaagggtaaaaataagagctagcacaggcacatggagctgatacgacgtccctgtttagggcacagttcttacccaattccacggaccgaacattttctgctccatccagcttttaatggcagaccagtttctatgaactgaggcttcagcccttggaatgatgtctcatttgcccgtctcttttctccttcttaaccacttaggtaccacattgtacagtgcagtgggtgcagtggttcatgccctgactacgtcagaacccctgagagccttggcagattctgaggactgagcacctcctgcctttcttctcttctctcctctccctgttccactgttcaatctgaaaggggttagggaggattggttgctgaacttgtgtggttttaataaaatagcttcaggccaggcccagtggctcacgcctctaatcccagcactttgggaggccgaggtgggaggatcacttgaggtcaggagttcgagaccagcctggccaacatagtgaaaccccgtgtctactaaaaatacaaaaattagctgcatgtagtggcatggacttgtagtcccagcttcttgggaggatgaggtacgagaattgcttgaacctgggaggcagaggttgcagtgagccgagattataccactgcactccagcctgggcaacagagcaagactgtctccaaaaaaaataaaaaataaaacagcttcatgggtaaatctgatacccagcaagtgtggaggctacacaggcagtcaaaggagcacccatcttagtcaggaaactgggttaacttctcagcctcaccacgcagtggctccgagattcagcttcctcgtctgtgaaatgagattgacacttaccctgcctagctcatggaggtttgtgaggattaaatcacatgaaagcaaaggggaaggcgtcatgtgctatagaaatgcaaggtgttactcattcctgtgtttgccactcccgtgccttcacccttgcttataacctgtcacctccaggactagctcactggccagctggtttgtctgtggctcttgggccttgccaccacattaatcatttcaagacaccacctttatctggcggccttccccagtagacaggctcaccttccccatccagctttctctcccactcagccttggcctctttgttgacccttcttgctttttctccttgacctcctcatctttcttgcaccatttcttaaaagctgtcttcagcttcactgtctaaccgagcactcccacctgaataacacttgatccaaataacgtaattatgagatctgttatcttgaatggttccttaattgtcatatgtatttgcttcattattctgcttaatttgcttactgaggtccaggactaaatctaaaccatgttttgttttgttttttgagacagaatctcattctgttgtcaggaccagaatgcagtggtgcgatcttggctcactgcagccttaacctcctagactcaggcaatcctcccacctcaaccccctatgccagtagctgggactacaggtgcacccaccatgcccagctaattttttgtgtttttagtagagacagggttttgccatgttgcccaggcttctaaaccatgttttaactctttgttatgcacagcgcctggcccggtgttaggcactagacaagagctcagtaaccacttgctgaaatgggagagctgagtggtcagagcaccttgaagtctgtgtagcacttgcatgtacagtgtcccttttcatcgtcacagccctgagaggtaaatggtgtgactcttcccattttgcaaatgagaaaagagaaacttaggagaggttatgtaacatcaactttgtgggctgaggctgagtgaagacctcgcagaagagaccagacccagcatgctccagtagctccactgcagggggtggctgcttacgaggacagagagcagaattcagacgactccagctgacctacttggtgcaagtcaagtgaatactagtcgggagggattagatgactcagcctctgccttcgttggagtcaggaagtaggctttgcagtccatttcctggggaattttcagatggaccagtgatttcattttcctcttctaaagcacccccatgcacagggaaaggttgttcacgtggccatttggatgaagccaacggatctgatgtcttaaaggagaagctgaaacagcagtggaaactttctaggcctgttggtattagtaatttcattcctggccaaacatgaatgagaaatccttctagtccactttgactgaggctagagtgtggattaacagtgctttgatatttcagtattgctgcccaggttgtgaaggtataagcctcatgcaggtcacctgctcttgcctccattgtacctattgcctaactgggataggcctggggtggggctgctgagagctgacaatgccaggccaggaaaggcaagctaaagaccagcaggcaggcctcggggttggaaagctacacagtaaacgggtggagtaccaaagcttagttgtgtgtctagagaattcagggtgtggtgagtgatcagctcctggaagagcaaagattagtatttaatacatatgcatttattagcgtggctgggtctctcgtcaaaaatgtcataatttcacagatcaggattttaaagcaaatagaattattgatatatatctcttccaacagccaataaacatcccgcagagaggacagcttacgcatgggctcacacaaagaaaattgcagagtctttgcttaagctacagcctgaaatattaaaattctgattttcatgcgctgttagaaatagttttcaaagaattccttcctccagccccatcacaacccctgcccatgtgagaggttaggagtaaatcatatgttttttaaaacatttgctgaaacctcctcccttttccaagtctaccaaatttttatctcaaaaaaaaaaaaaagaaagaaagaaaaaaatgggactaatatgacaacaagatttttaccttcacagtaaatagtacaatttagctgagtaacttgtggaagcttgttaggttgaagtgactcacttgcgtagatgaagttatttttagagatgtaatttgtactgtttagaaaagaataaagagatggtaaaaggctagatcgctcattatagtttacagagctcatgaacccagcatccatgcaaaagatgactaagcaaggggtcggttggtactttctctcagaattttacagatgtgagtcatccactttagtctgcagacacagcaccgagatacctgtgactcagctctcatttagaaaaagccctagaattcaattctgatacacttttatagttaagtagtgaggaaattacatactgaagcaaaatatgcctttgtaacgcgcagccgtgggatgtttttagcaaagactgatttatcttcatctctggcctttgaaagaatcgacctgtgatccacgctgggtaacgtgcccattgagcctgctggtacacatcacagtgcccaccttcttcgtgtttggctcacaacccaagtactaaattgtcctcaatagaaatctcagcctcaccctttctacacttggatgccccagcactaaggcccacttcctttaaccaaatacatgtacatatatgtgttcgtatatatgaaaatcttctgcctaaaatattaaaattctagttttcataagctggcagaaatagcttgcaaaggcttcatctccttcactctttacgtatgttaggggttagaaggaataaaatcatgttttcctacagtattctcatatttttagtaaaccctgcacaaaacatacatacagatgatgagcattatctttacacattagcagacggcagagtgagcccatgttctctgtgcagggccattgctttgttctgaggcgcagggctctgctggcctagtgaccctccccgtgcagcctcatgcttggctatctccctcgtcactgacacacactgatgacatagcctgtttggagttaagcctcagaacgtaacctgtccatttattcatttatttttagacagagtctggctccatcgcccaggctggagtgcagtggggcgacctcggctcactgcaacctctgcctcctgggttcaagcgattctcctgcctcagcttcccgagtagctgggactacaggtgcccgccaccacacctagctaatttttgtatttttagtgcagacaggtttcaccatgttggccaggctggtctcaaactcctgacctcaagtgatcctccagcctcatcctcccaaagtgctgggattacagacgtgagccactgttcccggcccataatctgtccttttaaatatatggaaagtggtcccttgtagtttgcagacacatcaatagattattcataaccaacaaaggattttgtttattatatttgccaaagaaacatggacatggttgcaaaagcaaatacttcacaaagatgtataatgaaaagcaagagtaccccgccccatgcctgccctttcacagctgcttttaaccacttctggtgcttcacggttgcctccgtaaccagctgactgttttgttcctcacctgctatgtctgtagcactattaccaagagcgttcgggcatgcagaggttaaagtctggtcctattgttaaggagaaaagccttgtgtaccttcaagtcaactcagcaaacatttgagtatctactatggaccaacgtctaggttaagccatgtggtcacagaaatggatagctacactaaggagtttgtactcgggtaagggagacaggcatgcaaacactgcgtggaaaatgccataatacatgtgtagaaaccccctcagaagggttttacacatatgtcctagagctcagtcttggaagtgcaattagaaatctggtaggtagataaagaggaaaggatgtccaaggcagagagaacagtgtattcgtgggctgatgcaatccattccaaatattgggaataattcataaaatctgatttttaggataagtgagttaaggaaataatgtggagatgagacaggaaagaaatgcacctagttataaagacccttttatatacaccgttcaaaatatatcctattactgatggaaagctttgggagtattttgaacagggatgtggcattttctctattatactgtaagtccaatggcagaggggaggatgaattcaagtggaagaagctggggtttgataaaccacttgggaaactggttcaggaaagataatatgaggtactgaaacagtgggaatagggaggaagaggaaaggagagattctagaaatacttcagagtagaatcaaaaggacttggtgaacactcagattttggaggtgagggagagggaggaattgcagattactgtataactcctagctagggtagctaaggaaagagtggaaattttaagagtaccagaatctggaggaaagtgagtgagtttgaatatattgagtttgaggtgtttatgtgataagcagatggagatattcagtaagtagccaaaattgtgagactaaagtggtggcagtagaagccacagagctggtagaattcccacaggatgaatctgtgatatgaggggactgaaaacagatctgggaaaggccagcagctggcgatgggctgaagattcctgatggagaccaatcagcagcagaggggtgagatgagaaccaggagagagggcaccacgaaggcagcagaggaccggatctggggaggtgcaggtgacaagggagaggagcatgaaaagcatttgcttcagtaatgatggtgcccattgatggtgtagaaaaagaaacactcatgccttagagtaggcggaagccagatgtgaatgggccacagaattcattcacagtgaaggtgagcccgtcctcttttgagaatttggggaattaaaagaagagtaaatgggcaatagctagtagggatgatagtcaagaggctgctttacaggatgagagaaccttcagcatgatgagaaggagccggtggaagagaggttggaattccttggtatggagttcggcttcctctgagcaaagaggttctgctgcctgagtggccccttggagccactgaggagtttgccttttgctttctctgccaccaccaggtgaataggcggcttgggaggtgaagcctagagttacccttggacctgaggtttcgtcagccggaaacctccaggcagttcagcagtgatgcacatcagcaaagcagggccatccatcttgtgagctgctttttgttatctccactttgattatctcctaaataaaaatggcacagtatgaaacaaaataaagcctgagtaggagccagtcagtccttcctccaaatcccagcagcctttcgtgcagcctcctgttttagcatttctcatactatattgggattattttgtttactgactttcccaaatgatgagccctctgaggcagagttcatttttgcttcatctcgaaatccccaacttctgtattcaaactccttaccccttaccataagggttagtgcagacagggcagctcaaaggcttttttttttttttttttttttgagatggagtttcactcttgttacccaggctggagtgcaatggcatgatctcagctcaccgctacctctgcctcctggattcaagcgattctcctgcctcagcctcccgagtagctgggatttacaggcatgcgccaccacgcctggctaattttgtatttttagtagagatggggtttctccatgttggttaggctgatccgaagctcctgacctcaggtgatctgcctgccttggcctctcccaaagtgctgggattacaggcatgagccaccacgcccggcagaggctttttaagtaaatgtaaaaactcacataccttttcttatttgacttataagaacgcatttggtcctagtctcatatcaaatcataactaattttttttttttttgagacggagtcttgatctgttgcccaggctagaatgcaatggtttgaacacagctcactgcagccttgacctcctgggctcaagcagtcctcccatctcagcctctcaagcagctgggactacaggcacaggccaccacactcagcacatttttttttattttttgtagagatgggatcttgccatgttgcccaggctagtctcaaattccctgggctcaagcaatcctgctttagcctcccaaagtgctgggattacaggtgtgagccactgagcccagcctcataactgatttttaagtatttaaaaatcccacaggtcattctttaacatgctaaaagttgctctaactctcagtggtctagagtcccatggtcaagaatactcatggtcaccttctttgagtttcagacaaacaactctctttttgtacaagtcttaaactgctctgctctttaaaccaaatacatacacacatacacagatatagttagatacagatgtgtgtgcatataaaaatatgacactccttagtaaaatattcctctagacctggggttcacacatccctcctcctgatccgtgctggtgcctactcaggcactactttgcagatttctcttctatgagctaaggtttttctgagctaaggtcaagcggtgacttagcaagttgaacgtgtaatgaaccaaacctgtttttccatggaaccaataataattaatctagaatgagccatttggcctccagaaacaaagagatttccatcacagagtgttggtgaggggtcatgagtaaggcgggggggcagtgagagcagctgttttattgtgagagtagcaggcaggctgaatgagaaggggttagctgttgagtccacatcaggctctgctgcagtgtggccagggttaaggtactttattttaaagccctttggaactttcctttctcttttatttccaatctgatttttttcatctgtccttaaatgctctgtgtatatgaacttcaacttctttattcaatccctagtcttttaacctgagcttgatgggctataccacaccttagaaggaaaggctacctaggcctcccctgggctgcccccaccggcattcaaggattgtatttttatccaggagacctgggctggtccctatggaggaggacaaggggcacaattaaggtaattaaactggcctccacgtgtaggacagatagaaggacaattcttggaggtagacaaagcttactgaattggtgtgatgtgattggtatttaggattaaccaaaagtatattttgctgtatgaaataggtcaatactttaaaaaatatacattcccattctgtttatccatggcggaagtaaatgtgacccccccgagccccaccagtctcctcccagcaggatattgtcctgtcctcttcagaatgggagcctttccagagatggaagcagcagaatgaagagtactcaaagtgactcaaaggttttgcatttggcagaatattagacccaatctgatggtgaatggggagcaggttgtaacttttatttcggacgtgtagtataattcttctccagttagtaccagaacattctagtggcatcagagccactggatttaacatctgaaggcttgaattcaaggccagctctgtcacttaactaattctaaacaagctactttgtgttcctgagtttcagcgttcttgtctgtgaatgggatggtatgcccatcttgaagacacaaatgagacaatacacatttgacctgtaaagtttatatgaggacatcctccaggcctctgaaattatcagactggagcagaggtgagcagtcagggaaggatatggagattttgaaggcttcaaaggttactgacagatgagactttctgaaaaggaagtgctgaagtgccaagccttcaggcttaacaggtccctcagctgagctttgggagtgagggcatgttaagcagatggagaaaaagaggcagtaaaaaatttaaaaggaagaaaagtagcagatcaatacagtgttgtggaaaccatgggagaagaacagaagtgagcaacagtgtcagatgccattaaaaccccgtagatataaccgtaagatgttttcccaaccaaaaggaagaaaacaaggacatggaaacatcaaaaataaaaattcttaaaagtctgagctcatcatgcccttgagcttaacttggtctgaaagacagacatcatactcctcctctggtccaaaacgactgtgtttatcaatctctcagacttttgtgctttcttgatcaacagccagagatgtgcttgcctatagcaacccctggctgaaatggtagatcagccaaaatgcccaagcagaagctctttccacaatgtcagaaacaagcagtaaatcacatttatagcacttgtagatacagcatgggctccagacacagcaggcagggtcgaatcctggccccatctcctcacagcttcaagttctctggcttgcccaaagccaggcttactcctagtagaaaggggcgagggggaatcatatggcagaaagtatccagcacattgtaggtattcaataaatgctgattttcctcctttttcttagcattaagaaagtatttatagccgggcacggtggctcatgcctgtaatcccagtattttgggaggccgaggtgggcgaatcacgaggtcaggagttcaagaccagcctcgccaacatggtgaaaccccatctctactaaaaatacaaaaaattagctgggcatggtggtgggcacctgtaatgtcagctactcgggaggctgaggcaggagaatcactgaacccaggaggcagaggttgcagtgagccaagatcacaccactacattccagcccaggcagcagagcgagactccgtcccaaaaaaaaaaaaaaaaaaaaaggaatgaaaacaaaacaaaaaaccccatgcctaactattatctgtagtaagagatctttcaagcacagatgaatcagtaacccaaagtcgtacagctattgtagtggcagttactgtgttcctgcagggagatgtactgttaaatacagtggccttgtagtgtgtatgtacctcactgggcttggaatcaagaccctgggcttctctctgtggctgctgaagcagttgaggcagttcaccactctatagcgtaatctcatttgtaaaacggagagttgatttcttgggctcctttttgaactgtgctttagcaagtatatcctctgttatgacaagactcagagatttttaagtaaatgtctcacctagctacagtacaccctgtaagtacacttgtcaaaagatagccagaggaagtaactcaagagggtcaccacttctctgtatttcaccctcaggcctggctctcgccttctagtaaacttggtggctggttcccaagtcccttggaacattctgtgttttgtttgtttgtttacttgttagtttgtttcaagtcccttgcagtttaactacccagagaaggtctgtggtacatagatacactaaccttgtaagagtacaagaagagtaacctaatagcctgggcccaggaggtaggtgtggagggaaccaggaaactacagatataggccacacttagcttagggactggcgtgtctgattaggccttggtgtcacaattgtatggcccactatcagtattgatattcttaaatttgactttgagtcatttagaaagggataggggagcagtaaatgtaaggtccattttatagagatttttatcaaaaacaatgaaaaataaaagttttagagctttcaaaaacaaaccccagttatctggaaagcacagctgtcagaaatggtttactgactgtgaatatgcatgcttttcttcggattaacaatgattcaatacctttgattgaaaagtatcttattcctttaaatttggatgtacaagtcaggcaactcactcaagtcaagggcttgcctcaacatgatcaccttatgtttgcacagtttattctctttgagttagttaaatttcagaataatatgacaatttaaaaacagtattttaggcagcaatcatacctttatctcaaatgaaatttctaatcagaattgctatcaaagaggaacattaatttccattcccctgctgcctgtcccacccatgctcatagaagaagtaatgaccaaggagctagtcagaaaacagtagcaagaaaacaaaacaaaaagctggacaattcacaggccaaagaggtaatcctaaatatacaaagattgattatattgtgggtctttaaaaaaaaaaaaacactcacaaataaattggttagcaaaaaaagaaagagcctttatcttaaagaaagcacctatgagaatggagagaatattgcatgatcaaagcacaaaggaaaaactgtctgaccgaggtttcatcaggcttcctctctgttcagatctttttctgatctgtggtccggtttggctgcaggaccccatttgaccgtagattctctagagctatgattttttatttgctggaagaagattgtagaattaaaaatgaagagttccaaaggactctgaatttacctcaaataaatagatggacaaaactaagttgaaagcttagttttcaacttgttttgaaagttgttttgaaagcttggtttgtattttctcagctggaaatcaggctaggaaaagaaattatatagactcaggtttgtttgtctgttttaattgcttctaagagaaaagtgagtaataataggtatcatttatgaagacctgctatgtgccaagtattctgcacatatattcattataccatgtaaaccatccaggagccttgcaaggtaggtattatcccattttaaagatgagaaaacctagacttagagagtatagtcagttgcctgaggtcaggtagcaactggcaaaggaggaatcaagcccagatctgtcaaattccaaacaccgttttcttcccagtatgccatccctcccatccttagttctttaggttgcagcctgtatttattgagcacttttctatgtgcaagactgtatggcgtgctttacctgcttcatttccaaccctgagcttaaagttttttccagtcttgggaatgggaaaagaggagcacagaggtcagttcacctgccaaagcttgcccacctcgagtacacatgccttcctcactcaacactcggcttcacccagataagctgttccccacccatcttgcagactgagtggctgattttttaacatttctggggaaaatatccccattccacacattctagtgggtcagacattgtcctataattgtaatatccctgcacggtataagtccagcatggaaactgcttggaaaggataatgtagaaataaaaataggttaatgaaggtttctgcatgggggaatgacatggtgaccagtgcttctaaccaagtcttatgaggaaacatgtaatccttctgccagatatttgatttaaactgtgtcctgtgtcagccttacatccaatcccaaacttcaggcctgactctctggatttttcacatagtaagtccattatcaagccttccactcagcatctcccttgaacataagagatgtgcaaataagtcttttttttttttaatggaaacgggatcttgctatgttgcccaggcttatctcaaactcctgggctcaagcgatcctcccgcctaggctcccaaagtgctaggattacaggcatgagccaccacaccggctgataagtcttaagagatgttttgtagagaggaattggttcctatactgagaagtaaatagtcacccccttctactaacgaataataacttttttttttttttttttgagacagagtctcattctgtcacccaggctggagtgcagtggtacaatctcggctcactgcaacctctacctcctgggttcaagcaattctcctgcctcagcgtcctgagtagctgggattacaggcaggcaccaccacgcccagctaatttttgtatttttattagaaacagggtttcaccatgttggccagggtggtctcgaactcctgacctcgtgatccacccatctcggcctcccaaagtgttgggattacaggcgtgagccaccgcgcctggccttatttttgatttgtacatactttccaaagcattctccattctagaggattgtaccatgctgggggcattataggaaagtgtctgccacactggaatgagtggtgtgagcttttttccctagaaatgttcaagggtaatgctcatagaaagacgttcacagtccttcactatgtgttcagagcactccacagtttgcaatctttatccagagcctctctgctccagcttctgtcctccagcctgtattccgtctacccagatcccccgcattccctcgctgggcctctacggtgactgcttaatacttttccctctgcctggattctcttgcttctctccctcccttcccagtcatagtcctcccactgccactgcctatccaaatcctagttgtttttcaaggccctgctcaaagcagtctcatctaataagcctcctagaagcccttcgatggagtatctttgcacccatactgcatggtggttgacacctctgttataaccttcgtcctcgtctcctttcctgagaacagtgagttgagggcatgctgacactgtggggaggagttggccttactcagctgggtttccctagagccggccatggtatgtgctcagggaatgtttgtcagtttggatacatgttgttttctctagaatgtaaaggtcataactagatcctttagggaaaaaagttagattcatttgaggaacttttttttttcttcctaaagccacattagtcatacttcgcattggggtagtcacaatattcccaaatttgtatctaactgcttcattctaatttttcaagacaggaatttaaactgaccctttactttaaccacagacacctcatttgtcctttttcttctaatcatttacatttggtacattgtctatgaattctttgaaattaaaagcttatgactttttaaagactttgcccaatttttaaatgctaaggattttgcatttgaatatattgtaatttatttaaggattcttttaatcaaactcttccttaatttaaccagatttcttttttaatcctcccaggccaggagtttatttattgtgactcaattcttttaaaaatagaagttaaaacagtactaaatgctatttatggtgttctctcttgctcaatttctttctgcatctcataaaagcatgtttctttgtacatgtctagtgcagtccccatttcctcactaatcaatgccagttagtcactaaatatgcatccactacctaccgtgtgtctaacccagtggcaaacatgtagggatctaacataaagataagtacactgaaattgtcaacaatccccctgagaagtggattatatggacatggaggctggagaaatcactgagcaatggagcatgcaaggaaggcttcctggaagaaggcggggcttggactgcatcacagagttggaagcaatagcaggttgaagggaatgaacacagagccaggcccgaggaaatgagaatgtcagagcagcaaaggggccaggatccaagtaggtggtatatccagagggcacagaacccagatggcatagcaggcaggaggtgcagagttcacacccggcccctctccaggaaatgtggaccctcagttccagcaggcagcctggaacagagaatctgctcactcagtgtgtgatggatgagggagtggatgaagcagagggacagagaagcacttgggacaggaggggttcctactttggggaccccttcatcccagcctcagccactggtatgcttttgtcctcatgagaactcaccctgagtgagccctgcttgggagcacaggttggaagcatgcagagttctagaaaagaggtatttctgatcatctgaactttgatgagagtaaaaccagataaacccagaaaagcaaggggcgccctccagacagggagaaggacttggcctgtgagcttcctgacaccagcgtctgcttccttcatctttgtgtcacctatttctcttcacagatacaaagggcaggagagtagtgggaaacattggtaatataggacaggttgtggcttttcttttcttttttttttttttttgagacagtcttgctctgtcaccaaggctggagtgcaatggcgtgatctcacctcattgcaacctccccctccccggttcaagcaattctcgtgcctcagcctcccgagtagctaggatttcaggcacccaccaccaagccaggctaatttttgtatttttagtacagacggggttttaccatgttcgtcaggctggtctcaaactcctgacctcaggtgatccacccacctcagcctcccaaaatgctgggatagattatggcttttctacatcgaatatgagataccaaaggagcaaaattaaaagtggagaattatgtttacaaatatcaaatgggttattgaatcttttcctttctatgagatattcctgtctccaattctgattcaacttgtaaccatctagaaccaactcaaagtccatctcttctgcagagcggtaacctcaggcggctgcccttctccctgcgtgacaccgcgtgtgtgcctctgccattgtcttagcatgctcaactgaagttgcttcttgaccttgccaggtctccttttccagaccatgagctcaagggcatggacaccctcattcttcctggcactctacccactgtgggttgttgttttttttttttttctgaagactattcagttttcctgaccctcttagtttttttaacaaatgcccccattttcaaagtaatgtttatctgtttatacacacgcgcacacacacacacacacgattatgtaaaacatatccacacactttaaagattcataaacactactcaacttaagaaatagaatagtgccagtatcatagacgtcctgtgggtgtctctcccagaaggaaccactaccctgaattttatgttaactgccctcttgattttctcaatagctttaccacctagtatatatccataaaaatatatcatttattttttctatttttgaacttaatataaatggaatcatactgatttctgcgtctgtgaatattaatgtcttacttttttaaactttttaaaattataaatatttaaggcatacacatgtgtataaagactatgaaaacaaatacccatgtacccaccttaatcaaatcttcataatttgctgtaattgcttctgagtttttttaaaaagaaatagcacattgtcaggccgggcacagaggctcatgcctgtaatcccaacacttgggaggccaaggcgggcagatcacctgaggtcagaagttcaagaccagcctggccaacatggtgaaaccccatctctacaaaaaaaatacaaaaattagctgggcatggtggcacacacctgtagtcccagctacttgggagtttgaggcaggagaatagcttgaagctggaaggcggaggttgcagtgagccgagatcacgctaccacactccaccccgtgtgacagagagactctgtctcaaaaaagaaaaaaagaaaggaaaggaaaggagaaaggaatagcagaaaggaaaggagaaaggaaaggagagcaaaggaaaatagcacactgtcaattcagttgaagccccctgagtgcccctccaaaatgcacccccatcctttactcattcccttttccccacccacagaggtaaccactacccttaatttggtgtatatctttcctatgcatgtttttatactttaattacatagacattcctaaatagtatgtaatgtgtgcacgtttttgatccttgtaagtatatactgaacagtgttcatctgcagcttgcttttttcactgaacatttggtccttgagattcatctaggttgacacatgtagccctagctcattcatttaaactgctgtaaggtattcctgtgaaagaataggcacaatgtatttatccggtctcctgttgatagacatttaagatgtttccagtttttgttatcacaagtggggctactttaggccttctcctgcgatctttttacacacatgtggtagtttcttaagagtggaattgctgtgtcgtggagtacatacacctttacttttactgtacaaggttttagcaatttatatcatcatcatcatcatcagggaatgggaattcccaatgttccacagcctgacaacacttgggtattttccagttttaaaatgtttgtcaatcaaatgggcatgaagtggaagttcattgaggttttaatttgcatgtgctttatatgagcctttactgagtgtttctcatgtgtcatgcgctgtactaagtgctagaaatactaaaataactaattcacagcccctgcgcttaaggacttcatggttctctgcagtgattcctacctggggaggcgaattaaaatcacttgaggtgcattttcagaaatgaggtttagggaatgcaggctcttaggtaggaggcatttgtgaaatagtaaaagctaaatcttccttaacacttgggccatcgtgtataacttgttaatgtgttctctgtcatccaaaaaaggctaatttattttcagtatatcatatttactgagacatgaagtttagaaagattttcatcaaaatagttaaaatttaagaacctgaaacatatgctacagttatcagaaatttcacatatacagaacagtgtataaagttagatggaagaaaaaaaccacttaaagaagggtggtagggaaaagaaatgaacacatactgagtacctgtttggtttttatttagttctttcaacaaacactatgagatagaaattattatcctcattttacagatgagaaaatcaggattcaaagaggagaaatattttgcctatgatatcatcactaattaatggtgtagccaatatttgaactcactttatctgacctcaagggcataccatgctgtctctttccataataggattttttagcatatgtggaaaaatccaagaaacttcaagcttcagtttaataatattgaaacttcaaagataagccgggcatagtggttcacatctataatcccagcactttgggaggccgaggtggatggatcacctgaggtcaggagttcgagaccagcctgggcaacatggtgaaacccagtctctacttaaaatacaaaaaattagccaggcgtggtggtggatgcctgtaatcctagctactcgggaggctgaggcaggagaatcacttgaatctgggaggtggaggttgcggtgagccgagatcacaccactgcactccagcctgggcaacaagagtgaaactccgtctccaaaaaaaaaaaataaacaaagataatttgtttacatgatcatatcataaccagcttaaaccagtgaaaagtagaacacatgtaacaaaatctggttaatatttagtctttcttgtcacttaaaagaaaggtagtgataataaatggagataccttaaatagatacttctgaattggaaaatgttacttttatatttcttgtaggtgagtattttggatatgtagtgttaattttccagtggttggaatccacatgtctcaaaggtttagtgtgtaggtagtaagatcgtggttgctcggtaaatatatggcagtcttcccacattgtggggatagcctgggaatgaaaagtatacagattgctctcaggaacaatcagcctcaaatggaatcctcactggagagtgactttacagcaattcaacaaggggttaaaacgtttcctaacgaggcttggaggaactggagcatcctgagaggactggaaatgggaatataaccataaccaccacaaagcgcatctatgagtatcttccctgccgacccaagatatgggggaaagcgcagaaatatatagtttggaaggtttgaagaaatgaaataatggccaacttgtgaataatggtgaaaatatttgatgatgtgactcccagggaagcaattatggttaacccctcatttgtttggcattttcaaggatcgaactgtcccgcaaaactgaactttccagacaactaaaattttcctgtttatatgccttgaatgctttcttaaccatgcttggtggaaatatttctgaaatagattatacaattatatgtacatagattatacagttatcttgccttcttgaacagaagcttcagaaaataacgtttccttagatgcctttgactgcacgtatcagaagaccctattataagaggtttaatagtaaagattgtctcacataacaagaaatccagagctgggtagttcagggatgatgaatccagccacacaatgatgacaggctgactttccctcatggtcacaagatggggcctcaactccaagcctcaagacctcacatgatcagctctaaggcaagaatgagatgggggcttctccttacacgtgtgtttaatcagagaggaaaatatttctcaaaagacccatagcccacttcccttcaggggctattggcaggactgagtcacatttccatgtcttggtttattgaaggctgagtgatatccagcactgtcagactctggggtgagaagaaggttctgcccataagaaagaaggatggagaatggctgttaggtacgcaaccacagctgtccgccaccactgccaagattgggagtgaatatcacttactatatggtgatagcttaagtgacagctgggatgtatggagctttttgttactacactgaatggccagactgggattctttcagctctcctaaccctgcttgtatttattctattcttcctctgtgctagactgcgaattgtgactacttgcctttaatgttccttgtcctcattttgccataattagatactttttttttctggagaaatcatataatcaaacttgttgaactatgcctgaaatgttgagtgtctgataggctatcctgggaatcacatgcatggtatggcatttcttttggctattcatttttccattgttgaggtgtttggagaagtgagaaatttctagaaagtcttatgaattgagataccaccttactagagttgtcttctagtgaaaagatgagcatttaggggcagataagcatgtttgcttgggaaggtagaaatgcagccactacttgaacctcaccagagttcacagagaggcagcatagtttatcagtgcattcggctttcccccaaagctgcatggttggctgttgtctggagagcaccacaagctctgggactgcaacccgcggaacccatcactgcagtgactgtccagagtgaggcaaccggtgcagagcttaattcttcctcccttcccccagggcttcagagccttgtgaatgcatcctgtgaactgcctggtttgtgcagaattaagaagcatttggtgtgacttgtttcagcaagttcttgaagaatgcttcagaaatagttattgagaccgagtgtagtggctcatgcctgtaataccaacactttggtaggccaaagagggaggatcacctgaggccagcagtttgagaccagcctggacaacatggcaagaccctcatctctaaaaataaaaaattaaaaatttaaaaaaagagaagaaagaaatggttactgaaattctactaaacaggtgcagaccatcccctctgtggatgaagagccaaccaagatttagtctctgtatatgggaagaaggaaataggaagcagttgtcaaaataatactgacactaagtaactgaatcaaatgagatgattctgctctaagaatcaaacctgacccagtaggttctaagaaagcaaatggctggccaggcatggtggctcatgcctgtaatcccagcactttgggaggctgaggcgggcaagtcacaaggtcaggagttcaagaccagcctgaccaacatggtgaaaccccatctctactaaaaatacaaaaaattagctgggcatgacggcaggcgtctgtaatcctagctacttgggaggctgaggcaagagaaccacttgaacctgggaggtggaggttgcagtgagccgagatcgcaccactgccctccagcctgggcgacacagtgagactccatctcaaaaaaaaaaaaaaaggaaagaaagcaaatggttaaagtgttcaattttgatatagctgaaactatgagccccaaatccttggaatctgggcggttccttcagagcaagttagctgttggaagtcctaaagtaattattttactatgcatcagaaaatcatgagttaacctataggcaaaagttaagtgacagaaacatttggggataaggaaagcaagttttaatttttttaatcttgactaagttgtaccattcaaatcattcttgtcagaaaaatgtgaagtatttctcataaatattttagttattaactcattcttatgcatagaacattttaaaataagccatcattttattgaccattgactgatatagacaggatacagcttagttaagttgagcaagatactgtatttttaaaattttattttctcatatgtgaattgccagttttatctctgaagtactctgactgttcctgctcccctaataatacatttactgtgtgcactgagaaagtattcaaattttaatattggcttcaattacactttgttagacaaatctccatggagaaataataatgtaatcaatgctttttggggactgtggtagatatcaacattaccttgctgctgttttttaaaaatcagaacaactcacttgcccaggtagatacatttccttcatattttgaattatttctgatgctaactgggcatttagggagtcaaagaagatggttccaaaataggtgggaaaaaatcattttttagcatattaaaatattaataccagcaactcattttctacaaaacaaaataataagaacgaaaatagaaggcattccaaaacccgaaaaagccagtagcttgaaaatcacatagcctgtggtattatctgcattgctttggatactgagtgatgactgtatttgctttaaatttataaattattgcaattgagttctactgtttaaaattgttgctttcttgtagggaagctctcatggtacttttctgctggtaatgattgctttggaggttactctcaaccttgttttatatttgcaaaagtgtacatagtataaaacaactgaagtcaaagtatatgtgaataggcttttttttttgagacggagtttttctcttgttgctcaagccggagtccagtggcgctgtctcggctcactgcaacatctctctccagagttcaagagattctcctgtctcagccttctgagtagctgggattacaggtacgcaccactatgcccagctaattttttgtatttttagtagagacggggtttcaccatgttggccgggctggtctcgaactcctcacctcaggtaatctgcctgcctcagcctcccaaagtactgggattacaggagtgagccaccgcgcccagccacgaataggcctttttaaaaaattaatcagaagaggcgcggtggttcacgcctgtaatcccagcactttgggaggccaaggtgggtggatcatctgaggtcaggagttcaagaccagcctgaccaacatggtgaaatttgatctctactaaaaatataaaaaattagccgaacgtggtggcaggcgcctgtaatcccggctacttgggagactgaggcacgagaattgcctgaacccaggaggcagaggttgcagtgagctgagatcgtgccattgcactccatccagcctgggcgacagagcgagaccctgtctcaaaaataaataaataaataaatattaatcagaagaaatggaagtagtaatgagaaaagatacaaagttaattttagaaagcaatatttgtgcagagtgactgaaaacgttacagatcatgctttgcaatatgcagggactcaaaagcgatttctgaattgaattattgattttaatcagtctttcgtattgttcctctatactatgaactctctgctttggcaccaacagacatgtattcagactgccctattgtggtacttgaaaaatgtgactaaagagtggacattcaaaatcgtgcccttttctctgactgtcgtgtgattcatctgtagaaaccccctgcagcactgagtcagtcatcatcagagtcaagtgcactccgagtctaagaggccctcccaactggatggttttttgattctcgggagttttttggcttctccttaaaagtctgctgcggacctaagttttccttcaagaaatcatattgagtgctgagagtacctagtccaagttgaatgtcaccccagactagaatagtgatagatgtataattatctagcatgtatttttatttatttatttatttttaagacggagtctcactctgttgcccaggctggagtgcagtggcgcgatcacagctcactgcagcatccgcctcccggattcaagcgattcttctgcctcagactcccgggtagctgggattataggtgcttgccaccacgccttgctaatttttgtatttttagtagagatgaggtttcaccatgttggccaggctggtcttgaactcctgacctcaggtaatccacccacctccgcctcccagagtgctgggattacaggtgtgagccactgtgcctggcctaattatctggtatgtatttttaaatatatcttcctcatgtagctaaaaagacgaaccttatacatacttcataatgacaactttagcttcctaaattgtgacatagtgaatgagtcgtaagcaggttatgccagtgtcctctggagtaggagaaggcaatgtggggcatagtaggagccgaatgtttgaatcatgggactagatttgagtcttgcccctgcctgactatgacatgagcaagttaatatacctcttagagtctctggtttgctcacctgttaaatgcaaatgttgaagataatgtctctgtcatggagttctaagtaacaaatcagataacgtgtataaagataccctgtaaatctagaaaattctatacttgtttttcttattatttttatgctgttcctattctttgtcctagaagtggataacattcatacacatatacgttatatacctttaagaatgtgttattgaaacagtctgtgtttttaatgatgatttgcctcaactaataacaagtcagtttacttttaaaaattgagttaaagaaccccaaaatgaaagataaagcatataacacatgttaacagcaaggattggaattagcctgtactatcacagcaaacatatttagtgctcagagtagtaccttatgcgttccattaaggaactcccactgatttaggagatataaatatatgtggtaatgcatatggaaaaaactgaaactgctgagtatcaaaattcactgcttgattggaagtagagtgataacttcatttttcctggtagtctggttgccatatcctataaagtagaaagattatcacctgcactcttaccgcttctccaaatgcattcttgaaaaacagcctctgtcccactgcctccatcaaattatagatgtggaatacattgcccaacccttgaagagtttatgttataatagacacttaaaacagatagaaagagaactctgctatggaatattgatcccgggaagtgctagagaggaatgtcagatggttgcaggcacccaagcatccttccctaagcttctgtgaccatttcaaagcattcttacagcacctacacatcatgccttctattggtgacattttcacccacgtgtgatttgcctctagattataaactcctcgaagatggagaagtcactttgtatttcttggtgcctctctatacaccacacctttcatccaaactgcaagcagtatttgtggttcaaatagagtttcgtacctaacattcggatttagtcaaaaaaaaaaatcttaagatgtgtttatgctctaactttctttttctttcttctgtctttgcagttgacctgcctctgtttttccctcgagaccagccaactctcacatttcagtccgtttatcactttaccaacagtggacagctttactcccaggcccaaaaaaattatccgtacagccccagatgggatggaaatgaaatggccaaaagagcaaagtaagtgaatctgtcgttatttccaacaggtaagagcattttgtttatctagtccaggggttggcaagctactgcttgcaggttagttcctgccctgtgcatgtttttgtaaataaagttttatagaaacacagcaacacccatttctttacttattatctgtggccgctttaatgctacagtggcagagtgagtagttgcaacagagactggatggcctagaaaacaaaaaatatttactgtttggccctttgtagcttcatcaggaagaagctgatctacatctgaaagtgtttcctttttctactgtttctgttggtctctaaaattagccatgacagcttttgttttttttcatggaatgtagaatttatcagaaaactacctctctatttagagtagaggataaatactaaataggaattcgagttgtgggtaaatggcataaatgatgaaaatgttggcagctactttttatagttttttaaaaaatggaaaatttcaggtggcagtaaacaaacaatttttgcttagtagtcaacacctggagccggtagctactctttcatatggaaatgaatctctgaattctatacctcattgcgtctctgcagtgtataccatagctgttgcccaaagtaggacctgtgtatttcttggtcaaataaacagctacacaaatagcttagggctattagaatagatatggaagtaggatttcatagaggtcgaagttagctaaagtttggagtttagaggtacaactattgctcatgaacctctcagtgtggaaggcctcacttcagtcatacagaataggtaaatatagaaatatgctgagtgttttttatatttaagactttggtgtctggaacatcagtcttcataaaccatgacctcctagattgaagaagcagtggatcaaaatcatagtttccaaaaataaatcgaagagtgcatgtggttataactttatcgcttggaacagtcatatgcttcacacctgtgatcccagctgaaggatgatcagatccaaagtatcacacaaatatagactatctattaggcctcctcttcatttgctcatccagtatttattaagcatctaccatgttccaagcattgtgctcaatgctaggaatataatgataaacgaattagaaattgtccctgtcttcatggaatttatagcccagcaaagaagataaagcctttatcatatgaaacttctgacaatttcaaagtacctactaacaaaacctggacctccagatctggaatgttcttgattagccatgactaatcaagaacttagtaggacttcctgttcttgcctccccctcccagagagaccccattcccttccatggggcctcctgacctcacctatatttttctgtagtacaagactttcacttatagcaggcttgataactttttattttattttattttattttattttgcgacagaatcttgctctgttgcctaggctggagtacagtggtgcaatctcggctcactgcaacctccacctcccaggatcaagcaattctcctgcctcagccttctgagtagctgggactatcggcatgtgccaccacgccggactaatttgtgtattttgagtagagatggggttttgctatgttggccaggctggtctcggactcctgacctcaggtgatccgcccacctcagcctcccaaagtgctaggattacaggtgtgagccactgcgcccagcctgagattcttaaataatgtcagggtgtcttcttctagaaaccagactgcctcagatttatatgcagaatccagagttgttatctgaaactttaatgtgccttcttctttccctttattttctctttttatccgtgacacccaagtctgaaatcccattcaggacaaaaacaagcatatgcaaatataacaagtaacaatgattaagacttacacatcctgaaatacaatggaaaaaaggaattatgaagtatgttttatgcttgaagtattgatatcgtttaattttctgggctttccttgtgtatacataggatctgccctaagaagatgggcattatttgtggtacgtgctgaaccagatgtgtctttgtggtttccatggcaaagctatcttggtgtgtatgtgtgtgtgtgtgtttcctaagtagacattttagcaagtatgaattgagtctttaagaagttgcagaccacaagcccgtgatttcagtataggaatatcgtaagtgaagcctgtttatcttaacagattggttcagagtttcaagagacatttgctttatgttaacaccagtctaaagaaaacatctgaagtaatgtttaaaaaatctgctttctactgtagcgaagatggatccattttaaatgtaataaaagagaaagccagcagctcgtgctagcaagaagaaatagtttaagtttccattcttcagctgaactgagtaaccaccctgtgctgtgtcagaaagccagataaacaccgtgaaagaactgtcctgcagtatagtcttgagattggtggagaaggttgaagacaaaggatggaaagagaggagggtcaactgtagcattccttccacaccctgtttctttgtcctgtgaaaatactgtacgtacacagtgcgtaaaaggctataattcacttggggagctctgcccatgacataaacactctcatggtttatgaacagcagtggagccttttgagtggaatcagctgtttattccctcctgtagagcaaaattctaaacaatgtaacctcagaaaggacacttcctggcactgaccagggcttttcctaccacatgtgcttctttctttctcatggctgtctagcagattctgtccctcgcaagtgaagcagcatttacaaggtgagcacaggctttggggtcatgtgtgccccagttgctattgcaaagtctaatcctgcaagctctgtggtcttgggcagagctcttaacctctctgaacctcattcctaaaacaggactgtactcctccctattggatggacttgctatgagaggccagcaagttaacacttggaagaccatgggttttagcttctgctgtgtacctcagtgcctttgctcacgcctttcctcccaccctctttctgccccctcaaacagacacatccttcaaccttctcccatatgggttttcccatccactctactttgccagcagctctctcccctcccagtctcctttgactctaatcacatactgctttggaatctctttggtattttcttttagttcttcacatcttcatatatattttgtttccttaaccaaaccatgagtactttgaaggaaatggctttgcatatatatctttttttaaaattacagtataatttatatacaatggagtggacaggttttaagtatatcttttgacaagttttgacgaagttaccttatagcctctttccaaatagtctctttactctcaaggcaactattgttctgtatcaccctgtcttagttttttcttttagatacttctaaatgaaataatacagatcatactcttttgtgtctgacacaatgaaatttatcttcatttcattcaacataattgtttaagatttagctgttatggtggccgggagcagtcatcacgtctgttctcccagcattttgggggactgaagcgggcggatcacctgaggtaggaagttcgagaacagtctggccaacatgggaaaaccccatctctactaaaaatacaaaaattagcagggcatgctggcacaagcctataatcccagctactccggaggctgaggcaggagaatctgttgaacccaggaggcggaggttgcagtgagccaagatcacaccactgcactccagcctgggtgacagagcgagactccatctcaaaaaaaaaaaaaaaatgtatctgttatggcatttcttttttactgctgagtaatattctattatatgaatataatgtattaatccattcacccatgtgtagatacttgtgttgtttccaggttgaggattttattaatagagctgctatgaccaagcctttttgtagacatgtgttttcctttcttcaggtaaatacttgggagtgggagtacatatgtgattaactttatgagaaggtgacaagcttttttaaagtggtatcggtttaccctcccatcagcaatatgccagggttccagttgcttcacattctcaccaacacatcctattgtcagtctttttaaattgtaccattctagagaggataaagtaagatctcatgtttttaatttacatttcctggtgataaatgatgttgagcatcttggcatgtgcttattggtttatctctttcatgaaatgtctgttcaaatcttgcctatttttaatttggttgttagtctttttattaatgagttgtatatatgagtttctttatatatttgtcagatatattttttgtgagtatcgtctttcaatctgtggcttgccatttcattttctttttcctttttttaatagagacaatatttcgctatgttgcccaggctggtcttgaacccttgggctcaagtgatccttgatcctcccgccgcagcctcccaaaatcttgggattacaggtgtgagccactattcctgcccttttcatttcttaagagtgtcttttgatgagcagaaaatcttcattttttaaatgaaatctgttttttacgttaatgctctttgtatactcaaaattattagcctactagaaggtcatgaagaaattatcctatgttttcttctagaagcttttgttttgatacataggcctatgatccatctcaaattaatttttgtatatgatatgaggtagatgccaaggttaattttttgttcatatgtatccagatattacaacaccatttgttgaaaatacttttctttccctgttgaattacctttacatctttgtcaaaagtcaattaaccacatgtgagtggatctatttctggatactctattctgttccattgataggtttgtataccaatatttcttgaaatcaggaaaggtataccaatatttcttgaaatcaggaaaggtatccaagcttgttctttttaaagattgttttggctattctaggtcctttgcatttttatatatcttttagaatcagcttgccaattcccacctctccccactccaacgccccccccaccaaaagcctgctgatcaacaagggaagaattgacatttttacaatactgaatcttttataatactgaatcaatgaacatggttttatttaggtctttagtttctcagaaatttttaaaatatttcaatgtagaaatcttgaaatatttttaaatgtttttctttttcttttttttgagacagagtcttgctctgttgcccaggctagagtaccgtggcgcaatcttggcttactgcaaactctgcctcccagattcaaaagattcttgtgcctcagcctcctgagtacccaggactacagacgtgtgccaccacacccagctaatttttgtatttttatttatttttttgagacaaagttttgcttttatcacccaggctggagtgcaatggcatgatcttggctcaccgcaacctccacctcccaggttcaagtgattgtcctgtctcagccttcctagtagctgggattacaggcgcccgccactatgcccggccaatttttgtgtttttagtacagacagggttttggcatgttggccagtctggtttcaaactcctgacttcaggtgatccacccgcctcggcctcccaaagtgctggcattacaggcatgagccactgcattccacctgtttttgcttttattgtaaattatataaaaatataaatataaaatatttataaatatataaaaatataaacaaaatttttaaaaatttattttctagtttgttgctggtatacaggaatacaaatgatttttctatactgacatggcatcctgtgacattgctaaattcacttattactactaaaatctaatagattttttaaatagatttcttataatttcttttttcttttttttggagatggagtctcactctgtcacccaggctggaatgcagtggcattatcttggctcactgcaacctcacctcccaggttctagcaattctcctgcttcagcctcttaagtagctgggactacaggcacacgctgccacgccaggctaattttttgtattttttttttagtagagacggagttttaccatgttgcccaggctggtctcgaactcctgagcacaggcaatccacctgccttggcctcccaaagtgctaggattacaggcatgacgggatttcaccatgtggcccaggctggtcttgaactcctgagctcaggcaatccacctgccttggcctcccaaagcactaggattacaggcatgagccagcacgcccagcctgcaatttcttacataaacagtcacgccttatgctaacagctttacttctttccttccaatctttatgtttttctgtttctttttccacctacttgcactgaataggacctccagtacaattttttacataagtgataagagcagaatctagctgtatgtttctctattaaggctaatgttgaggttttacatagatgtctttatcacgttaaagaaattcttgtattactactttgctaagaggttttctttttttctttttttatcatgaatgggtgttgaattccatagattgctttttctgcatcttttgacattgacataatcatgtggtttttctttattctgttaatgtgaattacattatttagtttttgcatgttgaaccaaccttgcattccaaagataaacccttctcggtcatgattttatcctgttttatattattaaatttgatttgctaaaattttaagatttttacatctacatttatgaatgatattggtctaaaatttcttttcttgtgtttgtccttgtcaggtctttggtatcagtactatgctggcttcattaaataaactggaaagtattccttcctcccttgttttctgaaagagtttgtgcagatttagtattatttctttccaaatgtttggtagggtttcctttgtgcaaaaaatatttagtgtctttagtaaatgtagggatattcagattgctgtatttcttcttgtgttcattttagcaagctaggttttttaataagaaattgatccatcatgtctaagttgtcaaagtgattggcaatacattgtttctaatgtcttccttttcaagtttcttagagtagaagcttaggtcacaattttaatccttttttcttttttaatataaaattactttctacagattgcttaagctgcattccacaaagttttgtatgttatttttcattattattttattagaaatattttctgatttcccttgtgatttcttcttgaaccatgggttatttatagttgtgcttcttgaatttcaagtgtttagaaagacttttctaaatatcttattgatttatattaattcggttttggtcagagatcataacctgtatgatttcaagcctttggaatttgttgagaattgttttgtagaccagcatgtgatctatcttgataaatattccatgtaaacctgaaaagaatgtgtgtcctgcagttttggggtatagtgttctatatatacattaactaagttaaattacttgttagtgttattcaaatcttttagctctttactgtttttttatgtctattgtatcagttattgaaaggaggtattaacattttcacctgtggggttttggattcgtctgtttctccccttctgctaatttttactttttatatcttaaagctttatttttagatacatatttagaattgttaggtcttctcaataacttggtccttctatcattatgagatgactctatttctggcaatattctttgacttgaaatctgctccatttgatattaaaattgttacaccagctttcttctgtgtattttttacatggtatatatttttttcatcctttctttatcctgtctgtgtctttatatttgaaagaaaccttttgtagaccttgggttttttaatgtagtcttaacatgtctgccttttaattggagtatttcttttttatttttttattttaattttttttttgagacagagtctcactctgtcgcccagattggagtgcagtggtgtgacctcggctcatggcaacctccacctcctgggttcaagcaattctcctgcctcagcctcccgagtagctgggactacaggctcgcgccactattgcctggctaatttttgtatttttagtagagacggggtttcaccatgttggccagactggtcttgaactcctgacctcatgatccacctgccttggccccccaaagtgctgggattacaggcatgagccaccacacctggcctttttttttttttttttttttttttttttgagacagagtcttattctgtcacccaggctggagtgcagtggcgtgatctcggctcactgcaacctctgcctcccgggttcaagtgattctcctgcctcagcctcccaaatagctgggactataggcgcacaccaccacacctggctattttttatatttttagtagagatggggttttgccatattggccaggctggtctcaaactcctgacctcaagtgatccacctgccttggcctcccaaagtgctgggcttacaggcatgagccaccacacctggccttaattggagtatttcatttatttatacatttaatataaataataagcttactgggtttaagccctacagtctttctattcatatttttggtttgggttttttttttttattcctttgtccttttcttcctgtattctttcagtttattaaagtattttttagtttaccattttctcttctgttggtgtgttagctatatttctttgtatattttagtcatttatacactaaaaatacaccgttaacttatcacagcctaccgtgaattaatattataatgcttcctgtataaacagtgtaattatctgtgtaccttctatttatctttgtgctgtcatattcacacactttcagtcttcgtattttatgaattccacaatacattgttattactttggcttttaatagtcaactaacttttaaagaattcaagaaaaaaagaaaaattaccttccatcttattctgtagtttttcaataaatgtaataaataatcatttcctctaaaaaaaaaacctatttaaaattacttcctccaaataagccatcagagtgaccatatccagcctataggcagaggacattgaaattggcagtcatcaagaaaagaaaatgatatctacatgacatccaggtgcctctgtctgccctgtggacttcattcacagtggcccctcacacacttttatgggatcatcagctgcagcccttcaagggttataatgcagaaattcttagtaggcctcatacagattataaaaactgaggctcagagtgattaattgactttgccgagggcacacagctggcttctagaggagtgagggctcaacataggtcctcattttcacattatggcaccaaaagtgaaaaaagttcttgcccctcccaaagctgaagccaaagcgaatgctttgaaggccaggaaggcagtgcttaaaggtgtccacagccacaaaaagaagatccaatccacacatcacccacctgccagtggcccaagacagtgtggctctgcaggcagcagaaatatgcttggaagagcactcccaggagaaacaagcttgaccaataattcatcatcaggttcccccaaccactgagtcagccatgaagaagatagaagacaacaacacaacttgtgtccattgtggatgtcaaagccaacaagcaccagatcaaacaggctgtgaagaagctcagtgacactgctgtggccaaagccaacaccctgatcaggcctgatggagagaagaaggcatattgggatcatctaaactgaatccagctagttgattctatgtatatgtcttttcaccatttaaaaccaaaacaaaagcataggtcctctgacccttctgcacatccacacccaggcagacagaaacagttccatactcttttcaccatgtgtctgaggctctcttctcatacagagaggaaatgcatgaggcaatgaagagcactgaccataaagtcaagacatagctgggtttaaacctgtctctgccactcacaggctatgtgactttgggcaaattcctaatttccctgggtctttgtttccttgtctataaaatggtgaagcctacttgagagggttatgatgggtatcacatggggtgtatgattttctgtgttgctaattttaaaaatatcataagttaacccttttaaaacgccactaattattaatctcacagtttctgtgggttaggagtcccactcaagatgcctgggttctcagttcggggttttaggcaactaaaatcaaggctttgtctgggtctatgatctcacccctgaggcttatgctcctccttcaagctctttcagtatgttggcagagttcagttccttgtggttgtaggactgaggcccctgttaccttgccgctgtcaactggagaccaccctcagcaactagaggctgcgtgcgtcctctgccatgtggtcccctccattttcaagccagtagtggtgcgtcagatccctcttatattttgaatctctgccttccatatgtcttctgctagtcacagatttaaagcctccctgtcttaaagtcatctgtgccatataacaaaacctgtttaccagaatgaaatccatcacattcacaatcctggggattacacagaaggtggagaatcttgggggtcacgttagaattctgcctactacgtgggataatgtcagtgaattgtccagcataaggtctggcatatggtaagaatttgatcatttttagctatcagcagcaacatccctagagaaaaagaggagatttttaaattaaaagcagagtcaatattgataccatcatatgtaccccagtaaacagtcccttaacctcggtaacttggctagagttcccaaagtttaaggccaccccattaatggactgtcatcccctgtggttgtatcttcttggtaccagcacaaccagctgaaccaacctcatctcagctgaactccccacaagagagatgagggagttttccaggcccaggccaacatagctcgggtgatcagagcccccgagaagacaataaagtcagtgctggtgagcgacacaggaattggggactgaggtcaccaaggccttccattccgcacgagcaagctcacccgtccctcctgggccttttccttatggggtttagaagtagagctgtgaagagaaaagcaaatcatataaataacgtggaattattggatccttgaacccttttgaaaagtatcttaaagggatttggtttgtttttccttacagaagagagagcaacagagatggggaggaatccagctctgcctgacatccaggcatcctctccaaattgcataggtcagtgagaacgtgttatttattagaacctgacatctgttgcagtgaaatgataagctccattgaaaagcctggccatcaattactgccaatacagccctcatcccagaggaagccactcaccatcctctcagcctgtgcagaccaggctgcaccaggcacggagtgtttacagcccagctcagtctcctggctcccctgggggaggggcagcaggtaaatcccttctgcaggtcccctcaggccatctctccccaggccctccatctgtattcctttggttccactggaagcttctctgagagcagttttaaagactgcaccccctgtttatcctgctttctcagtggaaaacagttagggcttttgttctggcctcagtcacacaagccagaagaagctgcactgaactcagcttatcaggatagtcacacagaaagagtaactgggctgggcgtggtggctcacacctgtaatcccagcactttgggaggccgaggcaggtggatcacctgaggtcaggaattcaagaccaacctgggaaacatggtgaaaccctgtctctactaaaaatacaaaaattagccaggcatgatggcgggcgtctgtaatcccagctacttaggagactgaggcaggaggatcacttgaaccggggaggcagaggttgcagtgagccaagatcgtgccactgcactcctgccagggtgacagagcaagaccccgtctcaaaaataaaaataaagaaaaaaagagtaactggaaggtcagcacatctttgtcaggaaaattaactcaggtgtgccctttcaagaacaattgagtgggctgggcgcggtggctcacgcctgtaatcccagcactttgggaggccgaggcaggcggatcacaaggtcaggagatcaagaccatcctggctaacatggtgaaaccctgcctctactaaaaatacaaaaaattagccgagtgtggtggtgggcacctgtagtcccaggtacttgggaggctgaggcaggagaatggcgtgaacccgggaggcggagcttgcagtgagccgagatcgcgccactgcactccagcctaggcgacagaatgagaccctgtctcaaaaaaaaaaaaaaaaaaagaacaatcgagtgttcaagcttgggttccaattaccccgccagccactggggaagtgtttgggatcaccaaggagagcaacttccttgcttgtgagttagggtcacgtattctctttcctggaaaaatagacaggtgtcctatagagttagaaaggaaagggtagaggagctggtttgggatttttatgataaaccatagtaggaacatatgctattaatggaatcagagttccttttgaacagctgggggaagaaacgtacagtaagtcaagaaaaagcaaaggatagtggcctgggagtcaagtgacctgggtctcatctagggaccattattaatttccttcgtgatcatggaaaagacacgtcacctttctggacttcagtaccttcctctgaaagtactgggctagtacccacctggtaatcactaagctctaatatatttctggaattttaagtgaaaattgtttaaggtagctgagcatacttttttattcatgttgagaaacttccatctctgttgccggaggtcagacacaaattgaaaacattactaaatggaattaagtacaccgtgtacgtgatgcctttttgtacagctcgtatctgatatttatagaacacttcagttgcagaacgtgcacacatatgccctgaacacacacccaataaaataattctagatgcaatacattttcagatgtcaagttaaaacagcttcttaggaattaggcttgactgttcagatgtgtgtgttagtttatgacaggtgccgccagggctgctcagggctgtcatgagtgatgtggagtccagccaaggcaggagggccaagccgcttgtttctatcacttctcattaaggcatgaattctagaaaaaagggaagcatcaaagaaccatcaggattgtccattgtgtgcatatcataatgacaagcagaggccttgcttctgcagaaacaagattctgtcttgtcttttgtcagatcattcagcacaagggccacctgtgaaaatgaactagattcatgccttattaaagtagaggatttacagaggtgagcaaaaatgggaagcaggtaccatccagctcattatatacagagtatgtacaaagcactggagactaccacacacacgtattttgaagagccccaactcaaagcctactgattgatttctggaatggtctgtcactccttgagattccattctgacaatgaggctatctatggcattaactactcagaagactgagtacaactcagaattacaaagcaggaagttacgtagttcttctaaaaatcaaaaccaaaatttagaaaactcactggggcagttacctctactccactgtcctgcaaaatccacaaccaacagcagagataagttgggtgactaagtaggaatgcatcctgggaagttaagtgtgacagtgggggccagtcacagaacatggaacatggaaggaactttagagatcatctagtactgccaggtctaaatatggtaagcattaactattgtgatagacattcaatgaaataatcgatatagacctttaagcacagtgattggcatagagttgactttcagttcatcattttcatttcctagaagaatttgtgcaaggcatacagtatcaagattagaaccctatgcccctgattactggtccaaagcccagcccaagccacctctgacctcctacgtttcccctctttcctgctcccttgctcacaggagcagcacagaatcatcaagggcaggagtttagcctgcaccacgtacacatccacctacccgtggagtggcctggcatgggtgccttcttcctagtggctcacccaggaggctgaaggcctctgtgcccatggggaaaacccagggtgtttgtgagcagaaataaccctgctgagagtctaaaaaccaagtacttttaagagaaggtaacatgcttctgtggccaaacttattactagcgtctatgggcaaaagagaagaaggagtattgtaatggaatgcgccaaaggaaagacatcactttactgctatctccaaagcagcagggaggctgcacattgagaagaggatagaaaattccagtgactcctattttcccagacagacagaacctctggcacttagtcatgcctaatggaaaatcgaagccaagaaagcagaaatggggtgggggtgagctagggtagtctgtaatccaaagtcacttctgaggaaaaaaagtagtttgtttgtctccttgtgtgccatgagtgggcagggctgagttgccaggtagcggggccttgacactcggaagaacagcctttagagcagccatgattgtgagaattgggcagaacagtggtttcctagttgatccagaagcaactagtaagcctacagtctgtgtgtagctgcagttaagttactgctaaatctcttcagcaaacgtgtaagagctcactatatgcagaatatgtacaaagcactgaagactaacacacacacattttgaagagcaccaactcaaagcctactgattgatttctggaatggtccatcgctgcttgagattacattctgacagtgaggctgtccacggcattaactactcagcagactgagtacagtccgaattgcaaagcaggaagctatgtagttcttctaacaatcaaaatcaaaatgtagaaaaccccagttttgcattattgatcatttgggagactggataatccttaaactgtcattattccaggtatccagaaaagtgagcattacaggaacgtgcatataagggcaagatcacgtattttctcagaataaacaatgggtcacccagtgcctcctaatcaccttacagacaataagaattgtaaaatgtattgaataattatagtacaccagcatagctctaagtgctttatgttttttaatttctgtaattctcgtaacaaccttatgagctaggtactgctattacacctattttacgggttatgaaattgagaccctgcaaaaggaagggacgtattcaaggtcacagagtcacttagtgtaggaactgagcatataccttggctttcccaacttttagattggtttcatactgcaccacctcttttcctcagattaaggtctgagttatcccaaattcaccaggcagctgagctcagctctctgtttagaactgcagggtctaggctgtttgccttggttgacactcaggtttggcatgccccagtgtggatttgtagtggctaacatttaattagattttgcccagatcactagcctagatcacttttcccattcattcattcagcagatgtttattgaattcaaactaggtgttaggtacgatgttaagtgatgtgtaagatacagtccctgctttcggtgaactagaggagggatgagaattgcacatagattcttctctttaaggtggcaacgtgcagggaaagagcactaggagtcgaggaaagaagattatgtctgtttactgggacccaggaagctgaaattggaggctgggtaggatttgatgtgcagagaggggaggacactcctccagaggaaacagagtgcacaaaggcccagaagatgggaagcatgggggttccaggaggtatgccggtgtccactgaagacaagagcagtagataaggcaggaaagaaaagaaaagagaaaagaaggaaggtggggagggagggaaaagaaagaaaggaaagagagaaggagagagagagaagaaagaaagggaaggggaggggaggggaaaggggggagggaaggaaggaaggagaggagaggggagaggaggggaaaaggggaagggaagggagagaaggagaggggaggagatatgcagggtacagagaacatgccctctggaatcagaccagctggaattcaagtccttgttcaaccactgtctagtagagttttttgtttgtttgtttgtttgtttgtttttaaatctctgtgggccttggctttctcacagaggattgtgagtgttaaatgctgaaatgattgtaaaatgcctggcacattgttggtgttcaccatgctaaaacattttatcttttttttttctgtaggcagtaaggtatttctttgtgtgtgtggttcttttttcttttcttttcttttcttttcttttcttttcttttcttttcttttcttttcttttcttttcgagacagagtctcactctgttgccaggctggagtacagtggcacaatcatagctcactgcagacttgaattcctgggctcaagcaatcctcccacctcagcctcccaagtaaccaggattacaggtccatgcaacagcactgggctgattttttatttatttatttatttattttttatttttttttttagaggtggagtctcactatgttgcccaggctggtctttaactcctgggctcaatcaatcctcccatcttgacctcacaaagtgcagggattacaggcataagccgcctcacccagccaggttttttgtcagtttacaaattacatattggtataatgatctgctttggtgttgatatgtaaatcataatagatccttcttggccttggaaatattaataaacacagtcaaaaactaagggtcatgctcatggaacactataaaggaatgtttggcttgggttctttcaccccttctttgccgcctccatgtccagggcttttagagaccccactctggatcttcagagttaggattgccagatttagcaattaaaaatgcaacatgtccagttacacttaaatttcaaataaacaacaaataatttagtgtaagtatgccccatgcagtattgaggacatacttatactaaaaagtcatttatctgacattcagatttaacaaggcatcctgtattgaggagcaggtcaggaatcagccagaacaaacctgttccccatatttggggaaggaggctcacctgcctgctagccttgtctctcgggtgataaaggctccacgcagcaggctttgagcagggccttcaaatcacttcctgggtagagacatcaaatctaatgggtcccactgtgcatgtttgggagtgggagtgggagtggaaatgggggtgggagtgggggtgggggtgggggtgggggtgggggtgggagtcgggggtgaagcaaggaagaatgtcttaccccagccttcacatatcctcagccccctctgtctgggcaagaacacacatcagcctttccctcctccaacttaaaggccttatgggggattttctttgctttcttcagaacattcccacagtcaattggtagaatgaagacagcctttgtggtctgataacatgtctcatagaatacgagcacgtctcagggcagagcatcctcttcaagtttcttccaggaacattgctcacagcgggaacttgagttgtcccttgtggggagatgcgtgtgtgagtgacttgacacagccacccacacgtgatgggaacagattcagtgcactgtgccctggcaatccaaggatcatggatatcgaagccagaaagataatctcgctgcttcactttagaaatgaaacaagggagaattctgcccaaggtcacagattttgagtctgaattcaggtctaggtgtctgtctactactttgggctctccagtaatagctcaggggatctgagtattcttggcacccttgttggttggtttctgggcattttcactggattacctgatgagtatcccccagacccccacttggctgcatgtccttcggcactgccgtgctcagctttatgctttgaccctcctctcctaacagcgagcaggaccactgctgctaggagctaatggcactttctctaccagccggctcatggccgtccccattagtgcctcctcactgctttctttgccccaccctgactaagcgtcctgcggttgagatggaaaaatccaactcagagcagatagcttttcaccttggtttcaggggaataattcatccacataacatgaggtaaaaattaaaacaaagcagggcgtaggttcaagcagaatagcacccttgggcttaagagtgactttgacctattcctcccagactagaaaaattatctggctgccagagagttcttagaggaatcactttgttcaatggtgtcactggcaaggtggtattaaccctaagaccagcttcatctgaacactgaaggcaaacctgactgtgcaggcagggccagcccacatggaagcccagggcagcgatcatgggatcttccactctttttattttcttattcttgccacaacctgtcatgagaccaagaaaacttgttttgaaaatgcttgacagccaaaacaacctgttctcagccctggatgagagggcttgtcctctctgaccacttacgtactgttagaggtttgactagctgctgactggaaaacatgaatttgctgttttcttctcatattgttcacagacaagtgccagtggctttccagttcctgtttctccccttttcccagccttttcttcaccagagacgttttaagattgtgcctgagtctaactgatgaatgaacactagcagcatacacttaagaggctgtaaccgatggttatatctctgcaggctgagcttgatatgtaggttgtctttccaatcccatttgattttaacctgtagatttaaactgtggatagattttaactcctgattttccacctgctttttggtcctctctggtgaagttggacgtgttagtcaatctctagttatccaagcagcgattttggcctctgccttggtggccctgaggccggcagtagtatctctgttcctcccaccaagccttgcaagtcgggtcttggtcttgggtggacctccaaatgaccctgactgtgaaggagcgacctcatctcttctcctctgtacaaggaagggctggactagataagggttgggcaaacaacagcctgagggcaaagctatccagctgcctgtttttataaataaagttttattggaacacagccataccctttgatttacatatcatgtatggctgttatcactccaaggccagagttgaattgttataatagaatacaggtatggtcttggaagctgcaaatattgattatctggtcctttacagaaagagtttgctgatccctgaactagataatctctagggttttcaaatccagcgttctatgactcttgaacttgaggcaattcttgaatagaaagagctcctggaataggggctaactggaaagggcctctttccatcctgtagtagttagcaaaacaaagcatgctttgagattgttgaactttacaaagggcggggcttattttgccgtgtttttacggagttgattttgctgtgtgtctgtatttgtttattggtctaatggctctggtatgcatggtgtcccccagttttggagaaaagatatcccagctgtgtaggcatggtttaatctgactgtcttcagtggcatggtttgaggtgggacacccatttgtgcccacctggaagagaatgctgattcgtctgcttaataaacatggcaggaaagggagccaaatgctgtcctggagaacctgtagggctgcccaaactccacctcacccctgggctgtctgtgtttgccttcctttctgagcctaagcaatgggatggaaaagattaactctaagcggtggggcagtgcagtaggctgtggccaggagaacaagaatgggttctgaagatgcctttaaaaatgcaaattaggaaggaagaaatcttcactttcttactccaaagcccatccaaacaaggttctaatttatagaattgcgtcccagtgaagttccccatgcccatgttagtgcaccagatgtgtaatagggaacccaacacacagaactgaatggacttctcagggtcaccttggccagtaagaacctttgtgcaaacaaagaaaaggctccccctttgggttggtgcagagttagctttaggtaaagtagaagctgtccctttgtctgggcctctgtccctgagtgagcacacagcttagcacgcagagcacaggctcaatttcagcccccgtttgctctcttggcctgatgcctttgtgcggggcagaagctgcacttccaaatgcacagctccctgcgcctcttgtacctggcatgttagaagtctgtggggttccctcagggttctagctggacaacaacaggttaactctgcttggccttggtctttgaggacacagcggactaggctagccaccagcacacctcttcatccctgtctccttcagcaacactgcaaggcaagtgtggctggtgtcagggctgaaggatcggtgccccatgctgggagcagagagttggtcctctggccgcagacgctgtaggccctgccctaggccaggtgcttatgcaggagagcccaagccttggctcctcctgccagcttcagctcagctcaaggagtgcacatgattttccacacagttcaacctcaaaggcaatacacttgcagcacagagaaatgtgctcagaggtccagaatagacaggctcacggtgggggaagtgacctcactcccgaggcactgggttccccactgcgcagtgtgtgctgtggcggcattccaccgggacacccaccctcggcagggagtgttgtcagaatggcctggagaagactgtgatgaactctgtgggtgctgcagtgttgtggtcagatccgatttccaccactcaattcatgctggaaattgtatttgagccagccatatgggcaaactttgaaagactcctgtcctacccttttaattctgcatctatcagcggttcccagcagctcagaggctagaggagtgggaagaaagaggcagcgagccgacagcagcccaggacccagtgtctgcttcctgtccccttacttggttttaagagcctactgggaacaagaaggaatgaagtttgttcctgttgtgagacccaaatgtgcagagcaccatgctaaggaaaagttagagtcctgcgcccatcgcttcttctctgtgacctagaaggatgtgacaggaaggtaaaggacagtacctgcatgtcagcgctgtcgcacactctgagaagggcagtgggagcccagtgaagtcaacctggaaacatctgtgcacatcagggcaggacgggggcccagggcctgagagaaagaaacccgactgctggcagatgtctccaatttcattactactccacgttgccaggcccatggtgatgtcctcacatttagctgcagcctgccgtggccaggcataggttggcagcatcactcagcggggtgccttctagtggaacatgggtgcacccagagccttgcccttcctgctcagccttagccctcagtggctgcagaaggcaggaagaccctccagggctggcagtgtgctgtcatcaggacacgggcttgcagcttccaagtcccgctctgcctttatcatgtgcctggccttggtcaagttactcctctccaagcctgctccttcatgtatatggggggagtagagtaatgggatcgatttcatacacatgattgttgcttggattaaaatgaggttattttgaaagcacattataaactataaaataagaagtatcaagttagttaattcacttattcaacaaatgttatatatatacctattggtaccagacactagttggacagtgttcccaggaggtccaggcccttgtcaataagagctgttcaataactgtttgttgagttaacgtgaaacaggaggtcctcaatgtgtgtgtgtccgtagctgtatgatggcagtggaggggtgggcaggaaggaaaccaaggcttgagttcttaccatgtgcctggcactgttgcctcataacaactggtcactggagagaaacagagacttgggggcttttccagacacacagctagtaagtaatagatccacatttaaattcagttttctcttactcgaaaatccatgttcttcccacttaatcagatagggaatgattgccacgtgttcctcttgccacagaatgacaccaggaggttccatctctaacccatgtttcttttcccaagcatccctcagatctatgacccaggccaaacccaagccaaaaatgatcacccctgattctaggccagaaaataggaatcgtgtgaaatctaagcagaatgaggctgtgtcaccactagccaaacctcttgttcatactgcgcaggttttaggaaaacaacagcctttaatgcatgctcgaaattccttccatggtaagccactgtgagaaaaatctcacccaaacaatgtgctcttggcagagggagggccggtgtcttttcaggcaaaaagcaaaccagcagggacccagaaatcactctagggagtgttggtttccccagaagatctagctttttaaaaataaacttagcaaaggatttcatttgcccctctgccccacctttgcctctcactgcttggagaggaggaggattgtggagttccttgtcccgggtcagttcccagctcagcattgatacatctgcttctcaagtttagcaccaaatatttattctgataaagtgagtttaaaaaaaaaaaaaactagatcgattattgtctggcttggtctccaaaaacaagtccctgcaattgacagtggttgcatgaacttaagaataatagatccttaggaaggaaggctgttcattcagtcattcaacagaaaattagggtacttctgtgtcactgaggtgcagccccagtgaaatgaactcagaagcctccagtgtttataccactgagactggggcagagtagtctggagtgctgcatgtaaagctaggcactccccagtgatggagcttccagctgcccctaccattcggtgcacaagtgtccctgaacttcggtgaagtatgagccaccaagctccgcccaagggtgaccacagaagtagacaacttacgaaccagaaacatcaaccagcaaccccagacagtttatgtaagattgcttcattccagagagcagaactgggatccatgggcagaagtttcaaggggacagattccagttcgggagagagaagaaccctgtaactcttagaggcgcctttgagcaacgcgctctcaaggtgttccagcagggtgaggatcaccccccagaagtgctgctgggccaagccctgccttgaacaagatcctgaggtctcgcccaacagcaaggttctctggttagcaccaaatgagtggctcaacagttcgtgttgtggagcttcagaggcaggacaagcagtcatgggctgtggttggcggccgcaggccccgatgcttaggccaggccttgagggtgggtaggtgtcaggtaggtgggagacccccagcatgttgcaggcccaggaaagcacccttcacctgcagagtaaaggggctcctgcttagctgactgccagacttgcaaaggggaattaattattgtttgtgatacaattaaaatcccccaatgaaaggccttgtataaatgtaaattatcattattgtcattaaaggggctagacgtctggcctgctggataatatccccacatacctctgagcagaaaagaaagccagcccaaggcaggaattttgctcctgctcttccaaagcaatagcagtaagaagcggcaggccaaggagggctctgcccgtggctgtgaaagcagagccccccactctcatccagggtgagcacgcagctctctctgctctgggagtcaagtgactgtgtgtcccctgagggccagggccctgcccaaatgcagtcccttacccctgcaggaaccagcccattactagcacaggagtggcccatgagtgtgtgaatatttagttgtctgctgatttgaagggtggaaggaacatgagcaggatggatactggccagcattcttgaggtcctaagtcagatctggagacaaaggggagatagacggctcagacccgtgcagcacctctgatgatgcttgtgaaggctcttgcctcttaacccctctagctaagcgctgggagaggtcatttgttacattactgcttccacttaagaaactgtctctggctaagtggttggattaataccaaagcagaaataataataatggataatagtatattagactgagcagtgacctcagaaaccatcccctcactttgcagatgaggcatctctggggtacagagaggtgaagtggcttctccaaagcagcgtagcagagaaaagcagagctggaatcacagctaaagctcccgtgccaagtccacagtttgactatgcgggatgatgttacctcccctgtgacagcaagtcacagagatattgcccctcatcaaccctagggagttttaagatgacctttatgttacaggaaccttctgggcttcctttgctcttctggggctcgttatttagagaacatttgtggtccctcacatgtcacctaggtggactgcacacaccctccttcttgaacttcttttccttcccccagacactcagagtagcctgcattcttcattagggtgccccagcacttccaagaaccacatgggcccgtgagagggaggtcaaggtcatcccttttgtctcttgttatcatagtcataattctgctgaaaagctacacgatgcagatcccaagatgagagtgaacagcaccagtcaatacctgtagacacacagagctaccagagggagggccatctagggggttttgtagaacaaatgtaggtgcaatgggggttggcagtaagtagccctcgaaattcattactgagctgttggcagctctaggaaaagtttaatggaggagactaaaatacagccacaatgaggtttgggatgggagagaacacgaaatcaaaaaattttagaaattatttatcttgctcccttactgcatagatgagaaaacagagcagtgattcaccacgatatagcagagccagggacagaacccaaggctcccgactcagtggacagtacacttgccactggaaatcatggtggcatggaaagaatgtgccctttggagtcaagcagctctggattcataactagcattgccacctattagctgtgtgatcttagaaaagttactttgggccaggcatggtggctcacacctataatttcagaactttgggaggctgaggcaggaggatcacttgagctcaggagtttgagaccagcctgggcaacatagtgagacccgtaacatagcaagaccccatctctacaaaaaaaaaaaaaattaattagctgggcgtggtagtgcactcctgtagtcctagctactcgggaggctgaggcaggaggatcacttgagccttggaggtcgaggctgcagtgagccaagattgcaccaccacactccagcctgggtgacagagtgcagacagagagagaccttgtctcaagaaagaaaagaaaagaaaacttactttccatctctgatcgtagatttatttttggcaaaaatagaatcacctgcctggtagtaagcctgttagaaggagtaaatataaaataatacacatgaaaataagtagcatgatatctggcatgtagtaggcacctccctttccttatactcatggcttccagacttttttttttaaccacaatctacaagatattttacatttgaatccagtatatataactaaaacaaaagtgccacatacagtgcactctgattttatttcactttattttaatgctgctcagaacccactaaatggattttgtgatccactgtttgaacaagccttctttacaccatgtgtggatatcattcatccacgttgcatatatgcccttcctttccttccctccctccctttctgtaacggaagcctggggccgcagggctacctgctgtcagcatgtgcagggcccgagctggtgcagtgtggagtgatccctgcagcccagcagagcagatgcatctcctcctcctgtgcttgcccccagcctctctactgcatgattacagaagacttgtaaggccccctcctgccagacgttctgtcatctgccagcctgcatggaacttccccacaccctaccccagcagagcccacctgaagttcctgttgtgagaattactcttgttaccaaaggccattgtctccagaaggccactgtaccccagcagggagagtggagcttggacaccctctcccattgagtagtttcttctttgggaattgctgcttttctgtctgaaagcccagagagccaggtgtctgcggtgtgatttcagctgtcagggggataagggtgaagagaggagggaccatggccatcttgctgcccctcccccacatcctcaaacacccagccaggggggtgaatgtcccagagtgttgggtgaccaaaagctgtgtccaaaagccagcatgcaggggcctgagcacctgtggaagccatgagctctggcctctggatgctgagatctggtggaagaaagtgaacttacaaccaggcaaataacacttcaaagccctagagagactcaggggaggggaaggttagaggcctcaaggagttgatctcctaagtgttcctgaggccctcctttgggagtcctgcactttgctgtggaggctgatgcctgaccatgctgcgcacaaacctcggagcactgttccagctggggtgtgacttggggcctggacccacattccaggttcagctctgctgggtccctgggcacttcctctttcagggtcaccctttggtttttcccctttcgatgactaaaaagtggagggtaatctgtgagcttggtggtgactcaccaccatccgacaggcggcccacttttcccagcaggtgagctgcgtgagtagccctcctcctggccgggactgtggtgagctccctgcaccccaccccaggcagccacgtggccatcagcacatcatggtctgtgctgagcgcctgctcttgcagccctgggcagagtgagcagaggactcaccatctgggcacaccaggcaggtgcagatggggagacaagataaacccagggctggggctcttctctgggttcccaggccccaggcagcagcacattccttagccccccacacccaccacctggcctcgttcccagccccagcccagccaggtgcacccatcttcccagcctctctcagtgccacacagccattcctgcctctcatcaagcaggttatgatgggcacggcagtctgagagggagggggatggagaggactggctcacgctccgcctactagctctggggcctcaggtcaaccccctgggcaggcaggcattcatttagcaccaaattgacattcatcttctgggagcttctgacagggtgagcaccaagggcactaagggtgaaccatccccaaattctgccctctaggcacttacagggatgacctatgctaacgtgccattaggatacgcagtgtcacaggaaccatcctaacctcccgcccttagtctccccttccccttccttgtaatgtttgacctcggcagtttcctttttccttctattaattacaacattctatcattctaaagtatatcttaagtaagccaaatgcttgcatttgagaaatatttattgagctggtgagtgttggacactatgctccaggctggggatgcaaagatggatgaatacgacccatgggctttgccctcagggagcttcttccagggtgtgagagaatggttggtatgtgtagatgcgtgcatacatctgtgatgaacgccagagaaagaagctggtcccatggccggtggaggctcaggagcccattaggactaccctgtccctccctccatttagccagctggccctcccttctcctcctccttctcatctgctgcaccaggggatgccaagggagcagagatgcctgcagcccgtgggagcaagtcctggcctttgcagttgcaaaaactggctgcaagctgctccagccccagaggaactggccaagctccagagggcctccttggagggcctcagagggagagagaactgctcagtaattttgatcactttggtaagtatttaaaaataccctgtgatttagcaggaaccagaattcatcccaatactttgatgtctagaaatggatctcagtcagttgttgttgaagtcctcctaaaacggcatttgatttaattcaacacatactgagaccacagtcagccttctcacaggcgaggaggccgagctgtataaattgtagtctagacaccaatctaaatatctcaaacgcaaggcagacatagcccagcctgaggttggaggcccggcatgctgtggaatcgagtagaggggagattgattccagctgagggcaagggcctctgcctgaagctgtgagcatgtggtactgtgttcccactgcgatatcaagcctttgcatctcaagtttgttaatttccttgttttgcaagcttagaccccctgaaaacagaccaggcatgctcaggggttggcgcatttagcaagattgactgtgtacatgaaccagttacaagcacttgtttgttcctaaagcccacacccgagagccaggctgccatcgcccggggcataattacaaaacaagctcccatcgtgccagtcactcactcaccaaggcacccagaattggatggcagttgtcacaggggcctttggagggtttggggtgaaggacattgaaacagaagcaggtctctttgtagccatcctgttgtgaggatgaccctttgacacgaggccctttgacacgaggcgagtaaccccaagtgagtcagaatttacagtggcggttcaggacaatgaggacaaggcaagaccacgaggcatgattagcaggacttgtcttacactatttacaggactgctttgattttcagaccacaatcggttttcatatgactgattaaaaacatgtgccagttgaagtcacagctgcagaagaaaactggaaaaagcagtgagccttagatgttggaacttgcctctatttgcaaaaatgacctctgacttgatttatgcccttgatttcctgacagtgagggctgtgtccctgaaccacttctcctaccacaccccaccctaccaccacattggcctgactctagcaaacatcatgaggctcatcttacaattacccaaagaaaagcatgtttgaattccagaattcaagtcctgttttggaagaaggcaactgttaggctcttgccaaataaaaagttccaagtgaaggaggctaacagcaacaagaccacagggtctcgtccacggggccgggctctagtggcactggggttggagtgacattggcaggtatcttaactaaacttgctaagcttctgttttctctcctgcaaaatggggagcatgacccctgccacacccagtagtgttgtgagcaccacctttgcaaagcttaactgccttaggtgctctctccccgctgccagtccccaacctctttgggttgtatattctgtgttttgttttcatttatttaaagctatattgattcagtttgtcagacgtctattttatggatttttatccttttgaaaagatctattgaatcaataaagcattgtaattccagtaggaaagaaccctttagatgagacttcgttgaacaaagtttcctactggcctcaaccccaaggcctctgagcatttccctgatagctccctgtcttaactttcttcagtctcctgatttccccttctctagaacccaaccattatgtcattttccaggcattacccctgataacttatgcttcctgagctagagggcagaggggtggccgagaggaacaggccttcatgtcccccgacaaaactgtctatggcactttttgctcggggctctgcagcgttcactaaccctaccccatttgtataaaactatgcagatggaaacgatccaataataacccaactactcccaccacctttgcagcattaccacctcctactgaaacttgcatttgtgtggggccctgggcttggtacttgatacacatttccattctcctcacaacctccttgaaaagaggtgctagtcaataaaaaatgataaaggggctatcaccactgaccccacagaaatacaaacaaccatcagagaatactatataaacacctctgtgcaaataagctagaaaatctagatgaaatggataaattcctggacacatacaccctcccaagactgaaccagaaagaagttgaatccctgaatagaccaataacaagttctgaaattgaggcagtaataaatagcctaccaaccaaaaaaagcccaggaccagatgaatttacagctgaattctaccagaggtacaaagaggatctggtaccgtttcttctgaaactattccaaacaattgaaaaggagggacttctccctaactcactttatgagaccagcattatcctgataccaaaacctggcagagatacaacaaaaaaagaaaatgtcaggccaatactcctgatgaacatcagtgtaaaaatcctcaataaaatactggcagactgaatccagcagcacatcaaaaagcttatccaccacaatcaagtcagcttcatccccaggatgcaaggctggttcaacatatgcaaatcagtaaatgtaattcatcacataaacagaagtaaagacaaaaaccacatgattatctcaatagatgcagaaaaggccttcaataaaattcaacattccttcatgttaaaaactctcaataaactaggtattggtggaacatacctcaaaataataagagccatttatgacaaacccacagccaatatcataccgaacaggcaaaagctggaagcattccccttgaaaaccagcacaagacaaggatgccctctctcaccactcctattcaacatagtattggaagttctggccagagaaataaggcaagagaaagaaataaagggtattcaataggaagagagttaatcaaatggtctgtgtttgcagatgccatgatcttatatctagaaaaccccattgtctcagcccaaaagcttcttaagctgacaagcaacttcagcaaagtctcaggatacaaaatcaatgtgcaaaaatcacaggcattcttatacaccaacagtagacaagcagagagccaaatcatgaatgaactcccattcacagttgctacaaagagaatgaaatacctaggaatacaacttacaaggtatgtgaaggacctcttcaaggagaactacaaaccactgctcaaggaagtcagagaggacacaaacaaatggaaaaacattccaagctcatggataggaagaattagtatcatgaaaatagccatacttcccaaagcaatttatagattcaatgcttttcccattaaactaccatggacattcttcacagaatttttttaaaaattctacattaaaattcatgtggaactaaaaaagagcccgtatagccaagacaatcctaagcaaaaagaacaaagttggaggcatcacgtgacttcagactttactacagtaaccaaaacggcatggtactggtacaaaaacagacacaaaccagtggaacaggatagacatctcagaaataaggccgcacatctacaaccatctgattttcaacaaacctgacaaaaacaagcagtggggaaaggattccctattcaataaatggtgctgggaaaactggctagccatacgcagaaatttgaaactggaccgtctccttacacctcatacaaaaattaactcaagatggattaaagacttaaatataaaaccaaaactataaaaaccctagaagaaaatctaggcaataccactcaggaaataggcacaggcaaagatttcatgacaaaaacgtcaaaagaattgcaacaaaagcaaaaattgacaaatgggatctaattaaactaaagagcttctgcacagcaaaagaaactgtcttcaaaatgaacagacaacctacacaatgggagaaaaattttgcaatctatccatctgacaaaggtctaatatccaaaatctacaaggaacttaaacaaatttataggaaaaaaacaactccattaaaaagtgggcaaaggacatgaacagacacttctcaaaagaagacatttatgcagccaagaaatatatgaaaaaatctcaacatcactgatcattagagaaaacccaaatcaaaaccacaatgagataccatctcatgccaatcagaatggcgattattaaaaagtcaagaaacaatagatgccagcaaggctgtggagaagtaggaacgcttttacactgttggtgggaatgtaaattagtttggccattgtggaagacagtatggcaattcctcaaagacctagaaccagaaatatcatttgacccagcaatcccattactgggcatatacccaaaggaatataaatcattctgttataaagatacatgcacgcatatgttcactgcagcactattcaccatagcaaagacatggaatcaacccagtccatcagtgatagactggataaagaaaatgtggtgcatatacaccatggaatactatgcagccataaaaagcaaggagatcatgtcttttgcagggacatggatggagctataagccattatcctcagcaaactaacaccggaacagaaaaccaaacacatgttgtctcttataagtgggagctgaacaatgagaacacatggacacagggaggggaacatcacacactggggcctgttgatcggggggcatcaggataaatagctaatgcctgcagggcttaatacgtaggcgctgggttgagaggtgcagcaaaccaccatggcacacttttattatgtagtaaacctaacgtcctgcacgtggatcccggaactttttttaaaaaagagaaaaaagaggtgctagtgtctgaatttaatagatgaagaatcaggacacaaaagggttaagtggcttgctcaagatcacatggatgatatctcagaccataactgggtggtcataagatcattaagtagaaatcatcctgttacaggtgaggaaatggagtcccagttctggatgacacaatgagccagggcccgggctagagctgtgagtcctgtgcctcctagtgcagtgctctttccacttcccccactgcctccccttgacgatgcatgttgtcctggacagaaggagagctgtttgaggaccaggccaaccaacaccctgctcttggcagccggagccatgtgattcctaaatacccttctaggaagagctgcagcatcatccctggtcaagccctgaccaaaactgcacaccacacacaaggagtacacctggtaggtttgggggcagaagacacgcaagggctggaggtgcctctggctacagaatttgtcctttgatgccacaaggatgccatgagcagctctagactggattgcaaaagacacacagtgtcccatgactttggctgagtatccaagcctgagattggccatctctgcctgcgattgccagctcagtgtgatcagtgagaagggagggcctgatccaaggagcctcgggaaaggctgaactgaggacaaggaccctagacctctcacaggtttcccgcttcggcacacacgcgttcttctggctgtttccacagactcagagcctcttccccttggccccagcgggtacccatgataatagttgacatctattgatcatctcttatgccaggtaccatgccaagcgcttacccagaccatctcattcactcctcacaagaaccctttaaggtaggcagttactcccgccttttagatgaagaaactaacgctgcagtcacttgccctcatgatcaacgagtaaggagtgtggccaggcctcgagcccagtccgcctggctccagagcctgccccgcacaggctaccctcaccttctacagcccaccggccttaggaccctcagttatggcaccctgctttgtaggtgagggagctgaagcccagaagagatttaccctgggcccaaggcccacaaaagtagaccccctgactcctgattcagttccctccaccatgccatgcctgtgagctgaagcctgggccagccctgcttctgctctgaattcatgggaaacctacccagtccttacgttttcttctcctaactgagactcctgggttggaccgagttgtaattttatgaaaccctgagcagagagactgagatcagtgaagagggactgaacctcattttgccctcaggcatattgagctctaatgccatctaaaaatagattcccttacagtgtgcattcagtgaggagcttgacactcagggccctctcctgtgggccccacttggccagttaatggggaggtgagaagacttcactatcccctagaacacgcttacacttttaaagcttactacatactttgtctctgggtcaaaggttttttcaaagatgacagatacctcttgccattagcaatctgtactctgggcagctctccattttctctgataaaaagtgaaataaatgaaaacagcgttttaaaaaatctataaatgggtgggagccagttgtcattttccctttccccctcctcccactccgttaactaacttaatgaggatccaagttgagaggcactcgccgaaaacagctggtagcatcatgcctttaaatagccctcgccacgcttccccttggcagcacgcagttggccctggcagggaaagcccaggacagaacaggaaactttagaactttctaaaaagaaaaaagcttgcctttaaaacgtgctcccttctgtgtaaggagcttgcaatgttgtagccccttcccctagaagtttacaaggaaagactaagctgatgaggcttgcctcgggacccagtgtgactctgggcctggggaggtaagtggagggctccccggacccgacccctgcccagctcaggccagcgtccagggcagcagtggctccagcaccatctgctcatcaggcacctgtgggggctatagtgcagctcagctgcagcctctccccttgatgttcgtagctgtaaggtcagggaaggtgacgtcctcacctctaacttagggaacattcagccctccctgaaagtggtactgggatgggccagactccacagtgcacatcaggccagagtccatgcagcagaggttggtggcagcctgtcgatctcagaccctctggagaagcggggccacaaggctctctccggccgcacttccatgttgctggggaaatagcagcaggtgaaacatatggaaggaataagtggccctcacgtctgggtggcagccaacagttgactgtctcctcccacacactgtcccatgcgagtgtggcatcaggtggccttatcacccctactgttcgtaagggaacagagcccagggcttctcctgccctgcccggccttgcctaggtctggagctctgtcacaccacagcaccccttttgcattaagggtgactgtggcgactgtggcatggtgccgttaatggataagggctttgaggtcctgagtgccagagaaggtggcggtttggctggctcagggctgtgctgatcacaagtggatggaagagggtgctttttcttactaactgttggcaaagtttgaaatttgagaatggactaaagtgttcttccttagtacctaaatattgtacctgttctctttctggagctgctgtctctcccaccttctttttttttttttttttttttttttttgagacagagtctggctctgccgcccaggctggagtgccatggtgcggacgtgatcttggctcactgcaacctccgcctcccgggttcaagcgattctcctgcctcagcttcccaagtagctgggactacaagcgcccaccaccacacccggctaatttttatatttttagtagagacggggtttcgccatgttggccaggctggtcttgaactcctgaccttgggtgatacacccgcctcggcctccaaaagtgctgggattacaggcatgagccactgcgcccagcctctcccgccttcttaaacagcttgtaatggacatactgtaactgcttcttgcaagctcgtggtcatcattagttacattaaagccacagcccatcaccaagtgctttctacactgagccaggcctagtggtcactgggagcaggatgtgctcccgctttccaggggctggcagataagacctgtgcacatgggacaagtgccccagaagaagcacggacagtgtgcagggagatgacctcctggggaccaggggagacttgatggaagcaggagtatttgtcctgagcatgaataagcccagaggtggcaaatggcatgtgtgaggaagagcaagtagtcaaatgagaagaagggagaggcagtagatccagggctcgtatcctggaccgtggccagctcaggggggtctgtgacatccccgggttgctgtggggcgtcttacctgcagtttctctgaggagaggatccttcactttcttagcttctcaaagggtcgcatgatctcaaaaaatgtgatagaggaacagaatagattttcttcctaatgacttggagccagatagagtcattgaatgccaggctgagagtttggaggacattaaggtcttggtcaggaaagggacagagactcacactgtaagagaatcagtgtagctgcaaacataggcaaaggaggcctcatgtccaggggagaagcagcttctgcagcagtgccatcgaaagataagacaggagctatgggagtcactacggatggagggacttagcggcaggaaccttgaggatgaattcaccgtaggggtttagggagaatggaaactggttcggaaggaaactgaaggttctgttacagaaaaccaaattggtcagagcattttcagatacataaaagtgatgaaaacatccatttggaacactagtttgagttacagagtgacaggtagggtgtcccacaggtggttggagacgtgggactggaagtttgaggggagggagggctgggctagcggtgctgcaggaccaggagttcccaccttgctctgtgtgaccccaaggatgatggcgcctgggagtgccgaaggaggggcagggagaggtagagagaggcaggacagctgtggcaccacatgtcacagaagtcacagggaaagagagcttccagagagaggagctgacgtttcagtgctgcagaggccatggtggaggccagcactgagaaagagctggagcattccaaggccagattggaaagagggctgcagttgacttgaagggggcgggcagccggtggcaccagccgctgcatttgctctgctccagagacaactccagggcctgtcagattgcgtggggctctttgccctatggcacaggatccccggtgagtgctcgtgcttcctgagcagttttctgttctcttctcactgctgctgtgaatctgcctcctacccttgggttagctcctccactccagatttgctgcttctgatctcctgggagctggcagctggtagagccaggctcagtaggaccagatcctaaatgaaatggactgtgggaggttccctgtgggtgaggcgatgagacctttgcagtgctgagggtgacaggtcttggtggccctgcctggttcttgccattgctctgaggtgagatatctggacacgtaaggtgtcactgtgattgtgtgggtgtcggtggggcagggctagaaggcaagcctggtgaccaggagcacgggtgcccacctccttcctctgcagcccctcccttctcctcccctcacttttctccctcacctctcagctgacagcaagctgctgctggaaatgcccctccactgccccttccctgctgcatggactgtggcccgcgggactgccattggtgccctgatgtggggttacccatgtgtccgtctcctccacactgcattctcccacacggcgtgatcccatggctgggtcaccccgccacccctgatgccttgtacagtgcctgacacagtgtgggctcggcgggtgcacatctgaggtagaacgtggccctgcttccacagattagaaacctggatgccggaaaggccaaacgggctgcccccggtcctgccacccctcttccactgactgggaaatgttctcttaacacccagcctagctttctttccagtagaccagactgcatgtgcgtttggaaataaatggagcccatgaatcatttagaaattattagggctgggtgtggtggctcaggcctataatcccagcactttgggaggccgaggcaggaggatcccttgaggccaggagtttgagaccagtctgggtaatgtagcaagaccctgtctctgtgaaaaaatgaaaaaacaattgctgacatggtagcacacacctatagtcctaactacttgggtggctgaggcagtaggatcacttgagtcctggaggtcagagttacagtgtgctgtggttggaccactgaactccagcctggctcacagagtgaggtcctgtctctaaaaaaatcaaatgtgttaaaaaacttattagaccctctttgtctttatgaagtcaaaggtccaactgagtggaaaatgcaaccttcctgatactctagatcactaaatgactgcgtggttcaattgcacacacactgtcttgtagcttggaccaggcccttgtctttgtcctgaaaaaaggcagccggacctaagtgcagatatctcataggaattggcagccaggagggtgcacgtacaggccctttgaatattcctgagagatgtcacagtagtgaactgcatgcatctcctcggaaaaatccggagggctttgcctcagcagagaaggcaaatccaacccaagatgcatgaacaataaataacaactgttctgagttagcttgaaagctcccagttgcactttgtttcaagttgtttgtgctaaccacaattttttttctccccttctttcccaccagggcttatttcaaaacctttgtccctcagttccaggaggcagcatttgccaatggaaagctctaggaaacaccagtcttgagaggtggccagccagactgcctgtccacatgcgtgtcagcacatacagccgcttcctggaagccgcctggaatgtcttcacggcagcgttttgctcacacagcagcttttgcacgccccaggcagccccgactgctgaaatccaacttgagctggctggtggtccctggatcctagagcccttcacttcgggttactccctctttcttgcctctatttcttagttggaagaaataaactcacaaattatggtgcagtaattttccggggaaagtaaagcctcaggaatgcccacgcctttcttccaaagcctttgtctctgagacctcttaagttctaagattaaatgcccctcgctgttcttcctctg

SEQ ID NO: 37755 - DNA, 197870 bp, Homo sapiens
gcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacggtaggcggcggggggggcgcgacagggcttggggtgtcgaccggcacaggcccctccgtttggccccatggaccgggtctctggcgggtagtgggaaccgcgcgtggcgcctccctgcaggttgctctttgccggggctccggagctgccagagcagcaccccctggcccgcgtcggatggggacctgggctgatccttgggacgcctggatcttgggccaacttttttttgcggggaacgggtgtaggggagtcattcctggagcgatgtagggagaggcacttcggagcagcctgttgggggtcgtaggctctgcaggctcagaagcgcctaggaaggacgcagaggtgggggagcttggaggctacaggtgggtccaggacacactgccgctggggtcctcggaaaagaacaggagggagctggtcgcggagtccaggtttccggggtgcgcgcggcctgggtggggcagggtggaggcggtgcctgactgcccctctgcgtgtgccctgggaggtgggtttgctctggggacagaggtgctggacgtgtaggagcagacatgccgcgcgctccgaggaagcgccggaaccaccagaagcacagggacgcgggtgccgagagtccccagcactgaaaacggggatctcctcttctgtaagggattttcttcccttgtcttaacccacttctctagactcaagggacgccaggatggatatgggtctgggcgaggaggaggtggttgtgtatttcgggaagccccgttgtcaggcacgcgcaccccagtcctaggccagggctggtgcccttcacctccggtgtcgctgcctttggcagcaagaaccgcgtggaggccaaggttgtagaaccaggcacgctccctgctgtctgtctgtgactctgtgcttgccctcagctgccctgtgtggttatgggtgatccctagggacgctgggtggtgtcagtgagtttcttcgggggcttaaaacaaacaaacaagaagtacttttttaaaaaaaaagtctggctcaatctctgtcagtggtcaccccagtttccagcaactcatgtgctggaacccttgtagtcggtacagctgtttcaggagctgggcgctcaactagactaggcatcttccaacccctgccatcgtgtgtcatctcaggataagttaaggccttgccaggaaggaagccgggtgtaatgtgagcgacctctgggcctgtgggtagggcctctctgctgccgggattcctaatttgtatctctgaacagctgaatcccaacgaagttcaagtgaccccagatgtcaccaaaccccagagaggggttacgaagcaagctgtttgggactctttggtgcgtgtgtgctaacctcagtgaaatcactctaacctcagactgagctctgcatcctcttttgccttcagtggggtttctggcccgcctgagtgattcaaagccccagagctggcacgtcatcctctggctgcatttgtatatcaagtcactgggttggtttttctttgtttgctttttggctgtatggacatggggcaaatggaagtggagtgttgtgcagttagctagtagatttggtacaggaattgaaagataataaattgggaatacaagtcagtgagttctttttctccctcttgagcaggaatttttggcttacattcaaataattgctttgtctgtagggaaacaagcagaaaatctttggcatgagtgatgtgagttcctgtaaagctacttatgttcttccagtcttctcttttcagcagaattgaaactatgtggtcccatggcttggtggggcatggtgctttgccaaatttctaacttggtggactaaggagaggacactgtgactctatccccatcccattttttaagatatagaaaagttgcaagaacagtgaccccctaaatatacacacctagagtctaattcacattttgccatctttgcttaactacacacctcccccaaccatccagccatccctgtgtccatccataagtccagctgatggttttatgcactttaaagtaaattacagatgttggtacaggtcattcctaaacattttagtacacattttattattttgacttcaatatgtgcttatggtttccttaagataaaatttatatacatatagtgaaatgtgcaaagatggaaagtaccatttgcataatgttttgacagatgcatgcacctgtgtaaccctagtccttatcaagacagagaatattactgtcaccccagcaggtgccttcatcctcattctcagtcattctctgccctcaccctctcagtggcaaccactgccctgtatctcatcataggtgagtttggcttgttcttgaacttcatgtaaatggaattctgcaatattgtgtaaagctcaccatatttttgagattcatccatgtcgtatccatgatttggtctttttttattgctgacttatgttccggagtatgtcttactccacagtttgtttgtatattctgttaatggatacatggattattttagtttctttcttctagtttctttctttctttctttggttattgtgaacaaagctgccgtgaacatttgtgtacaagtctctgtagggacatgtgttctcatttctcatgggtaaacacctagtagtaaattgctgggtcaaaaaggagatatatggaaacctgaaaagaaactgccagaccttttcccaacatggttataccattttacagtctcaccagcaaagaatacaagtatgagattccagatactacagccctgtctttcctatcctaaagtcaagagcatggtttgactagtgttcttctggggccagagggaatctgaggcagtggggaacatgtttttataggtggaggggccataggaagtccctgactctgcctgaaaatgggtttaaacttaaatcattgcagacgatcagatgaatattttatttttagagattttcagagaagggaattccataggggaatgtacccttggttgtgaaagaagattgattgagtgctttctataaaaagaaaaataaccccaagccccacagaattttactaagcttctgcctagaaactcccgggggatttctggtctattggtagggttgatattaacttggtggagagtccccttggatttcaccggcttggtcagccggctactgaaaggggttgtgtttattttgaggggcaggtcagatttggctttgttaagactcagagaatgactctcttgtgaaagtgatctggcctctcagtgagaaacatggcctgtcaacacccctcttattgtcctgactgggaaaatgggcctgtgcccctcgggtcccctaataacttagtccctctctgtggtgccaacagccaaagcttgccttggctgatctaggaaacgggaagtgaacttttctgtctgagtgggaccccaggatgcatgttttgcatcccatcaaggtgtcccagggctgaccaagctttgcaggagtcagatggcagacagctcagtcttgagacattgcactgtgtttggggactgttccctcctccttaaaagcctagcgcagtgcctgccagagggtagggacacagtaaacattggctgagtgatttcgtgactcgtgatacccatctgggtgatcgcctctctggaggttgacagtgggtgtcaagatgtcagggccccaggatgtattttactcgagggcactttaccatggcttggaaaacacattcaaagggtttgggcctaggaaaattttgttcagtgtaaactttcattgtattaacactgttctctttattactgattttaatattgttaataaaatacaaataattatagctgccacttgctgagtgcttaccctttgccaggcactgttgtacattttgcacgcattatctgaatttaatcctcatgagaggcgagtacttatattatcttcacttcagccctgaggaaattgaagcttgcaaggttaactttccctaagttcacgttttcatttttctaagaccttaagggaagagactgtgacattctggttttttgaaggcaaaatctgtctacaatcacggatttccaaatacacaaagccatattataatagaaatgtaaattagataatcagaacagcgttacaggaaatgatacactgcaatcattttctttagtttttttttgttgttgtttgtttgttttcattttgtcttaagcttactgagtttggcacagccaggggcttatactaattttgatgataatttaaaatattattggttgattaggattacaattttattgaaggaacagaaagacgttgccagctgaactgttcaatacagtagccactagttacatgtggctatttacatttaaatgtaatgaattaaaagaaaagaaaatttaaaattcagtccttccgtctcactcaccgcatttcaagtggcccagagccacgtgtggttagtggctactgaattggatagcacagatagtagtttcatcattgctgaaagttctgtttgacagtgctgctctgtggtgttttttttttacccttcagtttaagaattggtaacacacttggctagggcttctgctatttttcactgacaaagggatacatttagccagatgttgcttttgtgtttaccttttaaaggggtgtgtgtgtgtgtgtgtgtgtgtgtgcgtgcgtgtgatctttccttccattcacattcagtttttgacatacgtttgaatctcccttttctcctgggccccaaaggggctttcattattagcattgcatgttttatcaagacactttctcataaaaaattggtacagcaggcaagcgatagccactgcttgaacccggctaattccttgctctccaaataagaattcagttcagcttttaaatatgcaattgtgtgacttactccctacctgggctgaattcaggaggaaaaatcactctcagtgggccagaaccaaagagctggaaaatcaggtgacattctgcagtgatggctccctgccaggactgagatggaggagacaccatttggggtacttgaaagcttcgtttagagttttcctggatttgacctgcctccggggtgcagggattgatggagaaggctggcagctttgatgtcccagttacatgggacagtggagggctggtactgtggctgtcacctctgctggggtgtacagtacttcagaaccagcctcacaggagagaggaagccactcctcaggtgtctgcaagcagcaagtccagccagaagtgggaaatcaacataagctatgcttggctcagttgtttgatgccgacaaactcttatgctactttaagatcccgtattggaggtttccacacttcttcaaccaggaagccagatgcacctcactgacaactttctctggcgtttacacctgaaatgtcccgtcgtgttgttccataggcagacctccttgagggttacaatttattctttacgggggcctatcagctttcatatgtgtgcatgtgtgtgtgtatatatatgtgtgtatgtgtgtgtgtgtgtatgtatgtatgtatgtgcgtttgtgtgtgtttgtgtgtatgtgagtgtatgtgtgtgtttgtgtgtatgtgagtgtgcatgtatgtgtgtatgtgtttgtgtgtatgtgtgtatgtgtatgtatgtgtgtgtatgtgtgtgtttatgtgcattgtgtgtgtatgtatgtgcgtgtttgtggatgtgtgcatgtgtgtgtgtatgtgtgtgtgtgtgtgtgtgtgttttgaaactccctactttgccttttaccctttgtcctgaggaatccttcaagttttatggaatagcgctaaagttcctcagatttgggggaactgttgtaatagattttactcagaaagttgggtaagagatttggttaatcatagactctggttaatggaacctgatcatatcatgtattagcaaattttggaaatataaagcacaagaaatcaggttgtttatttaaacacttctttaatttagagaggtcttttgggattttctggtgtcttatgataccttataagtgcccttttcagtgtggcataatcatgactataggccagagtaggtcaaaaggtgtcttcataatgagcaacaagtaatcccagtagagtactaaaacggttaatatttatactgctctttctatgtgtctgagctcttctgagccctgttaaatagtaactcaccctaccttatttagtcctcaccctagaagtagatattgcagttgtccccattttacagatgagaaaactgaggttaaatggcttccttgaggtcacacaggtaggaaataagggcagcaggatttgaacctagtcagtctggttccagagcctgtatgaccaacccctgtgctgtactgttaagaaagtgaatttgagagccacagatggaatattccaaatgccctttaccatcctgtaccagataagtgtctttcctattcccgaaagatgctgctaagtaggtatttattgtgcatctgttatgggcagggcattggaatagctgctgttggggatgaagaagacccgcttgctgccttccagaaatttactgtcatgtagggagatgaggcattaccaagagctgtggagctctcctctgaactcgaaatggtacatccagcggcctactgcatacctctgcttgggtggagttaacatggctaactcctggcttcttctacccatctcagaagatggccactccagccttgcaggtgctggtgaccaaccctagaggtgtcttggatgccctcttttgctcatcccctttttccaaatcatcagtcaatcctgttttctgccttcaaaacatatacagaatttgaccactgctcacacctctacttactgtcatctgggttccctgctgtcatggtcagtcatggccagagtaattgatgtcttctttcagctcgaaaccttccagaggcttccaactcagtcagggtaaagctgaagtgctcacggcccggccaggcctacgctctgtctccccagccctgtttgacttcaccctgaggtctgctcagcctcccaggggccccacaccccagcttgtttgcacctgccactgccttgcctagcccaccctcccccttatcccatggctcgctctgtggccttcctcatgattttgcttaaacgtcaccttctgggtgtggcctttcccaatccccgtatttaaaacactatacctcctcctgtgattgctatccctcccccctgcattgttgttttctagttggcatactttaaaaatgggattttgtgtattatttttatttgtttgtctattgcctgtttctcggcttctgaaggtaaggtccatgagggcaggcgtgctcttttattgtgtgaatctcttttgttttactttggtatcactggcatttagaacagggccttgcacatagtaagtgctcattacttatttattggatgaatcaatggcctagagtggcaatcctgttagagctcagccttgaaggagtgtgatggttaattttatgtcattttttcctaggctacggtgcctagtttttggccaaacaccagtctgggtattgctgtgagttattttttaggcatgatgaactttgaaatcagaagacttggagtaaagcagatcaccctccatcatgtgggtggacctcatccattcagttgaaagccttaagaaaaaatactgagatccacaagaaggaactctgactccagaccgcctttggattcaagattgcaacatcaactattctctgggtttccagccttctggcctgccctgaagattttaaacttgtcagccccccaatttcatgagctaattccttataataaatacctctatttgtctctctctatctgggtacacacacacacacatctgactggttttgtttctctggagaaccctgactaatagagaagatgagaggtacgggaaaggaatgtcaggtggaggtccactggaggaaaagggtggtgcctggagagttctgagggtgtacaaaagattgcagtagcttagcctgacttcactctagggtcaactgtgaaaggaaacaatgggaggtaggactggaaaggagggaggatggagggagattgaggctgaggactccaagctgcacagcagatgtgattatgctctttgagccacttgtgtggtgtaaaatggttaatgtgggaaaagctggagataggaattagatggatgagggggaggcagattccaggaaagcgttggtagctgttgcgatggcagattggtttggagaataaagtggaggaatggatagcatccaccagctctggatgggccaatgtcagggtgaggatggtggcgggagcaggctgatactggggttttgggcctggatgttgggagggcagtggtaccacccagagacgagaaatgcaggaggaagagcaagcttgttgggcaaggtgctgcattctgtggggcatattcttccagaagtgctgagaaagtctcaggtgaagagagaaagttccaggtggagatgttgaaacagttcttggagatgtctgcctggagctggagagaagacaggcaggctgggaagggaactggggagctcttgcctggagcaggtcaagttagggcaagagagggagtgtgagtgctaagggagagacaatagcatgtaagtaacttttttgagcatacataatactatgtattggtggttcccaaattctgtgctaagataccgcaaggcactgcagcaaaggcacagggtggccaagggatatttcacatctttgagggaaatgcagcaatacttaacatctgtcagataccacgctaactactagcttgaggcacttcacaatatcaacatctgacagtaccatattactcttgatgatgtcatatctttacaagctacattttgggtagttgctaagaaaatcagtgtggaactgaaaatgagggtggtggtgttcagtgtggttccaagttttgagaagttgctcagtgtccaacagatgcacacatcccattagcaagtaattgtggttagttaagaatgaaagaaaaaatatttcttctttcagtttatgtgtgctatttttctgaaaggctgctgttgttaggctgtgaataagtattaagttgtttggacctaactacttaataaaacgaactattgggtattttttttttagtctagggcatgccattaaaaaatgtacagagaaactaagggcactgtgaacggagaaatcctcagaatctctgccatatgttgttctgggtgttatatatagattgtaaaagagtacacgcagggatagaaagatagggagacagggaatggcatgaggactgtgtccaagatgtctatttatccaaaaataaactatctgaagcaaataaggtaaaaatgtaagcacttgtgaaatccaggtggtggatccatggacatctcattttctgtacttttccatatgtttgaagtggtttataattaaaataattttggaaaagtgaggcaagaggatggaggaggacagaaatgtaggaggtgcctgtgcttgcctgggaggatggcagaggagactgggaaggggtgtctgaggtagaaagagattcaagagattgagggatgtggaactaagcagatccgtatggctgagctctgaactgtggttctcagtcctggaggtgagggtgtaggagagatcctgggccctgctgagtcctggctattaggagattggagagggctaggagtgggaaaagactgggtttgctcctagagcactgatgctcaaccctggctgcatgttagcatcacttgggggttttaaaaataatggtgctctggccccacccctaaatgcctgagcatcagggcttttaacagctctccagatggttccaaagtgcagtcaagattaagagccactgccacagctcagggtttctcaaactgtactgtgagtcaaactttaagggatcatttattgctcaaatacagattctgattcagcaggtctgggatggggcctgggatcctgcatttttaacaagatcctggatgctgctgctggtctgaggtccacatgttgagtagcaggttctgagtgggagctatttttagcgaagggtggctggagagcagcagagcagagatggactcaggttcagacccctcctgagacagactgagatggtggtaggtgtgggagttggaggagtgggggtaagcaagtgttttcttcttataatgcaaacaccactcctattaggtatcttttattgtgtaacaaattacaccaaaacttggccgctgaagagtcagctctcaaccactccacaatgccacttctcatataggagcaagacttctgttaacatgaactgcctggattaattatctattgatgggtggtaaattgccctaaaacctggaggcttaaaacaacaaacatgttatcttgcatggtttctctgagtcgggaatccagaaatggcctaactgagtgcttctgacttagggtctctcatgaggttgcagtgaggatgttggccgggctgaaggctgtaggatctacttccacatgggtgctgagttagtgctgactgttggcaggaggcctcgttgccctgcagtggaacttcatcctgctgatagagtgtcctcacaacatggcagctggcttcccccagaacgagagatctaggagagcgaggtagaacccacaatgtttcctataaagtagcctgggaaatcacactcatttccaccatatccttctggttacacaggtcagccctattcactgtgggaggggaccacacaagggtgtgaataccaggaggatcactgagggtcgtcctggaggctggctgtgatatccttattgttttcttttcttttctttctttcttttttttttttttttgagacaaggtctcactccgttgcccaggctgggcagtagcgtgcagtggcacaatcatgcagtggcgagatcatggctcactgcagcctcaacatcctaggctcaagcaatgttccctcttcagcctcccgagtagctgggacctgccatgtccagctaatttcttttttaaatttttttgtagagacagagtcttgccatgttgcccaggctagtcttgaactcctgggctcaagtgattcacctgccttggcctcccaaagtgttcttattgttttcaaccatgaaaataatgcatgctcaacaaagaaaacttgaaaatgtagcccatagtgtcatgactcagaaaaaagttctgctaacaggtggtttatgaactgccagtttttcaaaagtatggattttataaacaaatacacaggcacttttaaaaagtggtaccatataaaccgttaatacagtttgatatagattgttctttacatctggcattggatcaggaacactttcgacgggtacattttagttttcctagggtttcttagactctgttgcaggacagcaaaaagtctgacaccatctgaatactctactgaacttttaagtttaatttatatttctggatctagagagatgtcgttatcatgtaaagactttttaatttggatgatcagttcttactttggatgactgaatgaagtaataaacatgcttgcgtcttcaaatacagaatttgagtgtagagataaaaaatggggttgccagctgatccagcatcattgcatataattgccccatctctggttgcttgtcacgagctgttggcatttgttaaaattagctttacaggctgccttagattagcagcaagtgtggcaaatgagggcttactcttaatgaagctaatttgtatttgaaaatataactgcatttattgcccccattatttaaatgcatgcatgctagttgatagtaaaaatgaacttttaaactaagccttttctacgttatagctgaaaaatagtcttttaagaaggtgatccttttgaagtggttttccagtctttttatgggcatcgtgggaagcatttcagaaacaaattaggatacttttaaaataataatttaaacatttcaacatttaaaatgacacaggacattgtgccgcattgctggtcagcttcttctggagccaagtatttggcgctgtgctgtgtttgtgtgtgtgtgcgtgtgtgtgttttgttacagacaagtcttgctctgtcactcagcctgcagtgcggtggtgcgatcagagttcactgcagcctcgcaatcctgggttcaaaagactctctcacctcggcctcccaagtagctgggatgacaggtacacagcaccacacccatctctgttttatataacagcgatttgttccgaatgctcccgcattctgtccagacttcccgaacagtcagccatactgcaccatgggtatctcgtcattgtctctgtgatctccctgagggcagggcctggccttcccagttttagtgtttcctaaccaagtgcctgactcaaagcagacctcaataaatgtgtgttgaatgaatggatggatgaatgaatttggaacataatttccctccctcatggaactgatagctcctgtaagaagctgatccaccgcttaccaaagagacatcccacttaaggtttgattcagccaaaattttttccagaagatcaccattcaagggatctttgtttccagatcatttgcaatgtctgtcatcttcttcttgcagttcgggtctcggaaccttcttctgattactttattttcctctttagaaagcatccagttcctaattacccttaccaatttctgctagggaactgcatatatgctttgattatttccccactgtttcaccatagaaatggggaaagacctcttccatttcctctacctttgaagacttcttggaaagtttttcttggtaccttgatgctcgggagacccatacacatagtttcagggatgtctgctgagaaaacaaaatataaaaagagaaacaaatgcctggacacctgtcaatcaaagctgatccaacaatgaactcacacataaaataggtaatctgattgacattaggtgtcagtgtgaggtgagcataggaatttggaagggtggagctgtgggagcaggatggagcatagatgaagtactgggggagtctcactagacacaggtgacttttagcatgtgttttttacaaaaacaagcaacaaccagagaaaaagtcagtgaatagcaccgctgggcatgattccacctagtgggctgatgcctcagttgagcaggggctagctgatctttgagagatctcactttccatacacttttcatggcggcagtatctggacatcctacatgtgtaaagagaagcattttttcattaacagggctcctgcacttatcatataacccaacaaccccactcttaggtatttaccctagagaagtgaaaacttatgtccatataaaaacctctacacaaatgtttatagccacttcattcataatcagccagtgccagaaacaacccaaatgcccttcaaagggtgaatggctgtaacagggaccttaaaagcaggccaacttcagcaggtgccaaggaggcggcaggccatggtcatttcgagcagacttggtatataagttgcttatggtataaatgaaccactccaaaacttagaagcttaaaacaacaacagtagcttattttgctcaggaatctgcagctttggcagggcttggtgaaacagcttgtctttgcttaacatggcatcagcagcttgactgaggcagaagctctacttccagcatggcctgctggcaagatggccagcaagttggtcctggctgtcggttcctctccacatgggcccctctttggggctacttgagcttcctcatggcatggtggctggattccacgagcaggcaccccaaaagtcagggagtaaatgctctcaagtttcttaaagctgggtccagaaactggaactgtgttattccgtcatattctattggtcaagccatcctggagcccagattcagggtaattgacatagacctcacctctcaataggctcaataggaggaatgtcagtggattttggagccacatttaaaaaccatcctacttaccatttaccttccaccttactagagactttgacccatgtgagagatgtccttctactgagacactccctgaatgtctgtgtgcgggaatgtgcagcacacctgtgtcttctgtctgcatctgacagtactattccttagaccttttcctctgccttccctcccactgccctcaaaagcaacatacccatcttttgcctccatcctcttgcaggattctaatgtgagcatggtttgggaatgtcacatggtaaataatatagtctacaaaactctacaatagtgtgcaagtcactgttacagctgatttttcctactttttataagctagatttttctgacttgttttgagcatggtatagacatttttgaaatgatgtaaaagtctttcctattttgacaggggtgggagttggtggaagaatccagggcgaaatgaaaggaatgccggtgtggcagcagggagcaggctagctgcctctacacaaaagagtaggaggaactaattcacactaaggttttgatggccagcaactacttcctgtgtctccctttccaaagagggctgtgctttagaaacagttgcttagccagggttgcacgcactccagagaaatcagtctctaaaatttgagattcaaggattcaatgatattacagttttgctgctggctggtatttattaaaagaaaaacttgatacaaattaaatttaacagagtttgaatgagcaaagaaaacttcataaattgggcagcctcagaaccagaacaggttcagtgacctgcctgaaacacatcctggcagtgttttgtgtacagaaaagagaagtgaggtacagagacagctggcttggttacattaattcactgcctgtgattgactgcattctgctgctgtgattggctaagactcagctatttgttacagaagtttacatcctaagttaggcttttatatagtttacctactaaactaagttgcagtcgttatgtaatgactcaagtatggaggcatcgtcaagccaaatttggtttaatgtaacatactctttatcttttctgtgtctgatcacatggatgatttgcccagagcccctttatgtcctgtgatatcaagcacaatgccctttgggatgagctggggcagaagcctcaaggttgggagtctgattgaaactttaaactcttgtgaatcacaagagttttctaatgcttcttggtactcttctgatccccaccccaaccctttccaaacctttcttctcatcctggtaaccctctcctttctgctatcagggaacctgtcctttatcaaagaaactaaatatagattaaaaattatagacaaaataaaatcaaactaaagtggtagtggctaccaggagcttagtttcttgtccttcccatggagatatttgtcatttaaaagcagatacttaggaaaggtaattctgatttcaaaggaatgaacctctaatatgagaatttacagaataaggtagcaaaagtgggaggatttttgaggaacaagctccttcttggaggtcttcaaacaccttgccttccagagcaaggcaggtctgcctgagtatgcagcagggtgggcatgagagccttcccttgcttgccagcctatccgctcctcattcagccttggtcccatcaaagtctccagcagggcccagtagggagaacctgccgctacccattagaagctgccaccagcctgatagagagaagagtcctttcgccttctcagaactctgtaatgtatacacagtggctttattggataagctagcatcagatgaacatgcctactgtaaatattgcttcagtttttattcagaagaattgagacccagtacgtagatgattttgtgttttgcctttattccatcctcacgttattgttggagatgtatctgtgcatttgtaaggtcacagatttgtttattatttttgaacgttttagtgtaagtatgggaaagcacacaaatcaatacagagactgctcagtggcccagtgaatcgtcacaaactgacacccagatcaagaaacagcaaagctggtaccctagaagccccctcatcctctatgcagtcactgttctcccaagggtaactggcaccccagcttctaacactggagatgagtgttgcctgttttggaactctgtataacgggagtaagaaagaatgtactttttgtgtctggctgcccccacccccactcctttttgatttttgagattcattaatgtagtgtgtaatcctaggttccatgttttcgttgctttataatatttcattgtgtgaatataccataatgtattcatctattctcctggaaggtgtttgggcggtttccaggatggggctggtatgagtaatgctactgttagctttctcatacgtgtctttcgatgcccatatgtacacatttctgttggtatatacccaggagaggaatttccgggtcacaggataggcatgcgttcagctttccaacatattgtcagttttccaaggtggttgtaccaattcacactctcaccatcagtgtaggggaatttcatttgcttcttatccttgccaacatttggtattatcagtttttaaaatgtcgagctattctggtagatgcctgttaaatctcactgtggtcttcccttcatttccctgatgagtcatgaagttgagcttcttctcttatgttccttggccatttgcatatcctcatgggtgtttgttggggcatttcacctgtttgctgttgggtagtgtatcttttccttatcaatttgttaggcgctctttgattcatggtggatgtgagtcctttgttgcatgaatgcattagtgtgcaggagccaacacacactggcttttgagagctgattttagcatctcttcctgactctgccttctgtggcatcatgtttggcagcttgaaagctgccatggtgggtgtgtttacaccacagaaataggcaaactacaaatcggggcttcctctctttcttggagagctggtttaccagtgcaccacttgacaaatgtattgcaaatagcttatttcagtctctggattgccttttcactctttaatgtgggttttgaggaacagaagttttaaatcttaatatagcccacattgtcaaaattttcttttgtagttagagctttttgtgtcctctttaagaaatctttgcctccacccccatatttgtttacatggctaactaatcataatcaattttgcttaacttcccccctactgaagcagcactgccacatacagttataaagattgttcccaaggggggatgcaggggcttaaatccagaccttgctgtgctcagtaagacatggctgggacagggctgcattcctcagaagagggggcacctttttcgaattctcacaaaggcaccatatgggctagtggtgggatctctgacaccctaaaccccacgctgcctctctggcctgccaaaccacactgcctgccctttcccttcaggtagggcagcttcctgcctccatgcctttgctcttgctgtgcctccatctctacgtcatcaaatttgggatctgtccagcaaagcccatctcaaatacccaatccaggtccctgccattttcccatcttgtgttatagcttgaatgtcctccctcttgtagtagcctaacctccttgagggcaaagaccacattgtttgaatcgctaataatgctttgcctgtagtaggcatgagtaaatctgcatgaatgagtgacttggcgagcctttgggctctttgcagagagtaacagtgcacatcttgacgggctacgtgttcccaacacttagaagcttccttgtccatttcttttctgctttgtcccagtggatgccagccggcttgcttttcagcagttaaatatgcagccttttacatatcagctgtttcatctgcagaactacagagtattttacaagtaatcagttcatgcagattgcacataaatcatgtctgctctggccctttggatactcatgttcctttattaaggcataagtaagccttcctgttctcatccattctttcagactttttttaattactgaaaagtagagcctggttgtcgctacaccgtctccttccactccacccgccccatgccctcgttgcttttctgaggttcagtttgtttttctggagcttgccaaattgccttaggaagctgggtaccttgtaaatgaattaagcaaaaggaaattcttatctctaaaaggaagcggtcactgggtttctgtgtgtgatattcttggctggttaatatttttgtgaaatatgttctgatggcagcagtggtaccccagagaggaggaaagcatcgtttatccttagtacacagaagcaaaatctcttctgctgaagttgggagagtggatgaaaagctatttcgtgaaagtcattctgcccaaataaacagagagccttcattgcttttaatcccatggaagattggaagctcagctcaccttaatgtgcccattactttaacatttctttattttcttttcaaactggaactacagatttttgctgtaatacacgtggatttctgcttccaattgctctatccctgctattagtgttcagtcagttttcattttggtctaagatgactctctaagagcttggaagtataaaattatttcctgcagtttggtctaaaaacgaagaaaaaggggactttcagacaaggcccataaaaataccaccatctacttttaggatgttttatgaatataaatttcctgtctaaataattactgttgagggtagaaaggactcggagtttggaaactgtaacaacgacttattctgtgttagcaaccacagtgaaggtgacacatctcttgttttttatagatgggctgacactataatgcaccgtattgctttttagattccattttttattcatggatacagattatagtggaactgaggcagtgggaggtattattttcctcagatggggaaaaaagatataaaacaggtatgcttttggtgtcatttaaaaaaatctcaggacggctggtaatagtatcttagcagaaggagaagccagcctgagtactgagcacagtcctctgtgttcaggtcctatattaaattatactctcagtttcataagggctgaggtctgtcatgtattcttcaggaaaattacggcatcttttatactagggtgtttaaagacaaaatctcagaaaaaaatcacctccccgcctttttcctttggccagcagctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctggtgagtacatggggtgggaatggatgggggcaggtggggtctccagcaggggcctgcaggggatgggggtgcagttggagagctggatggggtgggggctgtgaagaaatgaaaagggcaggcctgtctcaagggggcggcttacagagatccagatttttatgtgaaatctctcactttttaaaaaatagtgtctgggcacagtggttcacgcctgtaatcccagcactttgggaggccgaggcgggtggatcacctgaggtcaggagttcaagaccagcctgaccaacatagtgaaaacctgtctctactaaaaatgcaaaaagttagccaggcgtggtggcgggtgcctgtagtcccagctactcgggaggctgaggcaggagaattgcttgaacccacgaggcggaggttgcagtgagccgagatcacgccactgcactccagcctgggcgagagagcgagactctgtctcaaaaaaaaaaaaaagcaacgaattacagttttaacaaatgaaaatcatgtgtgagccaagcaatacatatggataggctgaatttggcccatgagccaaccagtttgcagactgtttcatagcaagctccgtggagaaggaaggtttgccttctctcctcgtatgaaacttcctctccacccaaattcacctgcctgttgtctgccatctcgcaagagggctcattcatctgggcttggctttgccttggctgagccagagggagtcgggtcacctaccatacaagtgtccaaggactaaggaaacagggaatagcccgagaagactggcaagggatggtcagcatcagcatcagagcatttgctgagcacctgctgtgtgcagagtgttgggccagtgttgggggggaagtcgtgagcctgtcctggcatcttggagtgttctatctgatgggagacaggagacccatacaaatgaaaagaataaaagaactccacaggttttaattgtaagttggaaaacagtataagacatgtttttggaagaggaagaacatgctattctttttgggtcccaggagtttgagagcaaaaactgggcactatgtaatgaagtcatctgaacacattttctccctgggcttctggatatactttaagcttctatgatcagaaaggagaatgagtgggaaaagccctcatgctcatggatttgagtcctggctctgcctcagagcaactgggtaaatcactgagcttcccagtcctgcagtgtcctcatctatagcagtgtcctcatctataaaaggaacacgggtgtccacttcatggggcagttgtgaagattagaatggggtagatatgtgtgaagctcgtagcacaatgtctggcatacagtagggtctgcaggtgtttctcttcctcccctcctccttgactactctttctgctgtgactgtctccgtgcggaggctccaattgcttcttgagctctgaaaaaggacagctgagtgtctctgcagggacattctgtgcatccccctcaacaagtcaccaaaactgaagccagcatcttccttttcagattgctcccttccggtgcccttgatgggtcagtcatgccaccaccatcctcttaaacgtgcagatacctatgaccatgccttccccctgtgtgtagttgccattccttcactcaagcctattaaaaccatgtctgtaaatgcctctaatatagctaatgtaacatacaattatttggagcatttggtcatgcatttggccctccatttttttgttcagtgaatttttaagtgcctacaatgtgctgggcattgcgggaggattagggaaaaacaaaagcgtgtctaggagaaaggattgaaaagaagtatatcaagatgttaagtattaggatgctgagatgttgggggaattcttttttctcccatttgcagttgttttttttttttgtttgttttgtttgtttgtttgtttgttttttgcatcgtggttatgtgtttttcattatgacgaagagtaactttgctcctaagaaccttcacaaacacatgaagtttccatgcagtgctttgtccccccactgcttcatagctggtctctgaatgatttccccgacctccttatttgtttgtttccctgagcttcagctgcagcatccacactgcttttgtgcattgtgctgtccttgatggaattatcttttgttttctgcttatgaaataaacatacacccattataatgagctaggacaacactgggggatatcccacgtggcctccctgctcctgccctcgtcctcctacagatcctgccagttctctgctcagagctctcctgtggctgccaccacaccaggagtgacatagctctccttgaccgcattctcccactgcttgtctttggtgttccgctgctttgactttgctcttttgtgaacctgccaggcctcctctgggcttttgcactgcctgttcctctgcctggaagtcctcccccaggatccccctgctcatcttcttaacccccttctctctgaaactttccttgaccacctctttaaaatttctaccttctccccaattctccatgtctttcccctcttgattttctccatagcacttcttaccatgtaacctgctatatatcttgcttattgctatttgtttcctctttgttgtctgcctttcttcattagaagagagaatcccttcccatgagtgcagggattttctctcttttattctctgctgctccctcagtgcttaggacagtgcctggcacttaaatagataatcagcaaatatttgctgagtgaatactcaccatgtatttttgaatcctgcttttatgcgacttaacattgtacagtgaggtgtgcacctgtcatgcctatgctcggaaagtatgatttaatggctatatatgatttaatcactcagtgtaccataatttattttgcagtccccttttattggacatttaagttattttgggctttgggctattacaaataatgttgtgataagcaatattgtccataaatctttgtacacatttctgactatttcctcaggaattactgaattgagggatgcgaatgtcggcactcttgataaattgcccagttgccctgtagataggacctgcttgtgtaaaacacacatctgattctgcacaactctttagggggttcccctggatggatgaagttgagattcaagccagagctcagggctttctgtagcttggtcttgcccttcccagatcctccccctattgttccctggaggacagtgtgtcgtgcccactgcccccgcctaggaccctcctttctctgcttctctgattcagtgcaggcagctctttctgcacaggcccctacctcttactgcttgctaggaccccacccacctggatttgttccttcttgacaaccattctatcagaattagtctcttgtgcacgcctgtagtttgtcaatactgtccttttgacattttgattacatcatatattaaacctatttgtgtttccctcagggcaaggaccaagccttgtttatctttctgtttgtcttccttgttcagctttctagctgagatgagcctgtcttgcatagtcgggtcctagtaaacctagaactaaatgctgactcctttccctggcggtctctcatgtttttctcccaggagttctaatgagattattctttattctccagaatggagctgacgtttgttgagtgctactatgtgcccagtcctgtgataggacattacgtcctcacctcatttttctttctttattttgtttttttttgacatggagtctcgctctgtcacctaggctggagtgcaatgttgtgatctcagctcactgcaacctctgcctcccaggttcaagtgattcttatgcctcagcctcttgagtatctgggattccaagcatgcaccactacacacggctaattttggtatttttagtagagatggggtttcacaatgttggccaggctggtcttgaactcctgacctcaagtggtccacccacctcggcctcccaaagtgctgggcttacaggcatgagccactgcactggcctgctctcatgtttcagaaatttttcagctttatcaaggtataaatgaagtacactacattgcacatatttaaagtgttccaacccataaaaccctcatcacatcaagatgcagaacatttccattgccccagaagtttcctcatgcccctttgttatccctccaaccccagacaaccactaatctcctctccatcactgatttttttttgaagcgaagtctcactctgttgcccaggctggagtgtggtggtgcaatctcggctcactgcaatcttcacctcctgggttcaaataattcttgtgcctcagcctgccgagtagttgggattacaggtgcccgccaccatgcccagctaatttttttatttttagtagacacaggcttttgccatgttggccaggctggtctcgaactcctgatctcaggtgatctgcctgcctcagcttcccaaagtgccgggattacaggtgtgagccacctcacccggcctccatcactgattttatttcccaggatgttatataaatggaatcaaatagtacgtactctttttcaaaacctagctcttctcattcactcaacttactcatttaagattgatttatgttgtttggtgtgttttctgttttactgctgagtagtattctgttgtttgattgtaccacagtttgtttttccattcactggttgataaacatctgggtcatttccaggttttggctatcacaggttaagttgctatgaacattcatctttgtgtggcttcttatgtcattttatgtttgcagtaacccagtaaggtaggtggatacactcatttctttttgcagacaaggaaatggatactcagcgaggttaagtaacttgcccaaagaggcagtgctaggaagtggttgggggaagaattcgaatatagaattctagaatcttgggcatcaaagctcttgtgatgccagactgcaagatgcgacacaaataggcattaacaccaactggaatgttgttgttagaaaacttattatcatgtagaatggtataagaagattcctcttccataaggttttaaccatagcagatttttaaatgacactctatacacttatttttcatggagacgatgcttatttgactcttaggcaaatacaagtcagggaggtattggcccatgtccacctgatggcttaggtaggaagggtgccatgtgcattttccaaaaagtgaggataagctgggtgcagtggctcacgcctgtaatcccaacactttggaaggccgaggcagggggatcacctgaggtcaggagttcgagaccagcctgaccaacatggagaaaccccatctctactaaaaatacaaagttagccagacatggtggcacatgcctataatcccagctactcgggacgctgaggcagaattgcttgaacctgggaggtagaggttgcggtgagctgagatcgcaccattgcactccagcctgggcaacaagagtgaaactccgtctcaaaaaaaaaaaaaaaaaaagtcaggatcacagttaacactgttgagtttgtcccttgcttaaagctcagtgctgttgttgaagatactggaacatgcagcctcacttgtggggctggcagaggcgaaagcagcaggaatcttacagtgaagcacataagctgccaaaaatctcaattctgggtgatttgattgggtcttaaattttcaattaactctggtcaccgagggatgaacctgccctttgatgggtttcatcgcagatggaggcccataaagcatcacaatttctgcaaaacggtaccccgttatgccttttatgtgagcgttttgccagcctctctgtgccaggccactctaacaccacttgaaagctacctatgtcagctctgtgaaaatcgactatgttttatgcacatttggtgccagggacagttggcacggagagcaatctgtgtaatgaggccggtgcccagggcttgggccttccttgaatggtccagtcctgcactgactagtacaggagccaccagccacatggtatttatatgtaatcattaattaaaacaaagtaaaatagaatattctgttcttctgtcacactagccacatttcaagtgctcagtagccatgtgtggctggtgactgctattggacagcgcagacagagaacgtttttatcattgccgaaagttctatagcttaacactgttctagtctgttttcaagagaggaaaattcggtttcaggtcagaatctgtgtctctaagtcataacaatgtaccattttatcatgaagatttgcccttaggttcatagtgaccataagaggattcattgattccacagatatttattgaaggtcaaccttgggccagatgccatgtcttggggacatttgggtgaactagacaggaggtgttcctgggttgccttagtcagctcgggctgccataataaaataccacagactggcttaaacaacagatgcttattttctcatagttctggaggctggaagttgctaccctggatatcaaggtgccagcatggttgggttctggtcagggctctcttggcttgcagacaacagccttctcattgtgtcctcacatggcagagagggagggagggaagacgggggttggggggaagacagagagagtgagaaagagagaacaggagcgagcacaagctctcttgtgtctcatcttgtaaggacactagtcccatcacgttgtgccccatccttatgacatgatttgaccttcattactttcttactccaaatgtagtcactttaggggttaggatgatttggaaggacacaattcagtccatagcaccagactatagattggtattttactttggttcaaactctctcacagatgaagaaccagtacttgatgctagagtaatggagactgatgggatggtggtagcccaggcttgatggaggagtctgtgtgtcaaggaagacttgaaatcctcaggtggatttggagttttatgcaaatttggtgccagggacagttggctgttagtcaggcaaaagatgggagaagagggtggaagcagataatcttttcacgaagaggagacaacttgtgggagggatcaaaacacggagataaccctgcatatgtggggagccacaggcagttcagtttggttggagcatgttctttgggggagaagaaagtagggccagatgatgaaaggtcttaggtgttgggctgaggagtctaagctcaaaagcactgaaggtttttaagatggagggggtgcaggtgacatcagattctcattctggaaagatttctctggatttagaatgaggaaggatggaaggggcaatgctgggggaggggaaacatatagaaaccattgcagtcatcaggcaaggtaaaggtggcctcagtcaagacagtggcagtggggacaagaaaaggagtgggggaaagagaaattaggaggtggtcctagggactgcctggcaggtgaaggaaagcagaaagcagaggaggaggtgggtgtgctgggcacctgggatgacacgagttccccacagccagatgctgagtctgctttaaagcattctccaataatgctctcacttgatgattcaagtagccccgaaagttgaaaggaaggtatttttcttttcttttcagatgaagaaattgatttggcaggtaacaagtagtaagtgggcccagaatccagtgtttcagctctttccactcaaagcttatccaccgcacatgaaagagagctcagcgccaactgccagtccactgaagggtgtcgcagtgatatttgtttgaataactttattgaactataatttaaataccatgaaacacacccatatgaagtgcctgggtgatgagttctgataggtgtaaacatttgtagaactatcaccacactcaagatataaaacttttccatcaccccagaaagttccctcaggtgcctgccctgacccagccaactgctgatctgctgtgtcactgttgaatagttttgcttctttttgaataacatgtacatagaatcataccgtgtgtgtgcctctggcttctttaactcagcctaatgcctttgcagttcaatctgtgctgttgtatgtatggagtccttgatgttgtatgtatggagtccttgctgttgtatgtatggagtccttgttgttgtatatatggagtccttgctgttgtatatatggagtccttgctgttgtatgtatggagtccgtgctgttttatgcatggagtctgtgctgttgtatgtattgagtccttgctgttgtgtgtatcaagagttaattcctttttgtttctgagtaatattcccttgtttgcatgtgccacaatttgttgaatcattttcctgttgaacatttgggaaatttccagtttggggctattatgaaaaaaaaaagctgaatatccacgaacaagtgttttgtgtggatgttttcacttctgttggggaaatatgtaggagtggaattgttgggtttatgctaaatacatgtttacctttataagatactgctcaactgttttccaaagtgtttgttctattttacatttccaacaacaatgtatgagagtagagagcttcattttttataggtaataatcagagttactttttattcagcacctactgttgtattaatctcttctaaacaaactaacaacaatcttatgaggtaggtggagtcacccccacggtatagaagaataaattgagatattgagtttggagcagttataaaagaaacttgctaggccaccaagcacttggagctttgcaggatatcttgtagttttactgaacagcaaagccttcactttggctttcttggttcctgaatcttctgtgtgctgtggtgggtttaaactaaattgaagggcttcaacatgaaaaagttcaaaggtaatttattcacctttgcccctttctcaagcttgtcttcttctatttctattcttaagttcctccttataagacattcccatgacacgcattacaatttcgaggatcattccacactgctgcattttacaaattcccatctttgtggttttcctgtctaagaggactttaagaactgattttcgggatgttttcttcgacattgtgctgaccaggctcatacttggctttcggccaccagcattctagccttaaactctgtatataaattttgggtggtcatgataataacaggatgacattccttattcaagacatgcacattgcgcaataagttttctacaggtccagtttttctttgacctccagtctggggggtgttagtctgacacacaactacagaagcagctgataatcattgtttataagagttgtcctttcagtctcccttcacggctgggaaaaagactaatctaaaaaaatggatcatgatttacattatattctgaaaattaagaaatgaaagttgtggggagctaagtgtttgggtgcctaatggctagttataaatcctggcactattagcctttctgatttcgtgaagggagatgataggccagttccatggcctcatctaaaataatgtcaatctccagaaaagcctttaaaactaatcattagcttaaaggagtggttcccaaccttgagagtgaatcagaatagcctggagggcttgtcaaaatgcagagtcctgggccccatcctcaaagtttctgatttagtaagtctagggcaaggcctgagaatctgcttttgtaataagttcccaggcaatgctgatgctgctggtctggggaccacacttggagaaccttaaaagatcatgtggagtacaatttttttttttttaatttgagtggagatggcagaaaaaaattatactagtgtgatcttttgagtataaaataaattcaacaaatgtttacttacctacctatgtattatgaccaaatcataacttactttctttaggtgacttggaatatatttgggaggacaggccagaggaataaaaataaggatacaaggtgacacaatgattctcaaagtttgtttaaaaagttcccatgcccagctgcacaccagacccattaagtcagtcttggtgttgtggtttggttctgtgtccccaccccacctacagttgacactacagaacaggtgtcaacagactcagcttaagtctgtgatgtctcagggagctggctaagatggatacctggctgctggtgcctgcaggttctgggagggaggggggtgctttacaggggagcccaacatcgtaaactagggaaaggaaggaagagaattggaggggatgagtacttatttgcattacaggaggattcttggtttaaagtgggtttcaccatggggttcctttagatagagcctcaagtactctgaagtgtttgttttgcctttccttaatgaggtatttattacctctctgtaaatatgatacctgcagttttagaacataacaaatccatctataacatttgcagctcttcagcagaactgagcatacagtcactgacgttgatggcattttttctaagtaaaaacaaacaaaccttggagcaaaatgtcagaagccctggaggagggaaggtggatggctagaagggaggctctaagcagcccttgatactgctgcaagaggccccagggtcagagttgggtggggcgggactttctatatttccgcaaatttaagctcaccccggtgggaggctcctcctcgtacagtccttcatcttcatggcagaaaggctgttctgcccctgcgccctccctggcctctctggggatccctgcagctgatgtattgtgatggagcagtggacttggatgctgctggtattgatataatcattgttaacagtagcaacagtaataacagctaatgtggcatgcatggtgctcagtgtcaattaatccttatagagatcttgattttacaaatgaggaaacaaggctcagtgaggttacctaatgtgcccgtggttctgcaacgaatgtgtgatgagctagaatcagaactcagacttgccttcttcaattctttactcttaaggattgtggacaataccaaaggtccctcgggtatggctttgagatttggttggctgtgatcggtcattcaaggaccccagctttgatgttctctttttgattgagccctactctagggagaatttggctgcatgttttggtgaatcatagatggtggggatgagaatagactgagtggttgagcattgtcttatgctgtgttgtttgcaatgcagcttgatatactttagctcaattcatccttacaagtctagagatgttttttgttctgcttgacaaatagggagcctgacaaatagggtggtcttgtcttacagagccgcagcttgcactgaggtcttccgactccatgtgccctgtgtgtcttgctgctgcctgggacccacagagtctctgagggtccggagccacattaagggtcatgctgcccatgacctgttggtgaccactttccttaggtatcaagaacatgagtgttggtcaataacccactggagcgtagtgctggcttctgttgttcccagctttaaaatagggctaggtttgacctccagctcagattcagaaggccaagtctgagcttgagtatgtgtggatggctgccacttagtcccagttttgtaagtgtgccaatatcgggacttttcctgtgctgaatatagactcctcctttgctgaaaatagtatatgcggtagggtagggaaacatttttctttcctagaaaatcgctccttgctcctctaggtaacattgacttctgtgaaaccatctgtttcttccaatataatttccagactattagattaaacagtttctcctgacccacttttggcttctgtttcttttcactgttcattaataaattgtgtagcagagtttttatggagagtgtgtgtgtgtctatttatttaatttcagtttaggcaaaagcaattgttggatgcagtgaagttatttaacttcctacttgtgtttcatttttgtttccggtttctataattgctaagagttggtttttgtttttgagattcatgcaaggaagtcaatggcatgagttatgagttgaggttctggctgggaggtgtgttaaaaacagaccatgtttttaaacagaagatgcaaagagtaataaggaaatcggttcccataaaacatgtctcaaagtagataaatatgctcttacagtttgaagagattttcaaaagataaatgagataatatgtgtgacgtagctttaagtttttctgagcaaagctgttatattcatctttggtattgttgcttttgatgttgcgaccaagtctgctattagcgttagtgttattgttaaatattcactaatgggagtaataagattagatttaaaaggaaggaaggcattctttacattcctttgcattcctttctgaatgtaaaaactcttcatgctgttttcccagctactctaaatccagaccaagaagcaacactactcagtcttgtatgaaaatgggctcaggtgtgtgtgtgtgtgtgtgtgtgtgtgtgtgtctgtgtgtgtgtgtgcatgtgcatatgtgtgtaacccaagcagtaaatttcagcaactaagcctgccttcagtaaaatgaaattccttgctgatgactgttatctgtcaaagcaaaaccaaattatttttctgcagggattcataaaagcagccttgaggtagtggtaataattgttatctaatttggttaaagcggaacagaaaacaagttaatattctatgcaccctactaattattattagcaatattgcgttaaagaattttaagctttctctaatttcactgggtccactgtcattttatagtttgaccatatttcaccaatgcttcagaagacaggagtcctgttgaattttatctacgaaatattttcaaaagcaaatctggtgtgaaaaggtaggtgattctggcctcaagttgcatgccactgtcattaagtctagaaggtcatttcctcagttctgtgtttcaggcatactcttctttgtttacaggtcagggctcctgataagtaaaaattacatgggcaaggagtacctgctacacttagcagccactgagatgtttttctattctgttgcataaacatactttgcaggtacatacacatgatttatcaggaggagtacacattagtttgacagcctcattgggccctcttaaaagagggaagggattatttcacttgggcatccctagtgtaagctcagaattagtttgtaagcatgagtacaacatggcactataaggaatgcatgttgctttgacacaagataggtataataatatattcccaagggagctggcaagcttgtgggtggacttttctttttggagaaagcagtcttgtctggcaaagttacttaacaaaattgatccattcaatatttattgattatctactctttttcaggctctgtattgagcatgcaatggtgaacaagatagtaaggtctctcaatgtaggaaacagcgtctgaaacatcccaccaaattctggagtttttaatgtcctagtctggtgtctgttctcctatatctggaaaccaggccagcttgggtatagccctaatagagtctgtgtgttatcttggagaagcatctgccatgatttaccattatttgcctttggcctgctgcaccttgcatggctagagacttgtctgctgtttggtaggtgcagggggccctggaaatcctaaaccaaatctaatctttggacccaccaaccaaactgcagcttggaaaaggtacctcaatcaaacgagcttcctgggggtgagtggactcatcagggctgctgatgccaacaggctgaacttttaaggccttaatagatgcatcaaagatgccctgagcatgggctcaccggtcttcagtccatcatggcttgcttggtgagaaatggtcgagatgaagtgtgtgaaagaaaagttactgatgctgtttctaatagcccaggctggaataatgctgtaaaggtgtgcaaggaatggggagaaggatgttgaggtttttctggattgccttccatatccctcagactggtgatccaactgtttcttttcttaccactgtttcttgccaatctagagactgtaaatgaaaacaaaaacttactctcatgtctataagtagtttcttattgtggacttcatttaatgaattagcctaaaacaactaaaaaccaagaaaatatcttttttcttaataccatttactttcttggatataaagtgtgaattcagaagtggcttaaggcaagtgatggggatcagtgtccctgaggggtgaaccagccaaggttttgttctcctacctgcaaggaatgttagagtactatacagtgcttgggtttgggagccaagttacctaatgaaaaagcaactttaactcaactttcctgctcattagtgttatgatatcaagtagcatggtggacatctgccaagatggcccccagtgacccctgcctactggtatccacggccttgtgtacctagtgaattgcttctagtgaacaggatacagcaaaagtgatgggttatcacttccgagattaggttacaaaaagattgtagcttccatcttgcactctcccgctctctcttgattactcccctgaaggaaactggttgccgtgttgtgagctgacctgtggagagacccatgtggcaaggaactgagggaggcttcctgtgaacaggcagtgaggaattggggccctaagcccaatagccctggggaaagtgaatctgaatcttgctcaacaactgtgtgcatgagcttggaagtggatcttcccccagtggagccttgagatgacttcagccctggccaatgtcctcaggcaacctcatgaaagattttgagccagaggcacccagataagctgcacctggattcctgactcacagaaactgtgagaaaataaatgttgttttaagccactgttttgtggtaatttgttatatattaataatgcaggcagtttatgttaaaaagtcttgcttctatatgagagacaacatcatggagttgttgggagcacagactcttgaaccaacctggtttcaaattctggctctgctgcttattagctgtgtgagcttgagaaagtcacttcacttctctgtgcctcagtttccttattgggagatgggaaatgtagcttttggcccccgggctctatatttcaggaagattagctagaaagaggtggaaatgggttttaattgacacagcccacagtctgtgtcacagtgagtataacaaaggggtcacattaatagtttttgtgacactctcaagtcacttaaactcccccaggaagctcctgtttggttggggacaattttccagaggaaggggcagctgtgagtgcttagcagccaccacacagcacctgggagatgggagcgatggtcctttaaagaccatcaacaagagtggtccctacgatgttcttctgctaatctagaagcaaatgatcactgtgttgatttttccatttttgtcatttctttgatactgtggagacacatgcttagcatgtttttctaatttcatgccatgggcctgttgagcagagctcatcacttctcagattaaattatatgtttaagaaatgccttctgcgtcaaccagttattcatcagcctggttgtaagtggctaagcctggctttcagctgtgaaagtcaagatttgtgacatttaaacatattgatgagatgcaaatgtcctgtggttagccttccacaaggccctagcactcatgtaaataaatgagaaggaattggaagtgtgggcagcagagccctcccttgaataggaaaattgttttttcctgggtgccagcatctggtcgctgccgtcagtggtaatgaggtttggctcttcccatatgtccctgattcattgcaggttgtttatttgtagatacaacttggttgtttttctcctttttcttttctttttttaaactaggtttccctaattcagcaccaccacagcctctctaaaaataagcatcaaattatttgtctagggaaacatttttttaaatgatactagctctcctcaacttgtgaaagtttcttgtgtcttcttgctgttttcactttatctgctctctagcagaaaaataaaattgcattcaattgacacactttcctgctgggaattcaagacatattacagccctatctgtgtgttctcagttgtgatgaaactgtggaaaatccccagcaaccttaaatgagataggtgcaggtgattaatccagtttcaggaaaaaaaccaaataatttactcctttttccccattaaagaaacaaccatgcattgaggtagctgatgccatgtgagcaggagtgtgctttaatggaggcaccattaataatttaccttaatagtgtaatagttgccatttttgtgaccaaaaatttgtttcagcccctgctttatggatgaaaagtaggatcaattaatattgagtgatgacagcctccctgtggagagaaaatgggaaatcttggtgtcgtcatccgccttatgactaagaaatagcttttcttaattgtacggaacagagaaacccagggggatgtaattcatttctctccaggcttgcaatgtaaattgaaagtaaagaaaaataaccacatgccagagtgaggacatgaactcaaccactaagctatatctgatttgtaggatttgctgaaagtaaacaaacagtttcccccacgatggtgagtctccttcgactgtggcattgctccaaatacctcttatagcacatgacccagggtgtttctctctgatggggtaatggagcccctctgcctagaagccttgggtcccaggtcttctcccagttcattcactcttccctcccatccttatagtctctgcctaaatgctagcttttcagagaggccttcttttaccaccttgccccaaacagcctctttccttgcccaactcactgtcaacctctgtttctatcttattttctttgtggaacttacgatcatctgaaatcatattattgtttatgtggtatttaccatgtcctccaaccataatggtaagctccatgagggcatggtttgtccttgttctctaagcagctaaatccttagggcctcagtgctgaggatgcttgttgaatgactgaatgagtgaatgattaatatgaaaatgcaataattcagaataatttaaaactcttgcacatgcacaccagctttctgtaaaggtatattgactttaaggttcccctctgccttctccatcttgagcccctactggcagaacccaatagaaattcaactggcaaagcgaggatgcagtttgcacagtcctcgccccaccacacaggtcagacttggatcagaaagatggcaactaaatgaccagcacagtccaacccttcagattctcagcattcacatatcctcctgcacattttcaacttggcacaacagcaggacagctttgtttctgcctatgatgtgtctatgcttcatgcagtattcacactcttaagggaagacaaaaagtcccagttggcatggtgtctgtctctgggtggcataaattattttcctggttcagtctgtaggatatagaatatttatctgggattggtggaatgagaggaggaattaacattgcttcaatatggaaaccgtgactgctgggacttggcttttgccctcagccagcaccttctgtggcagaggtttatttattacccggtggaataacctagggatctcaatcctcagtgattctctctgtgtgtctgttagttgctttagttttccattgatttttactcttggacatggaagtaccaagaggcactctagagactctccaggtgccaggcatactcttctctgcccctgttgtatggcagcaatggcaccagtccagtttccctgtggaaattgggatcattcacctcacccagtagggtaattgccttctttgccttttgtttctgtggcattggtagtctaaaatagccaaggggcaatctcaacttctagttcagtaaaaccattgcagtgtctcctggaggaagcattcctctcttgggaaccagcagctccaaatctgcagattcaaaaattgtggggctggtaagcaaaactctaaacatactaggtgtcttggtctgtttgtattgccataaaagaatacttgaaactgggcaatttataaagaaaaaaagtttatttggattatgattccaccagctgtacaagaagcatggcgtcagcatctgcttctggtgagggcttccaggagcttccaaacattgtgcaagtggaaggggagctggtgtgtcacatggtgagagaggaagcaagagacgaggaggtgccatgctcttttaaacaaccagttctcacgtgaactcactcattacctcgaaggaggacagcaagcctttcgtgagggatccgcccctatgacccaaacacctcccactaggccccacctccaacgtgggagatcaaatatcaatatgagatttggaggggacaaatatccaaaccatatcactaggtttaagaggagaggagccatttttgcttctaccccttgatggctagtcctgtgtattctggctggggaagaaatagaactgatgcagcttgtattctttgtcccgaaagagtccaacttgtcaagatgtcatctcccaactggctccatggggaatgttgggctaacaaatggtgctttttaaaacaaagtacagaatttttgcaaatacagtagtggctaaggttcttttgactttaacactgcattgcatggtgaatcagtggtttaaaaattgcattggaggggagcctattttttttttcttcacctctccttgagtgctttaaagtggccatcagatgcccatagatgtccagtctgctgttcccagcatcactcatcaccagagaatcggctggcttcctgggggtgtactggtatctttctcatggtcagcctttgtttatcttgggggaggagggcaaatagcagcagcattcactaattaatcagcagctgtgtagcagtccatcaccctgcatgtcagggaatagtgctggcagagtgattaaaagcatgggctgtagtgtggcacagctctgggctgaggcctgcagatttgctgggagacccatctctctcatttgctctgtgacctcggatgagttacttaggccctgtgagtctgagtttcttatctgtaaaatgcagtatatttcctggcgttgttagaattgaataaagtcatcagaaaaggcattggttagacccctagataattctcagtaaatgatagctatttttataccaaatgcaaagaagagtcaaatgtaagtgcaagatttcctccccaagacaggaatgatgtaaagaattcctttgaaccttcattccttcatctgcaaaatgagggcgtttgtcctaatcaatccctctccaagggctgttgttcaccatattgggtgggcaactgcacgatagaacagtgtggaatgtggcacagcccaggtcaccaggaccacaggcattggtcagagaagtcagtgttcacaagggcgagggcagcccggagaggtaggtttcgtgcttctaggacagggaaggatagggagaagtgggaggactttgagggactctccgtctctgagggagtagccagcagggtggaagaaagtaaaaatgccttgtactaatagaatgctttcaagaataccgagtatttggccaggtgcagtggctcacaactgtaatcttagcactttgggaggccaaggcgggtggattgcctgagctcaggagttccagaccagcctgggcaacacggtgaaactccgtttctactaaaaaaaaatacaaaaaaattagccaggcagggcggtgcatgcctgtagtcccagctccttgggaggctgaggcaggagaattgcttgaacccaggaggcagagattgcagtgagccgagatcacaccactgcactccagccttggcgacagagccagactctatctcaggaaaaaaaaaaaaagaaaaaagaaagaaaacagagtatttttgtggaccttatttaatcatctgacaggaaggtacttcaagtcttactggatttttcaataggtgtgataagatgatcaatatgtggacatttggcaccccacagcacacccagtcacctggtatcatggagtctggcccagtattggggtggaggtggtatactgtggtcaacagtgttgacctaattgtgctgaaggaatagacaggcaattgcagactgaaagtactgtttgtgtatgtgtgtacgtgtgtgtacaccatggttgtccaaagtcacttcctcagaaaatctaaatgggaaatgagtgttatcgatgagttcatttatagccaacagatttcctagtatcatttagaagggagatgaacttttggggtcgccctacctgtctgactctgtgcagatgaggaaactgaggccattgttggagaaagaaatctcccagggccagtcaacctggtagtgccagcccctggaagaatccagagttcttggtgactcaccatggctccacactggccccttgcctcagctttcggtcgtgtaacattgtgttaattgcttcagcttcaggcgtcactcctgtgtaatgaagagaccagaatgtcagcctgtgaagatcatcatgtgttgggacaaagccctcctccatttcgaacaggaagtcacgttctcctggagtgggaaacataactgagaatcgtttctgccttgccaagattccgcatattaatcaggccggttgttccttgtaattctagaatgttctggctgagttctcatcaatgcctcctggtccagtcctcccaccatacacctgtcagaagttcctgcacccctttgggctcctccaggttttctgtcctcttcctggcttggttgtttggggtcttattctgaaaactttttaaggttctaatttcttctcacaaaacgagaactgggctagaggctcttggcttaggtttggatctgcctatttggatgatctctgtttcttctttgcagttagtgtttaatacttgtagtttatttctcaagcccttcactcggtcacagggagcaagagggctatgcagagaagaacactttgcctttctcagtggctttccatcccaacacctgtttgtttgtttttttttttaaagacaaagtcccaagtttcacaaacaggtataacaatcctcacattattcaggcaaagaaatgtgacttttcctctttaactcctcaagccttttttttttttaacagcttaacttctttaatgctgtgtcagctgttagggaaatgggaaggaagagaaaagaaaaatggtgaatgcaaagaaccatattcaggaggtgcttggtctctgcttacaaaggctgcagcgagacccccccatatgaagatgctatcgaggattatgtgtgagtgaattctgaggcttggtgtgggcgctggtgaaagtgattggaaatagaaaaacactcatgtaaaattttcagggtcaccttttaaaaaggagagtgtccttctaaaccacatcttaagacttttcaaattcaaaggaataaaaaatagtttaaaaataaaatattctgatttctaaaattcataattttttgatcaaacttgtgccatgacagagctataatttgtgtttttatgtgtgtgttttagaatgcttaaggaacttgggataaccaatttatagtgcatgtgtgtctatttaaaaacttgtgtgaagaagagttttaaaaatggaaaaatagatccaggttctactccctgttctgtaattggccagctggacaatgctgggcaagtttccttctctccctgacctcctttacagtggctgctatttattaagcactcgactgtgcaccaagttgctatgcaggcctgtatgtgaattatggcaacaatcctgagaggcagggaccattaatattgatattttccaataggaaactgatgtccagagaggctaagtaactcaccttggaagaaagcttctctgtcatgaggctaagatttgagcccaggttgtctaacttcagaaccaatgatggtaaccactatgcatactgtctcctcccactgcataaagtagactgtgacatgtggcccattttgcgttttaaaatgatttgtggcgtaataggcattataggccttgatttatagtcacacatttttgtctttgtgatttatttaacaatagggttttgatcaatccttgagtgtaacttattcctagaagaaagatgcatattaaaatggtttgctttattctgtggtttttgggaacagatataaaaagtggagaccacttctatttttattttttagaggtagtgtatgtgaaactttccaaagcactttttgcttgcatattttacctttaacaactctgtgaggtaggttggacagatattgaatttagttataatagttatctggaaattcttgtttgttaattctagcaccctgtgtaacttgggattggtcttcattgattgccatttttctttaaaatgggtaacattttttatgacatttttgtggtaattttgaattgtatcctggacattgtgactgtgatggtgtggagactctggattctgttatattcttctgatgactgttgattttgtttgtttgctttagcaaacaagcagttggactccagctgccaactctgtctcttgggtggcagctgaaatttgttcttttagccttagctgggttgcttagggagtacctcgtgcatgcatggttcaggagtctgccagagatctgggcagagtttatacacagaatctggggctcttttctctggctctctcctttctggggttttctcttcatattctaccagctgaagtagccctgtgttctgtcttctgtttcttcaagccagtaaactgtgggtttctgtccgagttttagctgctcctgtggtaccaaccagggcctgcccttgggctaaaagccatcagagacaaaacctcgcccagtgcagtacttttcttgcaagtgttgatgccctccagtatctgcctgccttggcttcctctccagtgccctcagaaagttgctttgttttgttttgttttgtttttatgtctgtatgtgtgtgtgtgtgtgtgtgcgtgtgtgcagagtttatagttgttatctgcaggagacttgatctataggagcatcctcagtcataccagaagtggagcaggaaggacaaatatccccattttaaagatagacaaatgaaggcccagagaaatcccatctctggtgtcagaacacaagtttctgggtctgtagcctggacccccctctctttctgacagatctaggttcaattttcacttctgctccttgctaaccccatgaccttgagcaagtcacttaaccctttctgagcacacagctcctctgggttattgtcagggtgaaatgagataacatatctggagcggctggggcagaataaaccttcaggaaatgtccctgtgtcaacagaaagggtccttggggatgtacttgctgtgattgtttgtcctatcttcccctggggttgactttggctttgtgtccagtcagtgctgttgtgcaaggagggaaaaagaagtagcttcatgttcaaggtgagcaagcatcctctgggcccaaggccgtcctctgtggaagtcctggaggggcctcaggccagcatgtctgcccccaagctcctggtcctctctcttccccccttccctctgtggagcacgccctaccatgctccccagtgcggcatcctggagtcccactttgcgtctccagttccttcccgcctgcaccaggcatctgtggaaggtcgtgcacctgcctttgcactgtctcttggtgtcagcttgtcttctccattcctctaaccagtggcccagatttgtccagcctggataagcataacagcctcataactggctgctgatggcaactcttgctattgtaaagtgcttaataataatgatgatgatgataatgatactattgggaagtatgtaataacaacaaccgactcacatagcacctaatatataccagtcacgcttcgaagtccttcacatatattaattcttttaatccccacaacactcagtgaagtatatactatgattatgcacattttacagatgagaaaactgctagggagttgcgcagctaggatttgaaccttagtgcctagctccggaagctatgcccttgacttcttcaatagacagctagatatttttcacatgtaacctgtgggataaggacactgttattcttgtacttatttggacgtgggataggcgggaactcaaggattgttagtggcctgtggccaaaggaaactccaccttagtggccagtgtcagatgcgattcaggcaggctgagtgatggggggaatggattggccttttggcagtgaagaaatggctgcatgcctgccctaatgggccagccacaggaaggggaagcatacgtacccttttctggctgtgtctaattatgtggcattttttttgtctcagttataaagatttaattgctccattgtactggggcaccagggcctcttataagtcatcttttatgattggtgataattggctcagcttgaattggctacagctagttgcaatttccttaccatttttaatctgagatctgattttagccttatcttttttctgagtaaagttttttttttttttttttttactcaaacgctgggttgtacgtgaggaaatgcgtcagcctctccccgctactccatcactctatttgggctgatttatgcattaagcatctaatctaaagatagcaaagatatgaaaaggcatcttaaagtgttttaatggcttggaagagaaaatcccaccaaagggagaaacgtgcccttcactctgtcagtgttgttaggatctgatgcctgatcccagggtggggacatttttgacagtcatggggtataggcagacagcatctaagggagccctacttatctaccggaaactcgagacagaatgcaggtacttcaaaaacgaacgacagtgagggtttgggaactcctacagataagtttccaaatgaaaaagataagaagcctgtcagctgaaagggaatgaggaatgagccacataaattaagccgacggaatttctagagagtgaagtgtgctgaggcatcaccagccgtgggatataaatatagctcaccctgttatcattctggggtctgcagtctccatattgatgtttctatgttttgagtaagcacttcctgaatgttccagtctttgagtctggcagacttgatttatgaagaaaagatgatgataatgaatgggaaaggcttgctgaggaattaatttgggggtagtagtaagagcgagcctgcttctctcaccctctttccccaaagtgtactcttaggtgggtgctgccaaaatgcacgagtggggtgagggatgaagctcttttagacttccttcctctggggtctgctccctgctctgtctgccagagatatttgctgtgaaaggctttcacccatttctgtcttctttccttcctttctttattcctttcttcaactgaactttgtttccattcacttgcatgcccctgaagcttttgatgtgcatgaactgccgttggctttttgcatctctggtttcccttccatggcgcacggtcatcacctcttttggccactcctctttgagggcttttctctgcttccccttaaccctgggcattccccgggctcaggccctgcccactctcttacagaaggctccttccggggtcagcatgtgcttggcatgtttgaggatcacgaatgagtcaagtgtctggatccagtagagatgaggatgagtggcgggcagcggaggcagccggggccatgtcctgtgtgtagggcctgtgtggaatgttgtggatggcactggagcagtctgagaaggagggggctgcatctggatggctgagtttgtgagccaaggggcctctgcataagtgaggtgttattgaccttgggatctttcttcctcaaaattgaaagaccaaggcactgtggtttattctcctgccttccctcatttccaatgccatcatatccacttgattattctttccagcatctctctatgcatccgtctgtttcattcctcccactggttcccaggctcaggcctttagctcaggagtggactacgatcatgatttccttctacccaaaaccctcacccccctttttgttttgtgtatctctcacacatcattagactaaacgctgctggtaacacatttttctccacactgacaagataagaattgaccttaggcctgccagtctctttctcccacatctggcctttgcatccatccccctactaaccatctcctcttcaatcagagtgaccttcctttttatcctccctccctttgtctgtagcgtaattactgtgtcttgacttgtattagatactcactgtctagaaagatggactgccttccatgttttcagctatgagaagcgtatgtgtgtctgtgtatgtgtgtctcagtgtgtgtgtctctgtgtacatgagtgtctatacctacctcagtatagttcttgctttgagaagctggcagtcttgtttggcagacaggaggtatgattttgaaattcgcaggtaacaggttggaagaaacttctgcctgtaaagaaggttggtttctgaggatggttggtgttttactttttccttaaattaggaaggagcctgagttcaggcccagaaggaaaggggtgtaatggctgcttctctgaaacggccttaagtgttcatcaaagaacagaaggaatcctctgcatctttttctgagcttcatgaaccaccagttgaggaatttggagtatatgatgttggaggtcacttcatacttcgtaatttggtaatttttgcaatatttttactatcataggtaaataacaacagagatttcatagatattacatctttaaaagtaaagtaaaacactgatttctttttttcccacgtaaatccctgaataggaatgcagtcctcatgtgtacctgttcctttgcaagctgggatgagaggacgatgcaagttaaaagtgttctttgttgcaagagcaggacgtgctaggcagacagtggctgaaaacggaatgtgatgagagatgcaagattgtggtgcatggtgtatcctgcattcaagcgcttggaccccaaaattgagcactggggagccacagaagaattcagagcatgagagtgatgtggagtgatgggcatttaaatggctcattcaaagaaatgtgagctaagttctgcttctgcctttctgcctctggagaaatctaagcgctgagagaaacaactatggaatcttgtcagggaggcccgagagctttttgtttctcaacttttagaggagtttgtgtttcttttttaagggcatgactcccttacttttatgaattagtctttctctaccttacatcttgcttttcccgctcaagtcctccctgggaaaatggagctccagggttggcaagatgtggacatcccctgctcagccttctgcacaaggtatagtgaaaagaaaaagattagctgtccccagcaggtctttttggtgggtgtgataattttggtgatcttataattctgaaatttttagcatccgtaattgacatgggggctaaattgcaccactcatcagattgtacaaactattaaaaagaagcaaattaccatgtatttgtataaagcagaagaggggaaagcaagtggcctttcttttaaattattgttaagtttcgaactgtattggattttggatttttaaaaattattttgtttaatcaggcatggggtgtgtgtgtgtgtgtgtgtgtgtgtgtgtgtgtgtccctctgagctgccaacctctgttggggatatttttttcctgtgctcagagaattgccttgatgaaagcgttcagcaatcaaatggataaaaattgaacacattcttcaggatacttctcatttttcttccttatatgttcattttctgaacaacaacaacaaaaacctctatgaaatactaaggctttttttttttttaccttgaagtggcatccttgaatagttgccttccattatttgttttagcagatttccaaggtgactgccaaaattccccaaatattccaaaaatagaaagacccttaattgtgttcgctgagacacctcccttttccttactgggactgtctgcttcagactcattcccctctgtctctctccttgttgtgttaatcttaaaaaatgattgtaataaatcattgtgatgggaagcaaattagaagagtggggagatggctggaataagaatcagggaaccgcacatgcaatcttctctccaaagttaacttgcgagtcactgaatgtgtctgagcttcagtttccttcaaatgaagcaggggctggcaaactttctgtaaagggaaagatggtaaatattttgggctttgtgggtgatgtggtctctgttacaactacttaaatctgcaacagcttttgtagtgccaaagcagccatagacaatatgcacattttattggaatatgcacatggctgtattccaataaaactttatttacaaaaccaggcagtgggctggacttggcctgtgggccatagtttgcccaacactggcaaactgtgctctaaaatatcagagtaaaaaatactgccttcttcttattattagtttatatgggggggaactaattatgacaatgaaaacactttgaaaaatataaaggagaaatttctgtttctggctaggattgggtagtttgaggcaaactaatgatcccaagaagaacaacaaaaactatataaaatacagaaagcaacattctgtttaaatctgggaagtgttgaaacaatgaggagtagggggctaaaatatcaagaagaagagaactgtggagaggtgagctgacgatctgtagctactttatttttgggagatttctaattctgagtgctgacaaaataatggggacctgggctttgcttggacggaatgttgctgctctgggaaaaataaacctgcagagcgtttgtgttctcttgggactggagtggagagacaaaattggagcttgaggagccagaaatgcacagttggctttcccttcaagacagttgctaaattctggactgcatgggacgagaggttcgaaagataagcagaatccctccggaaagcagaaggggtgttgagtaatcttctggtgctgagacaataaggatttacagttcagtacctgcttttggaggttgggaggggtgggggcatggtgaacacaccaggctctcagtgaagtccaggagggctaagtcctagcaaagggtgtaagccaggagcaacctgagtcttgtaatagttcctgattggtttaggtcatcagcccgcacccccatccccaactctattttcctgacagaagaaaggagagccatctcttgaggaagataacttcatcagaaatcttttcaactttctaatacatgatgtctggtattcaatcaaaaattattaggtgtgtcaatgtgaccattccccaaaaatgagagaaaaacaaatgatagaaacagattcacagatgatccagagtgaatagaattatatttagcaaaaaaggaatttaaaaataactaattaatatgttcaagaaaataaatttttaatggataaaatagatgaaaatatgaaaaatttaaacaaagaattggaatctataaagaataaaatgggatttctattacttgaaaaagatatctgcaattaagaactcaatggatagggttttaacagagagatcatatgtagcagaagacaagaatagtgatctggaagaaaggttaatagaaacgatttaagctgaaatgcaaagagggaaaaatggaacatatagaaaaaagcataagagacaagtggggcacagtgaaaagtctaagatatgtataactggagtctcagaaggagcagagagggagggaatgagacagaagcagtgtttgagggagggaatgagacagaagcagtgtttgaggctaagaatttccccagatttgtaagagagatcaacccatagattcaagaagttgtacaaactccaagcataataaataaaaagaaaaagcatagagtactgactggataaacatgttatttagaaacaaacaacacactggcattgtagatttctgtctctagtgggtgagaaccattacaggatcaggctctagcctcatgcttcctgtgtttccttccccgaacccttgtgtatccttcaaccaaacctctttgctcattgtctcttgcattcttccgcttctttacttttgttaagctcaattcataacaccagcccttggtgtttccgttttttaggcacctttatctttggctttatcattgtcactgttaacatctgcaagttgtagtttaaaggtcaaacgagacctgcacccattgaggtagtgtattagtttcctggggctgctgtctatgacaaattaccacacatgtggtggtttaaagcaatagatacgtagtctcttggagctctggaggccagaagtctgaaatcaatgtgtcaacagagtcgtaccccttcttgaaggaaaatctattccttgcttcttccagcatctggcagctgtctgcattcattggctcgtagctgcagctctctgctctgtcttcatattgccttcttctccatgtacctatgtcctctcctgtgtgtctgcctcaaaactctctgtgcctgtctgttataaggacccatgtgactgcatttagggaccacttgtataaaacaggataaacacctctttccaaggtccttaacttaatcacatcctttgttatataaggttactattcacaggttctagggattaggacatggacacatcctttgggggaacctattaaaggtggtgctgctataagaataataatagtacgggcttaacaatagtagttatgtgccaagaagcatgctaagtgcattatgtggattgtctcatttaatccttgttctgactctataaatcaggttcccttattaccaccattgtacagaagaggactcaggcttggcaaggtttaggaacttgccaaggccattcagctagtaagtggcagagccaggatttgaacccacgcatttgggcttcagacctccttgccttacgtgctatgagtgagcaggctgaatttctggttggactgcttccaggagctggcttttagactgtgggccctggatggtacttcctagctctaaaattctatggtccagtgagtttttgtcagaaaagaaaacctcaacctggattattaagagtataacaaattttaatctgccagataatggagaggatttgcttacactgcttatagatgaaactgacaggagtttgctgttgtgcattttgatatttgctgatggtttaaggtgtgtgtactggaaggaaaaattacttgtggacacacaggccaaatctataccatctgaatgaattgaagtaattactcaggttatttagaccctgcctgccagataattgaggtaaatggggttattaatttgaagtagctaggtaatttggtctgcctccctttgataatgtaaacatggtcatatcgtgtaattgtataattggctgaaagggccctattctttctcttgaagcatctgctattgtctgtggccaggcctttgggttatagtgtgatagtgtgttcaattagtacagaaaaaccctaggtatttagtgtgggtttcctggtggaaaattcatacatttatgtgtatgtatttatgtacgtgtatgtgtatatatttttaattaaaaatggaaatataaaaagtattttaaaatggataattattcctgattattcacggaagagttttaaagaaatatatatatgcttcccagttaaaccaccttagagtctatttgaggagatcagctcctttgtgagagttgtttttttttattgagccccactgtaatgtctatatttgaattgcctaagaaactcattatagcagagcttattccttgtcaaagatggtcaaaagaaaattagattcagttcattagcttctacctaaaccttgcttaatggggcccatgttgtggttttgttattggatcacaaacatttaacttgatccttcctattcctggcactggcccatattgtcatggcagctgtgctgcccgagggcctctgtggcgtggcctcctcatctcactctccaaaatggctgagccgtgggttctgagacttcattttacattgggaccaaacctgctttgtctgtcatttgttgaagaagtctggccagcctcgagtaggggctgccttatgaagggtaagaaattctggggtgggtaggtgggagagagtgggccacttcacagctgtggtggccacatgtctcagattttctggaaccatctagctctaaaatattctctatggttttagaccttaaatcctgaattttggcatggaaaatgaggctcaagtgacgtctgctcacgtgtctcttgcgttagttatctgtataacaggcctcttacatgatatttctaccctcaccaaaaaaggagaaaatgagaagaagatttaggttaaaaaaatatatattccccacccagcctctgcttgaaatgtgaggttttggttttggacagcggcgttggttgttgacgtcattgatccaactattttatttcccacttcactttgcttgcccaggtgtggtccaaggagtatgagggctgttaagataaaaccaggctccggaaattcaaatgaaatgtctacctgaacctcctcaagtctttcctgtgggctgtgtatttatttataagcctattgggctttggcagcagaaaaaaagaagaaaggaggaatttgtttctaaaatgaaaaccaaatttagttaatataaatgctacccatgtgcaactcatcctgccagatcccagtaaatgtacaaatatcaaaataacacaatagataaaaatcacggtggaaaaagagaaattgagacacttctgtgttttgcagggccagaataatctacacagtttactccttccaccatgcatattttacatactacattattatctgattttatataatattcacattgtaatttctgaatcaactctaaaattcataaaaatttagaataaagctatgcccactcaaagcattgaaataagtcaatcatatggaaaattcatgttctcaaaaatgtcttggcttcagttatctgagaagaaaaaaatcacatttaattttcttagttttccagtttagtttgcaaatgtcaaataactaaaagttataggaaccaaaaaatgataaacttctctcaaaacttattgtatataaatcttattttttttctagcatttaaataaacaacaatggccaataattctataatatgttcctttttcaacttttttctataacatgatgatattgactagatataagtgatggcttatttaagcaagtgaattctgcacatggactagaatttttaagaaaaattttaagaaaattttgaatgtagagttgagttttatttgtaattttcatttatttacttattattattattattttagaaacacagggtctcactctgtcacccaggctgagtgcagtggcacgatcacagctcactgtagccttgaactcctgagcttaagcagtgccccaccttagtctccaagtagctgggataaaggcacacgctgctattcctggctcatttttaaatttttaaagtagagactcccgcttcagcctcccaaagtgctaggatttgtaattttcaatcttttgagatatgagaaaatgaaaaatagttttctactagggcacataactcttcatgtaagagtttaggtgtctgttacacattgtggatattacttagtcctttctggttctgttaaaactaatttccttcagaaaacacagtagtggccaggcacagtggctcatacctgtaattccagcactttgggaggctaaggcgagtggattgcttgagcccaggggttcaagactagcctgagcaacagcgaaacctcatctctacaaaaaatacaaaaaattagctgggcatggtgcacacctgtggtcccagctactcgggaggctgaggtgggagaatcacctgagtctgggaggtcgaggctgcagtgacctgtgatggcatcactgctctccaacctggtgacagagtgagacgctgtctcaaggaaaagaaaagaaaggaaaacccagtagccctgggttgtaacttttagggaattcgtgaagctaagcaccatgttttcagatgactcccctgatttttgtacttctaatctgctagaaaaacagatggacagattcattataaatgtgtatttaaaaagaacagctatatggcctgaaggactgcccaaagggaactgaagtttatggaaagcattatggttttgagaattatttggcttcttgctgttttgtggatctgagtttttagttgctggaatttgacatctaaataagaggctgtttgctatgatatgtaaatagagtgtgtgggtcgaaatgcttgtcattatgcatgttgaaaggacaatttacgatttacaaagatggaaaagctcaataaagatccactattgaaaagctactgcaaaaggaaagctatagatagatgggcttcttgcagatgaacagaattaatgacaagtgaaaggaaaaattcacatcatgaggagggaaaatgtcttccaaatgtcagtgagagaaacacttttccttttcctttctgctgtatcctgggcatagcaccccactacctgaaactccagcaccccgagcatacctggacctgaataatacagcagaacatgctgcagcaatctatttccatgcttgcccctgctggctttgtacacctctattgtctaatcatctcatcttgtttccttttatcttcctggtacctaacacaagcatggcacatagtaggtgctcaaagaatgtctgtcttagtctattttgtgttgttgaaacgaaatacccaagactgggtagtttataaagaacaaagatttttttttgctcacagttctggaggctgggaagtccaagatcaacttgctggcaggtttggtgtctggtgagggctgatctccacttccaagatagtgacttgtttttgcatcctccagaggggtggaatgctgtgtcctcacatggtggaaggcagaaggcaaaaaggaccaaactctgtctgtgaaacccttttataatgatattaatccactcataagggctgagccctcatgacctaagcacctctcaaaaggactcacctcccttcactgctgcgttgaggattaagtttccaacacataaatttgggggagacacattcagaccacagccatgtctatcgaattaagtcttaatggtaaaaagtctcctttgtctaatagttgtgtgtatacttattccctgctccactgtgaaattagtaatgtaatttttgtttcaggcagcacttgccactttcaatcagaggcaccgaaacaaaaaactaaaattttattacttaaaatttacagaactaaataagtggtatttgaggtaagtttgtaatgcttatatttctgaaatttcagcataaaactgtattgagacttttgggatgccttgtatatcgtaaaagaaggtataatgataaccggcatttattgagtactactatgttctagaaatgtaacccttcataggattcctatgaagatcctaccagttaaatattgttattcttcctttttatacttggaggaagattaagaactcatgcaaggtcacttggcaagaggccaagccaggatttgaacccaggaagtctaaatccagagcctgggctcttaaccactgagttaaactgcttcttaagaagacttgcctccctgcaatgtttactgaagggaatggatttacccagacaggcctggcctttggtagaaacgctgcacagctctgcgtagaagcagttagtcatctgtacttgcagaggctgtaaaacaaatgtggtgaactgtaaaagattaaagagcctgttttcctgccagctaccagaaagtttcacatatacttattaaagttcttatagcaatggcatctgtcatttaaaaaaaaaactttttattgacacataatacacagagtgtttgtttttatgacagaagtggttcttgaaagagttgacctctctataactctaacacatttctatgtcaaccagacatgactctaggtcagtggttctcagagtggtctggggacccctgggagttcttaaggtcccaactattttcaaaatgatactaagacctttgttcgccttttccactcttattctttgacaagcgtgcaatggagttttcctgtggctacacgacccatgatggtatcatcactaattaatatgtgcttggatattcttatttttaaaatgtcttagttttaaatgttctaacgtgaagaatatagatagatgtaacccacataaacaaaagttcttaggggggtcctcaagaatttttcaaagtgaaaagtggttctgtaatccttttctaagagtttggtcagcggagggtgtttattactttttaataataaacttattcctaacatacctgagtttacaatcaccttccaatgtgtaagaagttgaatgagatgaaattagaaagataaaccattcagaaagataaaccattctccttgagtttcctctcatcttttaggatgctcccagaggctggagtaccttattttctaaaaagaggggtatactttctaccacagatctccgaagatggggtctttattctaacttgctaggcattcttttgaaaagaacagccctggttactgtaattgttaataaggcagcctgtcgagtgccggaatccatttttctgtgtgattagaacccggctgcattcctccttcctgacatttcatccactctgcttcgaggtcttaagaattagctgttcttggattaagtgcccttaatcagctcattttacattacaatgtaaagtttcgctcatgttctgcagagaacttgattttcatttgctgtccttgatcacagaatagtaagtggattcccaggaaatttcatgaagtggaatgataatgcagagacgggggtgggggcggtgggagggaggtgtcgggggatgtgaaactaattgattagtttagaatcttctaatttccatgaggaatggaggagcccaatttgtatttcttcttggcatcatgttctcacagattgtctgatgtttcattatcatcttgacagaacagccgatgtagaattatgttgactaggatatccgttgagtttttgccatgtgcattaatagtccatgattagattattttgactctactagttggttatctgagagcttgaggagttaagaagagagtgtctctgagtcctgagttttcagtgccactgtcctttgaacacagcagacacctccacccccaacaccaatatactgggctttgaggaccataaatgactggtgttaatgtcctctcctaacaaaacttgtgggcagaatgctcccctatttagaattttcctaatccttacatacagctggcttgagtgttttcatctgtcaggactagtcctttgcctggtttcagtgttaatttgcatgcttgtcatcctagggttttgttttcctgcccccaacctgtttttggagtctcttcccagtggatttgaaaaatcctggctactagcgtgaggattttcacatacgcacacaaagtagaagtgaacagattgtggcttttgccaaataagcctctttggtattcctcaccccctgaaaataacatcatttctccacgtaatcgttatagaaaaacaccacagagcaaatgctcctcacaaacacacgccacctaaacaaactgggcaggtcatatgctgctgttgctgcagctgtttgctgatcccaacagggtccaactcttgtgagcaaggaggtgtttatggcgtggagacaaagcctggctgcagtgggagggttgctggccgccagccctcatttatcagcctgtttttccttacccttggaagacctgggatcttcatgggagacagcatggtggagaggaggaggctgggttttgctgtcttgtccttcccagtaactggttctgtatttgctctatcctttgtttttgttttttcaatcacgtagtcatttgctaaggatttattgaattctagttatggactaggcaaaaagctagttgtgaggagaagaaaatgaacaagacaaagtccctgccttccctgggagacacgccagaaaactgtgatggtgagtgctagatggtgccttgacacaaggagggaggccttggtgtataggttgaagaagtctcttctagaaagagttgtgaaggatgagtaggaattctctaagcagttagggaatgaggaggagaggagaaaggagagatttgtgtcttatgtatccatctacccaattcccccattcctgccaccatgcaggcattatgaattgattgggaactgtttcccagtgagctcacccttggcttcacagtctttctccagacgtggctccaggcagcctctcacacaatcgtcctcagacttgagtgagcaaacaagtcaatggccctggttattgaaatgcaggtctgatttagtagatctggggatagcctgggacctgcattcctaatgtaaacacactcttcccacccctagatgatcctgatgcaggtgtgctcaccagctgccactttgctgagaagtcagcacggcatggtctcactccatagatggactgtgaattgataagaccaatgtggggcaatttggcaattcctattaaattttgaccctgtaaagatatataagagtgggtttttagaaaatcatcattgtgatagaaactattaaaatctatggaaatgactctcattaggagagcagaaggtgactaaggagacctggttacagtggcagccttgtcatctagggaagctcagatctggtggagctcatactccttgtagaggtctggcatcatgtcctgttcacccctggctttgacttttgtcttctgccttccatttctgcactgtgggaaggaagtcctgggatatggagaaggtcaataacatgttatttgcattttgcattatttgcattatttgcattttgcttgccttaattatatcactctctctttataaatgtctttgaataacacttttaaaattaaaattggaaagttgaatttgctttaaatatttgcttcatttattttcttgtatcataccctgaaattaagcatgtctggtttatgcttgatatttgtaaccactgtgtaactattcttatttttctggttcttccattgtagactcccatagcagtaaatacgttacatacgttcatgctttatttttttccaattacaattataccactaaattcactgaggaaataaacattacatttttaaaaggctttgtttttcttcgctgtaatcaacctttcaaagaaaacctgagcccaagaagctgactattgatggaacttaaacaagtccttaagcaaggaacatcttggaggcacacaactgtgtagaagcaaggaggtgtcgtttgttggtttttaagagtcattttgttctgatcttgctacattcacttgctgcactactgtggtatagtagaaaaagcataggattgggatctgagggtgtcttctatagtcctggtactgctatgtctctttagccaattgtttaatccctctggacatcattttatgatctatagaatgagaacattagcttagttaattagggagaattcatagtgtagaggttaagagcataggctctgaatgcgtgggtttgaatgtcaggttcaacccttagtggctctgcaggcttgggaaatttactcaacttctctggtccagagttttctcatctttaaaatggagataataatagtacatagctgagagattgagaattaagcaaggatgcttgtaaagcatataaaacaatgtctggtggacaatatatgtccaatggaaggtagctatcattgttactgttgttcatattatttccataatacttctatcatcatcatcatcatcctcattctcatttttaagggctttttctgctgtaaaatacattgaaaccatttgctcaaaaaaggagattaaaaagcagcatttaaattctgaaacactaagtgcaaaagaacttgatagggaagaacggcttgtgatattgtcacataacagttgactgtcttcggcctgacttggttgcatttctccactcccagtgatctctaaatccagtggatgtcttccattcctcatcttactgaagggcctggcaacactgaccactccttcactgtcacagttgagaccataattggtcagtaaatcaaaaaggttggttggaacagggaattattttttaaaaggtatatattgtaaacattttattttagcttaaaacacaaaactgattgtgttttcacagtgaattcattgaaaacaaacgttcatctgcccatcattaggtgcagagctgtggtctttgacagtgtttctgctgactagctctgcgtcatcttttggcataaacccatgatacagtagctaagcatttcaatcaacattgtgaagatggagggagactttagatgtttacaaaggtatctgaatgtaaccccgcacattttaaaattacttttcccttcgccttctattatatccttaccttcatctaccttgacagctattattttttttttagttttctttagaatctttggcttcttatgaataactctcattcactgtttgtacagtagttcccccttatccttggtttcattttctgtggttttggttacctatagtcaaccgtgtttccaaaatatgaaatgaaaaattctagaaataatgcataagttttcaattactcactattctgagtagcatggtgaaatctcgtgccatcctgctctattccgcccaggacgtggatcatctatttgtcctgtgcatccatgctgtccataatatacccacccattactcacttagtggccactcagtgatcagttccactgtcttgggatagaactgcttgtgttcaagtcacccttattttactcaacagtggccccaaagcacaaagctagtgatgctggcaattcggatatgccaaaatgaagctgtaaagagcttcctttaagtgagaaagaagaaaactcatatgctgaagttgctaagatctaaggtaagaatgaatcttccatctatgaaattgtgaggaaggaaaaaaaaatcacgctagtagttttgctgtcacacctcaggctgcaaaagttatggccacagtgcatgacatgtgcttagtgaagatgaaaaaggcattaaatttttaggtggaagacacgaagagaaatgtgctctgattggcagcaattgggttctttactatctgtggtttcaggcatatcccctgtggagaagaggggaccactctattttagtttgtattcatataatatttgattaggcttattcattataaccagtgcaactggcataaacaggtttgagactacacctagccagctgttggttagcctacaagccagctaatgaagcagaaagtcatgggtgtactggagagtgccctattagacttcgtgtccagcatgcaggggcatctaccatgtgtcctggaaggaatgaaggctttgggggatctgacgtggtgggtaagaggaggtcactgatgagacgttctgctgttccgtcttcccttgacttctaggacagcactcttctgctttgcttcttgtctctcgggctgctcctctgcctcctttgcagatctgcccatctgcgctcagccactaactattgagagtttggtaattcttggctggagacctgatcttctgtctgcatgttttctcataatgagagtttatccaagcccctgaccttagtgagcatttatgcacaggtacgtgagcctccgttttctatccccagtccagagttctccgtttgagctgaagatcctatattaatggcctgactaatgtttcctctgggatatcacagaggccctctgtagtcaacaggaccaaaaccaagtggtgaaagtcaccactatctgttcaggtccatgcaaaccagagacctaggagctgtctttgccatccctctccctcatctcccagccatctctttggctttgttttcttatgatggaaaaaaaaaagaaagaaagagacttgagaacagggtctgatgaaaaggtaagagaaggcaaaataacaccttctctgaaggttgtggaacagacactagattagttttatagcatttgttaaacttattgttttaatcctggtttggggtgcctgtcctgcctcaggagcagttagagacaggaggtagagacaggccaagacctagtgttgtttgatgaagctaatttgcctgtggaagccacctgagggagcatagacatgggagacatgttaacctgaacaggatgctggtggacttcaggtcatgcagcatcatggtgcagtgggagagagcccttggatgggcctcaggctcttatcctacctgccttccttctctgaggccaccacctctgtgcacctggatgtggccagacactatctcttcagcctcccctttctatgccatagctaaggatagacatttggggcttattttttcattttaaatgttttgcctgaaatgctcccagacagagctgcaagcaaggcaggcctgaggtgggaggagaatttaagatatgagcccttgttctggcagttagtagaggaaattaaaaattgtgggttaggaaggaaagtggagaagctgacattttatgactctttcagagaaatattttctgtttgcacatttaattttacaaattgggatggatttaagacaggcatggagagtggtcaggatgggggtgacatgtcttctgcctttgctttgtgtgctatgtccttaatgtattcctgccgcaattccacctctttcccctgctgcgcctccctggggcctcctgcagccctcctcctgctgcttcctggtcacttctagagatggggccattttctagaaccagctctctaggcttctgcagttccattgcagacacgccctgccccttcctcctcacatccctttccacaagtacttcagcagcctgtagtggagttcagtgcaaatcagaggcagcagtctgtcagcatggcttttgtctcgttgatttttctgagtcttgatgttctagaccatttttggctcacattcagaaatgactgagaaatcaaagtcagttgtgaaagctgaagaatattgatgcagagctggagtggttccgagacttaaggatcaactcgtggacatgacagtctgtcacgttagtaacaatgtgtgaagtgattagggttatgcataatggtgataacaacaatgattttagcagctcccgtgtatggaggagttaccagttccaggtgcagttctaggactttatgtgcattatctcaatcttcatagcagcctgatgagaaaggtgttatttttatcctctgtagacaaaaattgaggcccataagcattcgtaattcacccaaagtcatatggctagtaagggatggcactgaaatttgaacccaggtaatctggtccagattaggaactggagccaatacaccacccatctgcctgagccagatttgatgaataatcagctttctctcctataattcaattccagatttctgttctttatttgcctaataggatctgcataatttagaactaagataaaatgcactctggttaaaacaaagtaataatcctactcatttcgtatgaatttgtggggatttcagatatcatgaagccttcccactccactccccaaggaaccagaccagaaagtacaggaaggggaaaactatgttaagttgaaacattaataccacacggatgcatttattaagtgtgtgagggagatgttgcctttctggagcataacataaatcatctggaaaattcagtacaaagcatttccagggactcaacacaaccaactggagggcctactgtctattgatatttctgctatgaataatctctgtgggatgccggctggctgcttgcctccagcagttatttctagttttgctagagcagtgagtcgcagcctgtaatccccgcatggggtgagacttgtgactcaggaggatgtttggggcctgccaatggggcagaagaaggtcgggaacgcagtggctcctgagaggtaaacattttagaagcagtgtgattgtgttactagagattcttgaagagcaggcatttaagggacacagggagcaaaccatcaaacatgaaggcagtaaaaagttgtactttttttcctccaatttggaatagcgacagttagttaagaaaaaaaatttaatgtgcttcaaggaaggttactcttttgatcccacattgtaagggttgtgacagcttgtccccattccttggtgttatggatttattttgggaaaaagaagtgacctcaactcatagctgtagctaaagaatgttgaaaaaggaattaaattggcacctccataaaagtcaacaagggatcatgtttttttttggactgtaagaaaatgcatctgtttaaaacaaaaggttctaggacagagcagtccaatagaaatacaatatgacttgtgaatgccattgaaaaattttctagtaaccacattaaaaaataaaaacaggcaagttaattttcatgatatattttatttaatccaatatcttagacaatttatcatttcaatatggaatcaataaaaaattattattgggagactttttttttttttaccaagtctttgaaatcctgtgtgtatttatttatactttgggcacatctcaatcacactggccacatttcagatgctcgatagccacatgtggctggtggctccctggatggaagggaggaagaaaagaaaaaagagagaaaagaaggagagaggaagagagggaagaaataatacattagagaaaatctaaagattccttataagcacacaaatgcctatcagatcctcatgcgtaacctcaaaggccagacttctccatggcccatctcagtaagtgatcactggcaagtccagaaagtacattcctttgcctgattaaaaatccatctttcccttcttgtgccaacggtggatagatcgtatttttcttctgggtgtaattagaaatgattttcacctgattgcttcgttgtattagtctgaagaacatccccctgaccattggctctcacctaattgtttacttgatctcattctcaaacttttctctttttcactggaatgcctgagaaggcagctgggagggacatgtgcatgtgcccccaaacaccattagggaccccgttttctttagtgggaaccaaaatgcctctgaaaagcagaatcccaaggcatcctaaatgccatctcttacataggcaaaaaatagaccagagagtgctgatgtcgattttgcatgcaaattggttaatggagccggagctgctcaactcgtgtgtatgattttctatttccatgcaccaatttgggagtttatgcaagaaggcggtaatccttcatgcaaagctgaaaatgcagctgtggaagcctgttttagagaacaagagctgtctggtcctgttctcatttgactgagttttgttgaatcttttgtgatgtcataagacagaggaatattatttgttaaaatgcatttacaatgcatagaactttatgtagacttagtgaatggttttgtggctgcactgctgaatatatggtgtgtctacactacagtgaggaaaaggagaatccactgataggaatttgctggtgtgtcttggggtggtgcctttgaacaaatgagtggtcttcttttgtggatagaagttgtgccaagcccccagagtgtggaatttattctgtcataagcctcttgaaactagtcttacacgtggtctttatgatttccaatagtttccatagtttgtcattttatattactatattcagaagcttttgaaaattcacctaagactttattgataaaccagtgtgaaattttgttacagagtcgagaccttgatgataataactcaggagaaaaagaaatgacctcgtttcctgtgtagatgccaaactcaagtgtgctcataccctcgggtaccgcactttttgggaaatctcttgttttccattttctgctgtttggagttgagatttccagtcactgtcttgtatacaaccatggtctttgtcctattattatttggccatctttacaaagtgaaatttttacattcttcctttgcttttgttgtcatatcaacctttgattttcccagtggcatgtttttgaattatcccaactcagcagcttttttcttcctgttgcttttgtaactcctgctcacactagcagagacagagaaggatagttggtgacctgaaagtgaggtgtcccttctgcttgttggacgtggaccgagagatgaggccgatgaagatttcctggagatagatggtggtgatggttgcacgacaatgtgaatttccctaacggtacctaaaattgttagaataataaatttgatgttaggcatattttaccacagtttttttttttttaaaggtttctaggtttcctctgagctttacactggctgactcttttccaggactcattatggttctttcatcttggtcttgtggctaatctgctttagggcccagggaatatggggaccccagagttcaccatccaccagagtgactgcaggtagcagtttgcattggactttctttgacggagagagtgctactgcagtcctgatgtggactgtggccttatcagaggagaatttcttcatttaatgacagctgctaatgagccttctccaggcactcttggtttggccaccttgttggcaaataaacccagcatgggttctggcccagtggaaattatttaataggcaagacagggaaaaaaaaaaaaacttcaatgaacaatttgtagaattaaaagttgtgatagatgctgtgaaacaaatgattggtaattaatgatatagaacagagctgtccaatggaaatatactttgagccacatatgtaagtttaaactttttaaaagtcacatttttaaaaggtaaaaagaaacacatgaaattaatattaatatattttatttaatcttaatatatccaaagtattgtcatttcagtgttattaatataaaaaacttcttacttagatattttacattctctttttcatgctaaatctttgaaattggttgaacattttatacttataccacattcattcagactggccacattttgagtgctcaatagccacatgtggctactgtcttggacagcgctggtagagagctgtgtgtgtgtgtgtgtgtgtgtgtgtgtgtgtgtgtgagagagagagagagagaaagagagaaagaaaaaatggcaacagacagagagagagacagagtggggggaaagagaaagagcaggagagagaattgtatggatgagggagggggactcatccttagacggtgtggataaagaaagcctccctatatctcctttttgtctctctctctttctttctctttttctcttccttgaatttgtgaggcccatgagaaggtatcagagcaatcatactcttagttgaaactgagactcctcaaaagtgccttgtaaagatgcattatttttcttatatgttttctctaagagcttggctgcaacagcattgtttttggaactgtttacatctgcatagtaagtcctcacttaacattgttaataggttcttggaaactgcaactgtatatgaaacagtgtgtaatgaaaccaattttaccataggctaattgagaaaatcaagagttaaattcctatggcatatttctggtcacaaaaacattaccaaacttctcgataaagaccaaaacatttctaatactaaacatggaaataaatgtgagctatacatacagttaagaaagattaataacaacaaataagatgatgacttacccagtttttggtaaaacagcgagtgatggtggttgtagtggtggtgggttaaatcaaggaataaatgtttgcaaagtgaaactcgtaaggagcacttactcccaccacgaagttcaaaaccaataacaaatttggtgggctcgccaagtgctttcatcccacattgtttattgtggtacattgtggtacacatttttattttacaattatttgtattcattccttcattcattttccaactcgcttattccagttcagtgtctggggtggccggagtctgtcccagcagctcaggatgcaaggcaggcgccagccctagacaggatgtcattccattgcaggagtactctcacacatacactcacacttgctcagactgggacaatgtagacatggctgtttacctaacatgcacatctttgggatgtgggaggaagccggagcgcctggaaaaaacccatagggatatgaagaaattaagtcttaagattttataatagaaaatccatacaggatttctatgacaaatcattttacattgtaaatccagtagtttaatttttatattgtttgtacatactcattagtggctagtctttgatgccatcagcataatgtactctcaaaatcaagagaactaccaagaatgccagctatcatactcattaggaaaatggcttaaaacattcataatttgctttcttctgactcacaaaaagctcttcttggatttggtatggatgagtttcgttaccgattctgaataattggtgatcctttgtgtcttctctaacaaaagtacttttaaatgtatgaaatattgtattaatactccaggttccatatctagtgggttgcttttaatatttgagtgcccactactaaacctaagcatcaggggacctggtgtttcttaaaaaggcttcttgatgtatcttagcctgtgtcttctctgacaaaatggactggtgaggtgaacaataatgccatcttctgagttttattaatggatgcagtcaatggaaattgttgagtcagtctccttacaaatacctggacactgaatttttacagtacagtggtgtgtgtgtgtgtgtgtgtgtgtgtgtgtgtgttgtgtgtaattcattgactatgtgtgattctctgaaatgacgagcaaaccaataacaacttaactcttccccgctcccattgtcacgacagcctgatgctttaacagtcatttgtggtccggcggccggcaacttaattcatttgatgaggcatctgttgctttgccagttactccctaattgacctgcagaatcttaggtttatataagcttaaagaagttcttttagtcttactgagattcccctgtgtgttcatccatggtttaattaaggtattaagaatagtatttcagaactcattcagctcaatagcaaaaatacaaataacccaacttgaaaaatgggcagagggcttgaatagacatatctcccaaggagatataaaagtggcccacacatatatgaaagaatgcttattaacatcactaaacatcagagaaatgcaaatcaaaaccacagtgagatatcagctcacacctgttagaatggctactatcaaaaatacaagagataagaagtgttggtgaggatgtgaagtataagagaacccttgcaccccgttggtgggaatgtaaactagtacagccattatagaaaacaatatggaggttcatcaaaaattaaaaatagaaatatcctatgatctagcaatcccattactgggtatttctccaaaggaaatgaaatcagtatgttgaagagatatctgcactccatgcagcattattcacaatagccaggatatggaaacaacctacatgtccatcaatagatgattggataaataaactatggtatatatatgcaatggagtattattcagccttaaaaaagaagatgatcctccatttacaacagcatggctgaatctagaggacattctgctaagtgaaataagccagacacagaaggaaaaatactacgtaatcttgcatatatgtgcaatcttaaactaaaaatcaaatacacagaaacagagagtagaactgtagtttggggggtcagggagatgcagggagatggggagttgtaggtcaaaggtacaaagttgcagttatgtatgataagtaaatctagagatctaatgtacaacatggggactatagctaataacatcgcgtactggagatctgctcagggaatagattttaggtactcttaccacgcacaaaaaagaaaactaactatgtgagatgatggttatgttggttttcttgactgtagtaatcatttgaactaagtatatatacattgaggcatcatgttgtacaccttgaatatacacaacaaaaatccattaaaatttaaaaaaagaatagtttttttttgtgaaagcatgttattgattgctagggctcggggagagaggggaatgggaagagtaactgcttaatggacatggagtttcctttgggggtgatgaaaatgtttcataacctatagatagagctgatggttgtgcaacatcatgaagatactaaacgccaccaaatagttcactttaaaatgattaattttatgttatggaaatttcacttcaaattttaaaaatagtgttttaatggtgtggtctcctgagcctggatatgtgttttgttttgttttgttttgttttgttttttaagtttcagatacatgagtttgtttaatgagaagatgacagaagtctaaatttttaaagcccttagaacaaacattttaacttattccacagatttagaaatggcacatacagaagacatgggctttgtcttctgcaaacattattttaaaaattggactcctatttcctacctatacaataaaaagtcctgcatcaaaaagtgattgattttagtgttttgctaaattggatctactgcaaagcccaggcagattgatgttatggcactagcagtcttgaaggaactttttaaaaaagagagatttggttgagcagtgtaacattatcagcttcacctgtgagggaaatttcccgagggaattggtgtctgtctcatgttgcactccttcgtattgacagatccattagcggatgtaattagaagaccaaagtcagactttgaataattaggttaaagtcacaaatgatttctgggcaaaataatagaagctgttgcagttcagcctgctgtttcctgctttacagagctgagtgaaatgggcagttgctgtatgcggtggtttctttcttgtgttggaggctgatactttcccaataatcaagtttgaaatagcaaagacctcactttggccctttgcaaatgtctgaagggcttcgtttccagggaataaatggagctgtggaatgtttttgctaaacaaaacatagtcatagcaaaaacaaaatttactttatcccaggagtgttaagaaatgtgtggttttgtggattatgttttttctctgttttcattcctttcttttcctttttttttttttttttttttagttcttggaataatggtttatttatttatatggagttattttctgaaagaaaaacaaaacacttatttcaaaagacgtttggactctcatgccacccaaaataccttttcagcagtagtttctatattttgattttataaaagcctgttattggtaatagagtctggaataaaaaaaaatatttccaaaagattcaaaatgcaatcatgtgattctaaactttttgttcatctcagtgccaatatagaaaaaagaggaattaggaaatagaggccagtatcaaatacctgcagatgtgtccttgaagcttttgatgtaccttgtgatgatgtgggatgaacagaatgacatcctcctccatgtatgactgatgctcacactgcgcctggacagtggcaggatcagaaataggaagaagtgcggggcatccatcccccaactttatcaaatgccccatccatactctgcaggctgctaggtcttgactttggccatatgggattgagaaaaaaattacagttacttgtcacatttaaagattaggaagattaagatttctgacttcttgaaagtaagagttagaagttctggcaccattgggccccccccccattagcagtaaccatcttgtccccttgggcaagatggggcctcggtgttcattgctgtccccctggctcatgtctcttgtttactttattttcctggcctgcagatacctctgttaatggctttgggatctgcaccaagccctctgtccagtaaggagatgagactctgcccctgcccaggtaggggagaagccaggagagaattgtcctttgcactgcagcaggacaaagccctggtatgggatgaagatgggcaggagttcaagaccagcctggccaacatagtgaaaccctgactctactaaaaatacaaaaattagctgagcatgttggtgcacacctgtagtcccagctactcagggggctgaggcaggaggatcacttgagtccagaaggcggaggtttcagtgagccaagattgtggcagtgtgggagcacgtgggtgtccttcccagatgaggcgagtgtgatcactgtagataaaaactatagaacctgacagattagaaagtggagaaaaagtgtgatcagccctcgcggcagcggcccactctgagtaggctggcattttctctttttggaaggtaacggtggctaagacagccataccagtgtcccttatcttcagactacgaagttataattagaaattttaacttatgatgagacggttcatgtggttcagccttagagtcagctcctggtcaaaggccaggaagccaaagtaactacagaataactcatgccgtttccttgtagctctcttctagggtgaaggagacccatcatccttgatacttaaaacgttagttttctctcccaccgctgggcaggcatctcttccctagaactcctctgaaaagctccccacactcccccagaggacagttagcccagaatccctagtgcctgggcaggcagaaggctggaaccctcgggcagcagtgatgtttctcccgcccactggcagtgggtatcttccagcctctccttcctcactccagccacccacacatgccatgtgggtgttccttcttccaattctagctctggtttgggggaactcttttagttaacattgaaaacaattgttatattatccaatgttactttttagttagaaactggtacctcagcctccaaattgaaataataaaattattgcattttaaagttgaaagcgccttttgcaattgcccatccaaagtcttcattttgtaaatgagagtcccaagagatggggagggagctatatagcttgcccaaggttacataatttgtaaatgaaatcaggcaactattacaaaacaaaatagtggagaggttactctgataagtagggtgagaaacagaccaacaggctacaactggtatgtccatccaagtggagaaatcattcctttgtttattcgcctaggagtaacactggggaattggtcacttcataagaactatgttttcttttgtatttttaaggttagggttcaaatagaaacatgagattaaggcctttaatcatgtttataataggagcctttttttattgctttaagatcattgagattcatttttatttgtttcttttaaccatgaagctaaatttactttgacagcatgcataccaaaaattaaagccacaaaattgctcagctttgacaggagatacatctttagattttaagataaaaatttaaaaggtattatgtttttttcaggaagcatttaaatataaagtggttgattgactaacatttttagtgcaccgatttgggagcatggaggttaaggagtgtgggtgggaatggggaaggatttcatggccccacatcatgttgtcatcaccatcccggggtgaccagtcctcccattcaccacagccagtgccaccgcctgtgattgttttgtgttctgtagattacacacacatcatcccacgtgatcctcacaatgacgctatgatggaagacaggttgatgttgttatcaccattttatacaaagaaattgagtgttcacatgactggggttagcaggcagtgaggagagcagctggtatagaaacctgtcttctttttttttttttttttttttttttttttttttgagacagagttcttactctgtctcccaggctggagtgcagtggcacgatttcagctcactgcaacctctgcctcctggactcaagtgatcctccctcctcagccccctgagtagctgggactataggtgcacgccaacatgcgcagctaatttttgtattttgggtagagacagggtttcaccatgttggccaggctggtctcgaactcctgctctcaaatgatccacccgcctcggcctcctaaagtgctgcgattacaagcgtgagccaccatgcccagcaagaaccctgtcttctaaacatattaactacttttattttttattttagtgtgatgcataagaggaaacaaatgtataaattatcaaactctcaataaaggtttattttattatagcaggaagagtttgaaaaatttgaatcatttaaagaatattgaactgtagagaccaatatgagtttgagttaaatatgagtttgagggcccatattcgatgactcacagatgctgtttgtatatagttttatcaaaggagaggggatcttggtgctggatagtatttttaggtttgattgacaacgtgcagttgccttccataaagccctacactcctaccaaaagtacattcagtttttcaaataaaacaaactgtctccgccacatgtggttttgcccttttggttcagcagccttgtaatctgttgacagcccctggtttccataaggtcgacacccagcatttgcaggctctgggacaagaggacaaaaggagatcttgggctgggccaggattagggtgaggggagtgaggcaacatttataataaataaagacaagatcagtgacagtattgtgcaagccgtattggagcttaaagtgaaaggaaaaaacaccgatcctatcttttatttatttatttatttatttatttagtaactctgtcaccccaggctggagtgcagtggtgcgatctcagctcactgcatccttgacctctctgggctcaagtgatcctcccatctcagcctccctagtagctggcactacaggcacatgccaccacactcagttaatttttgtatttttttgtacagatggagttttgccctattgcctaggctagtctcaaactcctgggctcaagcgattctccttgagggcagggtggtattgcccttcaaacctaaaaatgcacacactctttgtccagcaaccctactactggtagtacttctatggctggactcatgaatgtctttcaagatatatggacaaaggtatttactactaggttgctctaacagccctcaagaaaggttcactcccaccacgatgagggccatgcctgtttccccaacacccttgcatgcagtgaatattacagaagtgaaaaaggaaaatgtattattccaatagcaataaaatatagaataactaggaataaacctgataaatatgtgctatctgtgtgaagaaaactttagcatgctccagagggacccaaaggaagacttgaccaaatcaaaattttgccagtttcttgcatgggaacttgtagcatggtgaaaatattcattctcagtcaagctatgatttgaacatgacccaataaaaatacccacagacttttttagtggagcaaggggaatttactgagctgatttttaaagatcatttagaaaaacgaattaggaaaattcaaaatataaacaggaatataggaagatttgacaagtagtttaaccagatattaaaacataatatgaaattaaaattgtttgaagtagtgttttatacaaatagattaatggatcacagtcataaactcatatttgggaatataataaatgataagtggcatatgatatatggcatctcaaatcaatgaggaaaaatggataaacccctgtggtgggggggtgttcaattcatattgcacactttacatgggataaattccaaatcgataaaagatttatatgcaaaaaatgaaatatgtattatgggaattcacaagagaattgttttataatcccaggtctttctgctatgacacaaaactcagaagccattgaaagcaagattggtaaattcagcttcatttaaaaagtttttcatggaatcacttgaacccaggaggtagagtttgcagtgagcggggatagcaccaccgcactccagcctgggcaacagagagagactttgtcttaaaaaaaaaaaaaaaattttttttttcatggcaaaacccactatatgcaaagtcaaaaggcaagcaacaaattgggggcagatacatcaaaaactaaatttcctaatatgtaaagagttcttacaaaccaatagaaaaaaagcccaatgactaaataggacacgaggcaaagataatggacagacagttcacagacaaggagacacagcatttaaatatgaaatgtttaataagaaaaaatacaaattacataataagataaatataagttaccatgtcacagggatctttttttttccactgagaattgtcagagtatgggaaaagaaataactttatacatcactgatggcagataaatccataatactctatgggggaaatagcactagctgaaaaaattacaatgcacacatacatatgtgtgtgatatatatatatatatatatatatatatttacatctctgattttttatttatttactttttgtgggtacatagtaggtgtatatatttatagggtacatgagatgttttgatacaggcacacaatgcatatatttttaacccagcaattccacatctaggaatttattttgtatatgtactataagcgcacacatgcaaaatcatgtaggaatgagatttttcactaaaagattacttgtaagagcaaaagtttgcatactccatggtatatcacacaatggatctgtagaaaagaatgagaaagcactctgtgtactgctatgaaatggtctcttaagaaaagtatactgttttgttttgtttttttgctttttgagacggagtttagctcttgttgcccaggctggagtgcagtggcgcaatctcggctcactgcaaccttcgcctcccaggttcaagagattcttccgcctcagcctcccgagtagctgggattacaggcatgcaccaccacaccggactaattttttatatttttagcagagatggggtttcatcatgttggccaggctggtctcaaactcctgacctcaagtgatccgcctaccttggcctcccaaagtgcggggataacaggcgtgagccactgcccctggccgaaaagtatactgttaattgataaaaattgattctaaaaagctaggtgtgtaatgttatgctgacatttgtgtagaagaggagggaaatatatagacctgttcacttttgtatgaattctttgattgttaatgcatatacacacaaaaagataatactgatttcctctaaggaaataaatgtaggaggtagaggatagggctaggatgtagacttttcactgaatacacatttgtaccttttgacttttgaacgttgtttgcccttctcaaaaataaataaattaaaaatccaaattttaaaataattcaataggtgaaaatattcctggtttttatttgtgtaattctaatgctgaattaaagtgtgttttcaaatattggttagccttttacacttttaaggcaattgcctattcatatatttttcccgtttaaaaattattttggggtggggagtgttttgcaaatttaaggaaattagccctttgtcttaagggtcacagaaattttgttccagtttgtcttttgactttgtttatgctgctttttgccacctagtatttttatatttgctcaatgtatttttcttcttttcccttcccttcttcctttctttctttatttctgtgtgtttttttttagagggtggaaatgactttttcattgtgatcactgataagacgactctagatctaagacagtccattattattttattttatttcatttttgagacagtggcttgctctgttgcccaggctagagtgcagtggccctatcatggctcactgcaaacctccccatttccagctcaagcgatcttcccacctcagcctcctgagtagccaggaccacaagcactggctaattttgagggggtttttttgtttttgtttgtttgtttgtttgtttgtttgtttgtttaagagagaccgagttttactatgttgcccaggctggtctcaaacttctcggctcaagcgatccatctgcctcggcctctcagagtgctgggattataggcctgagccatcacgcctggccgacatccaattattaatgcctttgggtgatttggaaaacgacaggctgcttataaagtctgtttgaagacagtaaaaactgggacaaactcattttagcagtgacctagaggatcctccccgagggcaagggaagaggggtttgggcagggctgagtgggcgttgtgatgggtctttgatgagcctctcctctctccactccagcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacaggtaaggcctccacgggtgaatgggtagcatcctgttgcggctaagttatgctcaatagaggaggggaagtgagaggatggggttgggggttgaaatttgcatgctgtcctcagggcctcagccctcagacaggtgaggcaaacagttagacaaccagagaggtttctttcctagcatcctgcgatgaaaaacaaatgcatgtccaactgcaagtagagagttccattttacattctttccctcttttaactcactggattaaactcagctagaaaaatgtctcctcagaagaagcatatgcccagaatgatgtggctagtaaaagtgcaatacttttaaactgaaaggcatgactggaaaacaaataattttgtttagaggctatagacaaacttaatgtcttcccgcaaagtctagaaatactttaacattttgcgcctaccataaattctgtcaatcacttgacagttaaaaaaatacaaaaaataaacaccacctaaataaaatgctataattggtttggtcttgatttagattttcagggcttggggatgtttttcagtttggcttgcccagttgaatgcttatgcctatatttcagttgagcctaattaagaaaagagaagtggggttagtctttcaaaaggaacaatattaatttttttaaaaaaaaaaaacagtgaggatgggatggagagagcagtatgtttttcctgctttcataaaaataaaaattaaaatgaagtctgggaaaggaaatcagatttgtcttttggccaactatcatagaaggaatgacagcatgtgccacattttaaaaagggagtacagagcagctcctccttgttctctccttttaaagtcactttgcaggtagacaaagcatttggctggtgtgctcataagggacagctgtgaggcatgaggttgcgtgtctaagactgactcctctttcctttcctttcctttatttcttcatggttgatcaagctctggggctcttactctacatcaacacacattacgtcaacacacattagaattcaaagtgaaaggtggtgcatgtttttgctcgaacccagaattcacacatgttttggtagggcaagacttttctcagtgtctgccttttatgtgtattagtttgtctttctctctctctctcttttttttttctgtagaaacaaggtctcgctatgttgcctaggctgatcttgaaatcctggcctcaagcgatcctcccaccttggcctcccaaaccactgggattatgggtgtgagccactgagcctggctgcatattggtttcttttcttttcttttttatttccttgagatggggtctcactctgtcacccaggctggagcacagtggcatgatctcagctcactgcaacctttgcctctcaggcttaagccatcctcccacctcagcctcccaggtaactgggactacaggtgcacgccaccatgcctggctaatttttttattttgggtagagaccgggtttcgccatgttgcctagactggtctggaacttctgggctcaagagagtttcccacataggcctctcaaagtgctgggattagaggtgtgagccaccacgcccagtccattattggttcctttaggttgattggctgttgatcattatctgggtcaatcatgagaagattgggggccacagtggttttgagtgacactgacacataggatatgtataatgacagtagcttatatttagtgagcactcactgtatgtgaggcttgatcattatcatttcatctgtatcatatggctatgaaataagtgtcatctttgttcccattttaaaggtgagaaaactgagacacaaatgttgagttgtcaaggtcacacggatggcagcaagcagagttctgccttgctcccaggaaggctgtctcccgtacctgcattcttaatcctggcatgaagcacgtgctgagttcctttacccacaattcttgtggagaaccactttaggaaaagaaagtgggggaggatatctttgatcttccataaagaagtacttttattactcaacctttcccccattttacccctcagtagtcagtaagtaaatcagaatttcagcaaggaaacaaaacagacaaatgagttgtatggattctataaggcatccactgggctccagggattctattctgcagattatccgagtggccttagtgtttaaaggagacaagtccatttgggtcagatcactggcacatccttcagtgtgatctgccataggcggtgacatgagctcaggacttggcctgagcttaactcaaaaagtgaaggtgtatctttttttttttttctccctgctgtggagcaacacttctcaaactttaatgtgcttgtgagtctcctggggatatggttaaagagcagagtctgatatagcaggtctcaggggaggcctgggactctacatttctaacttgtttccagatggggcagatgctgatggtccgtggcacgcactttgagtagcaagtgtgtggaggacctaattcttgcctggcttcatgcctggcactcagcaacactattggggcttgccactttactcctaggagagctgtaagcaccaggctaggtaagaaagaacacagaactcgtggccaggaggcctgcgttctaggctgcacttggctactagtaagcagtgtcgtgcaaggggcacatcgatggatctttctcggcctccgtattctagctgctacaatgaggggctgttactacatgatttgcaaggcttgcaccaaactctaagttatctgatgggacaagatgggtgaggaagcccgtcttcagaaataagaaccaccactttggggaatagtgcattataagccagcagtgaagctgggggctcagtaggggttgtttacttccactaacgtagcatgaacaaatgaacttactttccagaagacaaaaatgagcaaactgttgagaggaatgagactttgtatgcaggagggttttcaagaaagggaagttggcagtctccttgggtttgagctgactttcatccagagttcctgaactgcctgcctgatgaacttaatgaacatttcaactcctggacaagcagatccagagaaggaaattccttaggtaactttgtgttgagtctttggaactgccttttttaaaaaaatgcaaaagtttgataatttatcatgtaaaatgaggcaaaaatgatcaagaggatcatccccacttctagccccaatggtattaggtgggaggagtggtggaggttggaagcagtcattgtaaaatataattttaaagtacaggaattttctctcctagcaaatgcaataactgcattttttttgtattatggggaaaagactccaacgatcttaaaaataagcaaacaaaaaaacatcaaggccaggtgcagtggctcacacctataatcccagcactttgggagaccaaggcagaagattctcttgagctcagaagttccagaccagcctgggcaaagtagagagacctagtagctactaaaaattttaaaaattagctgggtgtagtggcgcacgcctgtagtcccagctacccgggaggctgaggtgggaggattacttgagcccacgagctggaggctcctgggatgtgactgtgttattgcacttcagcctgggtgacagaatgagatcctgtctcaagaaacaacaacaacaaaaaaaaaacggactttttctttatcaatagggagtttaagtagtaaaaacaaaacaaaggaagacttttgtgattaatttttaattcagacagttaaagtgatacttttcacaaagtctgccaaagttctgacagttatagatgctgttaaatgaaatgagttagcttttaaaagagaaagaaatacttggttaatatttttcaagtggagcacattgaaagagatgtagatacacattctagattattgttgacccaagtgaacttcattaccaagaatcaccatgagatgactctgtgaaacttcgatatcaacctaatgtgtttggagggttcacataaaatttttaacaaataactgggctttgggatatgccagaaacaccagacggaacccctcaagcctgcatttatcccctcactcattcactaacacttgctgagtgagtactcttttcagagtattgtgctaggagctctatgtggtgggaagttagagagtgcaaatgccaggctcagttgaatgtggagcctgccttccaagcacttgcagtctaattaagtaaatgagatatgtgcctcatgccacaggagtttgggagaaggagatgccacctctcactggaagggaaaccaaggaaatgtttctggaggggcagcttttaacttgggcctgatttcttttgggcaaacatggggagtaatgagcatgaggcaggaagagtttatttaaatctcctaatgaaatgttttctagtagtatttgagtaattggagagcatcgttgacagtctaactaaattattaatgagtcattccaaaagtagttctcaagtgcagtaacattcctctgagctcactgccattttgacagatttcacttacatccctgaaaaattacctgatcttttcttctgaaaattctaataactgccatttcattttaccatggcaggcctagccacacatctaactgtaaactgttcttaattctaagtgtattgaatttagtcaagtcagttactttgactcaagttactttgactcaagaatgaatagctgaatatgaaatacttagtgaataagtagaaagagagtttgtacttcattttctcaactctttctttggaacacttagtgatttttaatagacaatatagttgcactcactctgaattctaagtatagttaagtgatccttcatttttttcaagtagttttccttagaatgagttgctaaagatcttgaaacttgatggctaacagaagtcagttattaaaacgtcacttctgatgtttcatgagtgtgggtttaattctaggttgttttatggttatagatgtaactgcagtacaaaaatgcatggtgctggccatttttcagctgttgaattgtcgttgtacacacatggagctaggggcgtcattggtgtgtttttcatcatgaatgagttgaagtcctttggcgacagcttccgtagagtaatgccttacatggtacagggaccagcatactagggagctctgtggacatttatcaggcaccttttggcctaggattagggtgggggcacacagaggacctgtagttaatgcagaggctgcaattctaaaattcttgtggaaggtggaaaatgtgtacaatcaaagttacccttgaaaatcttttgaagtgcatataaaatgtaatactgtggcatctctctacctgaccaatgcatgtcttccttcaggactagatcagattgcttttccaacagtgaaccccaaggggaggtaagctggtttgggtttatagtgagtactcattggaatcacacctaggatggtgaaatttttgcacctagggaagcatttgtgggaattggcattgagggaacaggaactccacgcctcccttctcgagttcattctggggcacatctgcctattgaatagaataactggcactgttttaagtggtaaacatttatcccttttgtttggatttttctaaggtaaatatgtatatgtaatttcactatgcaaagatgactctaaggagctcctagatctcaagaaacttatctatctactagggagctgcaaaatatatgtgcaaattatataattgcccaggtaagtctacaggtcttggtttgcatctctaacctggaatttgttaatgagagtgctttagaagaggaggctctgcggctgtcatttgctctaggttgggcatgatgggtagactggaatagggagtgaaaaagtgggaagggccttcccactattgacattgtggaacaagtggaacgtggtgtccaaagagaaacagtgggagggcaggcatgagaagcctggaggaggctgtgtgtggtgctgtaatgagcccctcaggccagggcccacttctctagctgctgacttagccaaggctactgcagtccttgttctagaacagattcctccagtgattcttagaagagatgcagtgggttgttgagagttacggtgagctgcttcatcccaaattgaccatatgcttggagtctgtgaaatgtttcctcttaggccatatcagcaagctgtactcccaagtgcttacgagcaacacagatgactgaatgagtcagccttgtccacccagggtcaagtgatgcaagagaaacgattcttttggcttttgctgttttatttccaggaaagtaaatctcagagaatgctcatcccttaccctttgtttctcctcttgagacccagaatctaaaattctgaagactctgtctttattctaagacagggcttgcaagctcagatccctacagtggcctggctcattgaatggggactcttgggaagtagtgagtcaatgccttagctctgtcctatggttatcaggtgttgccaggtcttgtacttttttcaagaaaagccagaaatctggatttttatgtgaaaacttctcttttagcctcacttttccaaagtaggattgtttgtccctaacccatgccactggctgccatcttgcagcctctaagatttctgtgtagtgcttacatcagtagaggtaatcacacaccctttgagctgcttatcctgccttcgacacacagcaattgctggaatctcagtctctcctgttattgtgttttagatgtctgcccacctccactccctttgctgaatcctcttccatctttggattcccattgcttgctcagagtgccaggccttgaatagatattgctcaatagattttgcatgaattgagtgggataaaaccatgccctggaattttgctacaatcttttactaaaggaccataaattcattatgagatagatctgtctttggtttacgtatttatcagtaccaaaagtatatcttaataatgcagccacatagcacagacctcaagtaatggaacagacacacacacacacacacacacacacacacacacacacgatcctttcattgccaaaataacagtgatttgccacaagaatagatgtccattatttttcactcttctttttcttttaaaagacattcaaaggatggccttcaaagaaaggaaatctttgcggaccataagtgaagtacaaatgcattatgttatcttttttttatagcctacaagataatatgaacattttctttggcatttgaaaagggcaaaattgggaaagtacaaaattatactgaaactaaaaagaaaatcctttaaaaaattacagtcgaaagtgtcctctttaagtggccttgtgtcttttcatgtctaatttttaccaattaccttgactcttgggagaattatagggcttctagaaagaggtttcataattaagcgaaatacacagggggtggtagcgcctactggggtgtgccctagaaaatgttcacacgcgaggccgaggatcagccctagagtgcgctgattgttggaatcacacgtggggaagaaagtaacggtgggtttagcactgattgatgcgtgctactgtgatgggaaactgcagccgccggtttattcccagagagcagacattgaggaaggtgaattcagagctcttgcttaaggcagagcggggaatgagaaggtgtttgtttagcatgtgggtcgttattttggattccgatttaggtggggcgaacacccgttgctggcagctgcccctcgtttctggtgtggtatctttcctcatcagttttctctagcttcctgaggggtgtggaggatttgattagctctccgggctgccaccgtaccccctgaggagctgtccagcatcaccaagactaccttaatttattcctcttattttcccatctcactctggagtgacacccttttctggtgtgttgaagtttcaggattcaccgttaattatttgtttgcacttttcaatctcatatgccagcgtaaagccaccttctcttgggggaaagaattttttccaatccacactcctaaatggcttgccgagttactcttgttctcttcctccaaagcattggcctttaccccggtggagagaacaagaaggagacgtgcatggttggtgtgagagctcattttccccactcctgttctatagctgcccttgattggcctgtgtctttcctcacattttatttattttttgtttgtttgtttcttctgagagagagaattagcacactagtgatttccaccctctccccagaactattttgaaatgacagagaacagtgagcaggtacccaaacaaatgcacaagcactgaatttctttgaaatttcctgttaatcttaaaacttgggtgaatacttcagtaccatgaaatgtctgtatttgtttttaaataaaatagaggccccctcttcccacatgtacatacaatctttaagtaaaaattgactctctaggaagatttatttggtagcattgcaaggtagactacagggacatgattttgagaatcgtatgcataagtgtaggtaatttagttgcaaataattttactaaagcgttggagttttctatttatatgtctgtctcatattaaatataggaactcagattgtcttactttaaatctttgtgggagtcttgtattgaatagtctacctattcaactctgttgaattgaaaattgacattttttcctctttgtcaatcagaagtaacttagattttttttgtgtgtttttcaagctgaaaaagatataatgggcattaccagtgatgggtcctggatgagactagtcattgagttttacacttttagatatgaatgcagaagtaggtgagatataatgtttagatgtatataagtacattattaatgatttaaatgttcatgagatttttatataatgattgtctctaaaatctgtccaaattttatattttaaatgattgaaagatggaaccatttacaaagaggtaaatgctataaagatgctataagtatatgaaaatatgataaatatgctataaatatgaatacatcatttcattcacttcctatcatcgaccatgagttggaacttaaaatggctacaaagactttaaaaaccaaattagcagcttgtattcacataacacctgtttctgagagtctgagagcactttgctttgttcctgtatgttttcggtattataattaattctcattatgtcctcatgatggttgtttctgttgttaatatttgtcgaaaacattactgtgctttcagcagaggttttagacatacactgttttgtaaccaaaagataccatgaccttccctcattccccacttctcattttatgtctaggaaaatgaggctgaagaagtcattaacgacttctcagtccgaagtttggagtgggtaatgggagtgtgtggtgaatatagaactcaagttccatcttgagactcatggcacagaaatacatcatctttcaactcagaggccccagagcttatagaaacatcctcagagaattctgagaattttctgggctttgtaacatccccagtccccatggctacactgtgggaccagaagctttgctaattccccagctggtttcagaacatagggctacaactgcaaaccacttagagctccccaaatggccccattcagcaggctggctgggtcttttcagtttctgcaccaaatgattatatgcaaataatggttctacgattatcagtgtgttattttctctctgctccctaaaaacaaaataaaaatgtatttattacgtgtcttttgggtccgctaaggtagcagtctttgttagagagaatgagatggacacgattcctgttcgtggggaatttgtaatatattgctatagtttaagtctccaaaattactccatcaagcaacctggatctcttaggaacataatgcccccttttcttgtaaagaacatttatgtgtttgcaggtacttcttcatatgatttctcatttttgataatagccatcatagctaccatttatttactgctgtggctggctggagtccttgttcattgcttcatgatatatattatctttattcccctaagccaagatgaaggaaatgagactcagagtggtacttgtccaagccagtgtccacacgtttcatgagtggagaaaccggttttcacattggcacctgtcttctaatagcattcctctttaattgtttagctgtgagggttaaggtaggtaaggatagaatttctcagccttggtactattgacattttggatcagacaattgtgtgtgggactgtcctgtacattgtaggatatttagtagactctctggtgtctacccacaagattctaccagcaaaccccccatccctgcagttgtgacagattccagacattgcctaatgtctgtggaaggacaaaactgccccgatttgagaaccagtgggttagttagggagtaagacagggagtctaactttttttttttttgagacagagtctcgctctgtcacccaggctggagtgcagtggcgtgatcttggttcactgcaagctctgcctcctgggttctcgccattctcctgcctcagcctcccaaggagctgggactacaggcaccaaccaccatgcccggctaattttttttgtattttttgtagagatggggtttcactgtgttagccaggatggtctcgatctcctgacctcatgatccacccacttcggcctcccaaagtgctgggattacaggcgtgagccactgcacccagccaggagtctaacttttattttcttctaggtagccacctttgccaagagcacttattaagttaacctaactttgccattgaataaatgccacctttattatagttaggatttctatatgtacatcccaatctattcctgattctttattgtttctttgatctacttattgatttttgtgccagaaccatgttattttgatgataataaatttgtaatgtatgttaacatccagtagggcactattcttttttttttttagacggagtctcgctttgtcaccaggctggagtgcagtggcacaatctcggctcactgcaacttccgcctcccgggttcaagtgattctcctgcctcagcctcctgagtagctgggattacaggcacgtgccaccacgcccagctaatttttttgtatttttagtagaaacggggtttcaccatgttggccaggatggtctccatctcctgacctcatgatccacccgcctcagcctcccaaagtgctgggattacaggcgtgagccaccacacccggccagggcactattcttttttaggatcttgataacttttgtacgttgatttttccatgtaaagcctgaaataatttcttcagttcctggtaaactctgttgaaattgtagttacattaacacactaatttaagaagaatttccaccttgtgttttcaagaacataatgttcaatattattattggaggtaaattttatttgagagcttcataataattctggaaattctatgtactatctaaacagtggttaccaaagtggggtagacatatttaatgttgaaggagaactgaggtgtctatttttatatattttattgaaaaattaggagagagatgatgtgtcataatatttagcattcaggttgaaggtggtgtcctggcttggtgtgtatgtcagaggtcacatgtgctgtatggagcaggaggggcctgcagaagggctgggttcagggaagcactttcagctgagatctcagtaaggtgaattagtggatcgctttttgtaattttagctaaattaactctcatgaaatatacacatggctttaaaaaatttctatgaagtgattgcagattgaagagaatacccgtaatgtaaatgtaaaatccttctctctctcatgtggaaatggctacactgacccgtctctgcccataagagctttgtgggacgcagtatgagattaaaacaccaatgttgggctgggcgtggtggctcacacctgtaatcccagcactttgggaggccgaggcgggcggatcacgaagtcaagggatcgagaccatcctggccaacatggtgaaaccctgtctctactaaaaatacaaaaattagctgggcatggtggcatgcacctgtagtcccagctactccgggggctgaggcaggagaatcacttgaacccgggaggtggagattgcagtgagctgagattatgccactgcaccccagcctgggcgacagagtgagacaccatctcaaaaagaaaagaaaaaaaaaaaacaccaataccaatgcctacctgttcagatctgatttagaaatttggaattatcaagaagactttttgaaaagtgtgttatagttccattatgttaacaatgaatctcatttcaagtgtatattttgccttgaggtattagctattaatagtgtgaacttactgtgatcatcattataaaatattgcttatttcatcatttctgttgtttacgattttctgttttgtatgttttgttttataacatatgtaagatgttagtacagtggtactcaggaatttttttctggcacgctgtgtgatcagaaaaatttggagacaattgatccactcagcatttgagacacactggaactggtggttcctgaagcagtcggaatcttgctactcaaagtgtggtccatgcaccagcagcatcagcatcacctgggagctcttagagacacagactctcaggcctacccagacctgtcgaatcagagtctgtactttaacgaggttccagatgatttgcacatacattaaagtttgagaacagaattaagctgtcttttcctgtaacacagccattagccatgtatagccatttaaattgttaaaattaagtaagaataaaaattcaattcttcagttgcactggctgaatttcaggtgctcagtagcaaaacatgctgtagcaaaaccgtagtggctattttactggactgtacagatatagaacatttctatcacctaactcagttagtgggtataggtgggatgatttgggaaggaagaaaacaatcagcaaagtttaatgtggaacatgtgcattcaatgcacgtagagaagaggcttcttgtaacctaactggacaggtcccatgagagagtctcatgaacaccattcctatgtagctattattgctatttttgtttgcagatatgtgacttttctgaaccagtaaatgtcaggcagactgcttttattcagtattctatttgtgataaaatattattaattatgcatcgctactaatattagttctttctacatctgtcaatgtaaaggagagacttgcagcattccagagaaagcaggaccctcccccagctcccattctgtgtggctgctctcctcttttctgcagcccagctcactgggcattgaaattctttcacaactccattagacagggagcaccgaggcaaagtttgtctgttttcctcttggtctttacggttaacagtgcactccttgtagtgcacagtggctgatagtttgtctcccagggagccagccctgacagtaagcagcaagacaggatgatttctctagaataaatagcagggtcggatagttagatgtccctggtaacatctccccagtaggcatgcacagctccctgagagagtgtgtagtgggagtatcctttgcacatctcccccatcatgtccagaatgttcccagagataccaaacttttttcaacagaagtgctgaatgtcttctgctagaaggggaagggaacatcggaagaaaggacagtgactcatctgtgggtaaattcttctccttcgttgtgcttcctacttcacaactcccctgggggaccctatactgaggtgctttatttaaagatttgctaggatttgtttacttgactattttttcctcaagtatttcttcagttttgctataggggaaacttttaactccaacaggctcattgtatttgtgtagatttggttcattttgcaaagagggttcataaaattatgggaaaccttttccctattgtactgggagcatctctgggaaggtgcaggttattcccctgcccacaaccaccaccaattgcagggacaagaaatactgctcttccgtccacccactcccttcgacaaaaatctcagtacagttctcattgctgctgtcctaaaatattcttccccccttcctacatcatacacactgccgcctgcttaatcttcccagaatctgtcatagtatctttctctctaaggccacccatgactcttctttacttcacagttaaggcgagtaccgtcctttctcagtaactttgtttcccactattctgccccggtcactgcagagcccacagtcacagactcgttctaacagtggattcacccacacgttccctaggctcatcattacagcctctgctgagttacaggcaacccgcaccttcacacaccttttgcctaactgacctatttattatttccatcatataactcatgcttttctcaatctaggtcttcattaatttctgttctcaggcctagaatgtccttttatccattgtcccatgactaacttccatacagactcaaagactcagcccacacacgccttgctccttaaattttcccctgatccttgacactggaaataattgaattctcatagcacttctgtttatacacagtctatctagacttgagggcaggatctagacttgagggcagtgccttcaatccctcatatgtggtcagcagtcaagcaggtgatggatagacaaatgaataagtggagatttttattgtcattagttatacgtaagttaatgaaactaggaatagctttctttttctttcattgacaaatctctttcagatctctagctcatttctctccctaatacttctttaaaaaaaaaaaaataagctgttctgattattctatttgagcttggtgttgctttgggaaacaaaaatcttaaaattccttcctgtttcccagagatagagaatttgtttttgtcaactgacgtttagtattttttttcctggctggagaagtgcctagtaatctgtttgtgtttgtcaccatttttttttgattatttctaaatgaagcaaaaataaccctactgatgaactgcacattctctctccttttcataactgcctgttgtcctgggaaaaagaagacatcgtttaaactcatggtctttgaagagatctaagggatttatgagccaaaatgggatttattacatgtttattatttaaaagtaatgtgtatcatagtttttagtcacatgcttattttttagaagtatagtttataatagtttttcgacaggcaattgttttttagtggcctcattttagatcttcccatgagaccaaaatgcatattcaacttactacttggcactttgtcagtgatttgagggttaactgttttgcctgtgataattaccaatattgaaagcactcataagtgttagcagtacttgttacaacaatgctattttaatgtcttaggaaagggttaggtcccaccactgtgagagcagagtgaggggctgtttaaatgggtcagacaaggccgggcatggttgctcacacctgtaatcccagaactttgggatgccgagctggaggttcacttgagcccaggaatttgagaccagcctgggcaacatggcaaaaccctgtctctataaaaaatataaatattagctgggtgtggtggtacacgcctgtagtcccagctacttaggagggtgaggtgggaggattgcttgagctggaaggccaaagctgcaggcttttatatgagaacaaaatgtctagattatgtgctttggtttcagaaagaatctttcactcgttgcccatgggcgtttgagtttacagcgctagtttggccatctgacccttcccctgcctggagaatgactacaccacccttggcagacgctagggtggtggtgagtgaagatctccaggtacatctctgagtttgcacacagttttacagttgatgtttgtgtatgagtaatgaggtcaacctgacacagaataggggtcttttatcatgttctgaaacgaccctgacatctgtggccagttgtgttgacatttgtgtacaagtgctcagtgtccaaatctactttcatatgtttgtctgacaagcattatttaatgtgtgtgtggtttttttacttgttcacattcagttttggcccaagttctagatataaggtgttaaagaaatgaggactgtttggaatgacagagaagttctggaggccgggtgcggtggctgatgcctgtattctcagcactttaggaggctgaggcgggaggatcacttgatggcctgggcaacgtagggagaactcatctttactaaaattcaaaaaaaaaaaaattagccagacatggtagcatgtgcctgtagtcccagctacttggggggctgaggtgggaggattgcttgagcccaggaagttgaggctgcagtgagcccttgatcatgccaccgcacttcagcctgggcaacagagtgagaccctgtctcaaaaaaaaaaaaaaaaagaaaaagaaaaacaagttctggaaatgggtagtgatggtggttgcacaacattgtgaaggtacttaacgccactgaattgtacacttaaaaatgattaaaatggtaaatgttatgtgatgtgtattttatcataataaaaaaatttttaaaagtaaggaaagcaagaagttggaagtagttttgagtttttctgaccagaggaagcatagaccccattctttcatttcattatccctggtctttttccttgaaggtttattttcctcttagaatacaagagtctacattactcatctttataagtcattctttctatttttcccttttccatggacttgttcagttatgtcccaaggaaaatctctaggagagtggcagatacaacataccctgcctaggaataacttgagatttaacagaaaagttgcaaaggtattccagagaattctcatatgcacttccccaagtttcccaccaccattaatatcttacattaccatactatgtttgtcaaactaagaaattgacattggtacttcactgttaattaaaccgtagattttaccatttttctattaatgtcctttttcagttccaggatccaatccagggtactatactgcatttagttgtcatgttgtgatggctttttaaaacttaacggggctcagatgtcttagttgcttctccattgcctccagcaatcagaaccactctgtttatgtgcattattaaaactatgttgctacactctaaggattcgagttcattttgtcctattcattcttgattttcaggaaatcacatctctgccagtagtacccttttattctcactcctttcagaaaattcctttggaatggtgaaatacagcctctcaaatctccagtgctctgtgtaagtggggggtcccaagatgtaagatgggtcagagctctttttagttaatttttccccaggctgtttctgagaaatgactcagcagcaagatgatgatttttttttttcaaggagccaagctattctgaacccaaatcaaaatttaaatttgacaatctgcccaatttatatgattatctgccagataatcatataaacagataaacagattaacagatttcttcacacctatttgcatagggtggattaaattcagtttccctcttgggatttcaagaggataagtaacttggagagaagattataaatttgttaattgaggaaattgacaggatgtctcatacccttctccttgacttgcttccttgcttccttgcttccaggaaaacaaacgtgttctctttgttttcttccttcttccctggttattctttctttagctccttggctgtttgttcctcttttcaccccaccctcttcatggtggagggtcccaaaattaaattcttaacccttctcttgctacattaatggagagctcatttagcctcatgctttaagtaatacctgggagactgatgactcctaaatttatatctccagctgcagtccagaccgttctcctgcagtccagacttcagtatatatattcaagtatatatgtgtgtgtgtgtgtgtatatatatatatatatatatactcaactgtctaccagacatctcaacttggatgtcttctggatatgtcatattcaacatatctgaaacttgaattatctttcttcccccctaagcctgtgccacccaacccttccccatgatagttctggcaaagtcatccattctcccagttgctaaggcaaagatccttggagtcatcttcatctgctttcctccttccacaccccacaacctgttcatatgaaaatcttgaaggttttaccttgaaaatataactggaacccagcacttctcactgctgctaggacactgttgccaacccactctgagccatcatcatcccttgcctggaccacttagatgggcttctggctgccccttacagccagagggatccttttaaaattcaccagatcatgtcacttctctgttccacaccctccacggacttcctctgtcattctgagtaaaagccattgtcttcactgtggcctgaatgtctatactatccatctcccctgaggctctccaactgtgtcttcctccctgcacccctctgcactgagccccggccacagggcttctttgcatgccctcagcttagggcctttgcatgagctgttgttccctctgcctggagagctcatgccctggatgagcccggtcccttacctcctggaagtctttattccaaatttcacctcatcagtgcagctatcctgaccaccctcattaaaactacaactgtctccctgctgcccctgccattcaccttaccctgctgctgtgtttcttttttccttttcttttcttttttttttttttgagatgaagtctcactctgttgctcaggctggagtgcagtggtgtgatcttggctcactgcaacctccgcctcccaggtttaaacaattctgtctcagcctcccaagtagctggaattataggcgtgcaccaccatgcctggctaatttttgtatttttagtagagatgggggtttgccatgttggccaggctggtctcgaacccctgacctcaggtgatcctcccacctcagcctcccgaagtgctaggattactggcgtgagccactgtgcccagcccttttctttctttctttttttttttttttcaagacttcccaccattgggcatactctgttaggtgctcatgcatgtctattgcttattgtctttctcctcctattagattgttagctccacaaaggcagaggttttgtcacttctatctattgatgaatgctaaagtatagtacctgacacagtagtagtgtggtccatatttaatgaatgaatgagtaatgaactgtgaaaagtgctaggaaggaaaagtaagaacacaattatagatgataataacagatcagtagcaggtaggatttgttgagcctggatgttgtacctctgtgctaagggctttgcttctttttgtcctatttaatccttacagcaatgttaagaggtagctccgtataatatcccattcattagtgaaagaaactgaagcacagaaagtttaagtaaattgcccaaaggctcacagctggtgtattacctgcctctagttagctctaacaccggtagcctctaactaataaatctattggaattatcataccaagttggggatggcgagtgatggggaagcatattttattattagtcatgctctcctcagagtgtctttatttaattggagagtgcttagtgttaatttccagataaagtaggttgggggggcttttgctgttagttaaccctgtgtacgtctccagaaatgcattctgtgttttctttttcttactgtttaaaaccagatctctctgtcctttccaaaagtggaagtcatctggacttctgtccaggggaagtttggtggtttcccatattcttttccaggatgatacaatgacatggccctttggggagcatacctggtatttccactaccccataggaaggtggcaatgcctgctcagctgggagtttcaggttaatgcttcttccatagaaactagattgatagcggaatatttattcctttgtcctgtggtatcttggacaaccaggccacagccctggaggtcacttctaggacatgtccacttctgtctcccaggatagtccttgccctcagggacacagaacactcctcacctgatggagctgctttcagatgtctggctggattttgtgggtttgggcctaggcctggtcaccagtgggtggcctgttctaagcatgaaactgccatgtcttcctcctcaggaactgtgttagttttctgttttctttttttggtattagttttctatgctctgtaataaatgataacacatttcatggttcaaaatggtacgtatttattatcatatggtttctgtagtttatcagggttctttgcttcagaattttatcaggctgtaatatcagtgttggctcaggctgcagtctcatcagaggctcaactgaggaaagccccacttccagcctccctcagtttgttggcaggaatcatctccttgtagttgtaggactgggatctctgttttcttgcagctgttggccagggactacccacaatttcttgccatgtggctctctccttcttcctgaagctttcttcttcaaagccagtaagggattctctagctcagagggagtcatataacataatgccatcacaggagtgacatccatcacctttaccatgttttattgagtaggtgcaagtcacaggccctgcccccactgaaagggctggattgcacaaaagtgtgaacaccaggaggtggggattgttgtgggggtcatcttagagtgtgtttgccacagcaaccatggtctccccaccaccacctcactccccacctccagtgctgagaagcccagaaactccctctggcagctctatagggctttgctagtggatttaatgctgtttttcataggattagtggcaaggagagagtttctgtgtgactgtgccttctgccttcagctcttcctctgtgaggccatagctgcaccatcacagagtgctgacttcaaggctgggcagccagcatctgtcctcaaggggtttagggatttttcccccttcctctccctttcagccattcttcagtgtaataatcctttcatttcaaattgaggagctaattcccaaaggcaggagaacgcctattacttgctcacctattcccccaatatgcattagatttgcttttccaagaaaccataggctgagatgtaattttccatggttcatctaaaaaatttgtaatgcctatttttcttgatcttttgtgcccctttcagttcagatgtaactgagttaattatttgaagaaatgaaccagagcttcctttcttgttatagaacttcttgttccagaaccagagatggtacttattagattctatgctaaagattattccctagaatcgatctgggctgtgagttgcttacagaccaacttgtcttccttttgttcatcctgtgaatgttgtacttaatggatacagcattgacttatttaaaatgattatagttttttagtctattcatttgaaatctcaatggatatttctaaataacctcatatagcctgtttccatgtaacagaacagctggattttagattttagaaccccctctccctcatcctgatttttgttgtttgagacctcacatggtacgtatgacagtgtgtcttgaccaagtcttcttttcaaaggtctggaatcatctgccttagttcctcttaatatgtcttttgtttggggaggaaatgagaacatgagtctagtctctgaccaagtattaaggcaaaaaggttagggttcagaattggtttattcttttgggattagtttgttccagattgaaatcagtttattgttttacattttgaatgtatgcgccacagtaccctacccttggaagggtatgttggaaagaaaaataaaaataagctattgaagtttgcttaccaaatcacagttgcacacctggggaaaaccaaatcctctttcatttttttcacttttaaatttaaggtgaatcatacacagatggttaatggtagcagaaattgcttttaatgctatataagaatcttagaaatttatttaaaacgttgcagcaaatacacagttagaaactggtgagatgcatgtatctcaggagttcagtgtggaagtgcctgctttatgcattttctggacagtcctgctctcacagggacttcaggggcccctctttggtagaacagcctcataagtgggccaggagggctctgctccctcctccaccagtgcagattagctgtgtacatgagccctggacaaggagctgggagccttggtctctaattcccactccccaataccaccagccacctagaagagacagcacgttctgccagcctttagctgcagtaccactcttgttgccttatgcctggctgggccaaggaatcctcttcaatttctgacacccacgtgatttccactctagtgtcatacaggagccctgcctgtgaatggctgtgaagtggtggaatttcctcctggtgaccacttgctgctggctctcctgaatgggtgcagttttgaactgtgctgtatcacagggatgtctatgtggtggtgctttggaaagcagcccctgtgtgcagagatggcagggtgcgctaggaagcctctcctttgacagcaagactacaggccttcacctcagacagccgtttacacccacgctgttttcccagaatttcttttagttgctcagtagtctttctttaatgcatctttaatttccatagattttgccagattgccctctaaaggggttgaacccttttaaagtcttttaaaaattaatttttaattttctaagtgatataggaatatattcttttcatttaaaaatgaaaacaattagggattatggctaaattcacttttgatcaccacccccacacccataccatcaccacccatccccatccccatccacataagccttccccattccccaggggtacctgctattattggtttggtgtatgtcttgcttgttctttttctgtgccctggcggatataaaccaatgggacatagacattactggagtgagagtttgtgtgtgtgtgtgtgtgtgtgtgtgtgtgtgtgtgtgtgtgtgtgtataacatgtaagctgtattgtaccaaacccatcattctataatgatgtgttttacatgatgctacatcttagaggtcttactatgatgtggatatgtatatattacttgagtagtttccataaaccatttttcatcagtgcctttttgacgttactttcgggaaagaatctggggcttcattaaagacccaatgattctttttaaaaaaaaaaaaaaatattctgcgtctgggcacagtggctcatgtctgtaatcccagcactttgggaggccaaggcgggcggatcacctgagatcaggagttccagaccagcctgtccaacatggtgaaaccccatctctactaaaaatacaaaaaaattagctgggcgcagtggcgggcgcctgtagtcccagctactggggaggctgaggcaggagaatggcgtgaacctggaaggtggagcttgcagtgagccgagatcacgccactgcactccagcctgggcgacagagcaagactccgtctcaaaaaaaaaaaaaaaaaattagccgggtgtggtagtgggtgcctgtaatcccagctattcgggaggctgaggcaggacaattgcttgaacccgggaggtgggggttgcagtgagccgagatcgcgtcattgcactccagcctgggtgacaagagtgagactgtctccaaattatgcaagatattaatctgtttctgtgtgtgcttttctttctcttcagatctcagaaaactgatcttcacaatgaaggctacatcttggaattagattgctgttcctccttagaccacccgacagaccagaaactcatcccagagttcattaagaaggtgagcgctacagtcagggtaccattgaagaggtttgcgagtgttcccctgagtgaacaggcaggtagctgccttaggacagatcagccacactcaagaggccatgcaagagctgtgacctaaacctttggcagccccacagggaagcagccccctccagagctgactctggaacaagatggctaacccctcctccccaggcatgcaggagcccgggtcctgtcttttccagctggagtggggttaacagctgacagacctgcaggcctgcgccgggactcctttcaaaccctcatggtaatgtgacttcccagatcccaccttccttttatctatgggtcttcattgccgcaagcccccttcccttcctagtgtggaagcatgccagagtcctgggccacccacattcgaacataccagggaaaactgcgtagttgcagggaattcatatttcttcatgccatatgaggttttgtgcctaactgtagggtctacttgagttttaatatgacatttactacagaaggaatgtcctagccccaaattggggctgagttcactgcttgatgcttatcttgttctctcttacccagtgttccctagtaatcgacaattcccccaccccatacaggtgattgtgatttgaggtccaatcagccaattagggaatttgttaataattattgtcagctgtcagctttgggccaggaatagtactagatgttgggatacagagaataaaacagccgaactagtgaaccatatgaggttttgtgcctaactgtagggtctacttgagttttaatatgatatttactacagaaggaatgtcctagccccaaactggggctgagttcactgcttgatgcttatcttgttctctcttacccagtgttccctagtaatcgacaattccccaccccatacaggtgattgtgatttgaggtccaatcagccaattagggaatttgttaataaatattgtcagctgtcagctttgagccaggaatgtactagatgctgggatacagagaataaaacagccgaactagtgagtgttaccagcagaagtggccggggctgaggagcaaggggatccggaaggtacttggagctgagatgggaaggatgacggggtgtctttggggatgcggctgtgctcggacaggtcgggaagccctccaaacagggaacagtgtacatgagggcctgaggcaggagggagtgaggggaatcaaaagaacgtcagagggagagtgagggtcgggagaaggggccagagacagctgggacagggctgtaaaggcagcgggaagccgttgagaggaattttgtataacagtaaaatgattaggctgtccctttaaaggagatttgtttccttgctgccaccctcccttcaacatgtattgagtgttcaggctccagggactctgggagtagccgctcatgtatgggtctatggcccatagaccaggagccagatgatctctgaggtcagaatttctggtaattttactaggatgagggaggctctttctactctggtagaattcagattattatttaagaaatgggggaggggggaagtagcttttgttcacatacgcataagcctgagaacacaagtgttttaataacgcatgtagctttctatagaaatagagctatctttgtttggattgctgcaaataatcaacttgtatagggacatcctagaagtggaatttaccctatgatccgaataccaggaaaaaatcattttagaaatggttttgtaattaagactcagatgcttggaatatttgaggggtaagtgagtaaaagaaaggcataaggctctgcccactctcaaatatgctttttaaaaacatgtgatttgaggctgggcacagtggctcagctggtaatcccaacactttgggaggctgaggcaaaaggattgcttgagctcaggagtttgagattagactgggcaacatagtgagacctccatctctgccaaaaaaaaaaaagtctctttaaaaagccgagcatggtggtgcttgactatagtcctagctactctagaggctgaggcgagagaattgcttgagcccaggagtttgagaccacagtgagctatgattgcaccactgcactccagcctggctgacagagtgagacccagtctcttaaaagaaagaaaacatatgagttgatatgagttggtgactttgtcttaaccaaattaggttattgcatggctgacccattgcagtggtcctgtctcagttcttcaggaaacagcccgatttgcgagctactggggtgttgtttctgtagtacccaagtggagatgtccatctgtccagtgggaaaggccctcaaagttagggtttttatgccctgaaggacattagccagtttttatcttaacttttatgccagcattctttttttcccactgattatagatgtgtgtatgcacatgtgtgtctgatgattcattagataatttatgaagtaaatgacacctgctcattctgtgtttgtataagtccttaacactgtgtaggttcttagaaactgacttttagtgaaacagcatacagcaggtcctcaatttcattcagtgtcatttagttttaaccttgagaagaaaattggtttcatttgtcattttgctcaaagtctcagtttccaagaacctattgacaacattaagtgaagacttatagtaagaattctgttcttaacgttttgaaaataataggctttaaagcccatcgtatcatcctgttcctgtcatacacttggtttttaaataagaagacagactggacagcttgtaaaccagggcagcagtgagatttctgacccgcagtgtctccagatgtctatcccagagttccatctctgttcctctaaacagaaatgtggcttacggtcattcctgccttggaggagccaggtgtgttgaggttgccccaccgtttgcccccgcattgtctgttagtggacagggctggacttggaaagacctagcatttctcgctgtcattgctggctgtggctttagtttctagtccagttgccatgacaacaagaagtgggacaaaataatgggactgggcccccttctccctgctcctcttttctgttgctggccataatttctaaagaaaataccacctctgtgtgcaaagagcagaggacaattccacgtacctctccaacacccgtggctattccaactgatggctgaattttacatgtgtaaatttttctgtcatcacaccaggtagaagaccacaggtgcttcccaggaagaagtatgctaaaaaccatttgtggtttttttcactgcaaatatttaatgaatagctttggccctatttatatatatgtagtggtgacacttgttaattgcagctcagttaggtcaagatgaagctgtgtcattggccgcctcaacttgcagtcatttttatctgggtcattattttgtgtgaaataatggctcccgttcctatgacaagtagattgatcttaggatgagatggtaattaactcgttttgtcatagtaccatcatgcaggacaggttcatattcttctctgcatattagaattaaactcaaaaggattagattttttcataagaacaatgccccagtattatttttccaccaaatgttttaaattagcagaacctttggatagaggacacggatagaaggagggagagaagatttcattatttctcacaattaggaaaagtaaagtcatttgtgtctgtgtcatgtaaaattagctgaagacgccgtaatttatgcctctctccatcatgacttttcagagtgtgaagggagttgtgtaaagatgatgatgactccattccttttggtgtggccagtttctctgagtgctctagctggtcaaatgaaatctaccttactgcattttgttttctcctgttgtgtcctgctgtgttccatcctattggccctttatgtaagttattatggaccacagaacatttaaaatgcagagctatgggcagacttggagagacttgttttctaagtcctagagccgaatgctcgagggatgaaaaattgagaagctgtgagagagtgatggtgctgccagaattcctttgggacgagggctcaaccagcccatcaggtgcacctggagactgtgtggctggcaggtccgtgggggcctctggaatttcccactcctcagggctcccagaggattgtaaagcaggcagagtgacacagaatgaacagcctatgtgttcatcttcaaattgctgttcattcatgagagcgtctatgggaaaggtctacagtttggagagcactttgaagttttcagtcattgtgcacgttttctggcatgtacttctggtctctcaaaagttccatttgagagaccagaatggcagtggagtctcccttctagacaccaggaaactaagctcaaggggcagagggctttgtccaggggctggaactgctaaatgatggagcctggattagaccctccataggagaggcacgagtgggcagccaaggggcttcagagtggccagaaggttctttggctaggtggactggagagagcttcggagaggtgtggaacgagggctctgcaaagtgaggaactgagactggaggaggctgagaggcaaggtgggcagctctgtgccgttgctggcatgcacaggagcatgggttgaaggcataaggctgaggaagagccaagtcctgtttgacttgagtgtagcttggacaaaagagaaggaaggctgttctgggtgggcttcctttgattatgtggagcagagccttagtctggcgagctctagtgagtcaggcgggtttactgtaaagatgtagggcatggcatggagtcccaaggaagaaatacaggaaaccaggagaaaaacaaaatatatgtatattgtgtatatatattatatattgtatatatattatatattatatatattatatattgtgtatatatattatatattatatatattatatattatatattatatataatatatattacatattatatatattatatattacatattatatatattatatattatatattatatataaaatatatattatatataaaatatatattatataatatatataaaatgtatattatatattatatataaaatgtatattatatataatatatataaaatgtatattatatattatatataaaatgtatattatatattatatataatatataatatataaaatatatatataatatatataaaatataatatatatataaaatatatattatatattatatataaaatataatatatatataaaatatatattatatattatatataaaatataatatatatataaaatatatattatatattatatataaatataatatattatatataaaatataatatatataaaatatatattatatatatatataaatataatataatatatataaaatatatattatattatatttatatataaatataatataaaatatataatatatattatatataaaatatataatatatattatatattatatattttatatataatatataatataatatatataatatatatattatatattatatacataaaatatatattatatatatattatatattatatacataaaatatatattatatatatattatatattatatacataaaatatatattatatatatattatatattatatatataaaatataatatatgtgtgtgtgtgtgtgtctctgtctctgtctctcatatgctgctggcccatgtttgtgtatctatggtttatttaaatttaaaataagattttactctgcagagggaatcctcctcatgcgttaggcaaaccttatgctgaagtgctcatgtctactctacccttaaccctcatctcatgcctgtgaagacttatcctcatttgacagatgaagaaactgagacacagagaagctatgcagtttgccaatgttataactgtgcatggcaggactgagatatgaacccagcctgttggacccagggactgtgttctagagcacttggccatgctacctctcctgtatagcttgtccctttctggacagaggtggaggctgtcagagccagaatgtgaggttgagcataggaggcaaatggccataacgcgtgttgggtacatggggtcagatgttggagtgccttgaaggtgtcccctcagtgaaggatgggctccaggcccttgccgcccaggttctgctgatggaaattgcctcgtcctgcctgcgggagaaagccacgctccctgcccttgtccagataagacatggtggcctttgccttcaggccctcagctctgggctctgttccccaagttgactcccttttgtgatggagctcctgacctccctgatctccttaagaactaggttcatcttgcactggcccactgagcctttgcaatgaagaccgttgaggggcggctggtcccactcaatgagtgtactgtcctggattaaaccgagtacattgtccttcagaaaaccgaatgatgctacttatgcctcaacctaaagaaagcaccttgacagatggaaaaatctcaatggcttcttttaatgaaacagaatatcccaaatctccgggatgatgaaattttgcctgttatgtaaatgactcatcatttactttctggctgattgttgagtattcagagtttcatttctacaagtgcggtgcagagagtctaattttaattagggtaagatgccaattcagagtgaaatgaaaattatgttaaaaaggctctcctgtgcttgctgcaccagaacccacccacaaaccaagagaatagtgacatttaaaaaagatgaacctggggaggggggttgttgaggggaagtaaaggcagaaaatggagtgtcatcccagcaatgagtgtgtcttcagagtggaagacagtgagctggcggctggcgcaggccttgcagggggcaatggggtaccctgcttactgttgtgtcttcaggacttaatacataagcgtcgagttaatggatacattgaaagagaaagaggaatactcactaaaccttcgtgtcattgaaggagagagaggtgccaaggatgacacctgggtgactcaggtgtgagatggggtcatctgtaaggaccaagaacacagcatgaggagccctgggggcagagaggtgatgagaatggggatggttgtatgaagacttgaggggtcagggggacactcagggaacattccagaaggcagctgtggttgttgggctgggacttgcaagaaagccaggaacagagatgtgggtgtctgaggtgtcaaccctgagagcaggcaagaatggtggtaaggatggtcatccagtggcacatgcccatctcaaggggcagtttccactgagcctccgctctctgatgcctggtggaaatatggacccaaaattgcaagatctgttgtttggttgggcacctggctggctttgttttagagaagttaagtttatattttcttgtgaggtttcttggtttttcagcgtaagcagacagatctattaaaaagactgcaagatctagaccagtttgtctcacgctatctgtggtgaaggaccagttttttgccaattcataacagagatatactttggtaaaatccagagaaagaaaaatagcacttttccaaggtagagggaggaacagaagagtgtgatgttacagaatccaggggaagagcatgctttgagaagagatggagaatagtatcaaaagctgggaggaggtcaagtgggaggggcccaccgggtttggccactggatgccacgggtaagttttgcaagagcagttgtcatagtataaaacaggcagaggccttcctgccatgggcttaagtaaatgtgtctagaaggacagaagagcagtttactttaggagatttgagatccccaccccgtcttttttttttttttttttaacacggcttcattccgttgcccaggctggagtacagtggcacaataacagctcactgaagcctcgacctacccaggctcagatggtcctcctgcctcagcctcccaagtagctgggattacaggcgcgagccaccatggccagctaattttgttacagacagggcttcaccatgtggtgtcaaaccaacaaggttttaccaggttggtcttgaattcctgggctcaagcgatcggcccccattggcttttcaaagtgctgggattccaggcatgagccaccatgcctggaagatttgaacatttttttcagctgaaaggtattgggagagaagaggtgataaaagatggaggcaggttccaggcagggcgaggtgggaggggcacaaggtaatgggcatcccctcctttgatgctggcaggggagggaggaggaaggttacaggcttagatgttcctaatggaggaaaaaatgcaggagctactgcctggaggccgctgttttcttatgaagttcctctcccaccctggcctctcttgatcctctgtcctcttgctatttttattagcctgtgatcttcctgttctgtccagagaggttcgctgaagttaatttaagccggagggagggaaggggtcatacgcttgtctcaatcactccccaaaaaaggagatactttcttgtgcttcattttctccctctgcgggaatctactgtccagcatcagtgggtcaggtttcgttcacatttctttgaacagatctttgctggtagtgtttgggaatactttagtaagccggtctaggtaatgccctggacacgtgaaacttagagtctagctgagggcacagacacagagcagatgggcacatgagggttgtaggatcacagatgggtgagcgctgtcgagtagaacatggcaaggggcctgccccaggctggcagtgttgggggagtgctccatgaagtgtacataccaagacctgagggtcaacaggggagggagggtggaggtggtggggactcctggagcagctcagacaaagccaaggtgggagggagtaagtttggtttgaggagcagaagggagttcactgtcttgcctgcaaatgacagaggggtgagtgaggtggagtgaggctggagagtgagtcgggtccccatacagccctgcaggccaggctgaggatggggccctttatcctaagtgtagtgcaaagctgctggagggctttcaggagcagctggagaatgattcctaaatgtatactttggaaagatcagaatggctgcaggttagtgactggcttctgggtcaagagtgggtgtggttaggaccctgttggagtaactcttcatagacaagagatcgtcacttagtttaggtggagcgtcttgacagagatgtagagaggtagatctaagaaatattgagccaggcagaccaccagggttgcttctggatggggtaacgaggcaccgtggagagggagaggacaaggctggtttggctcctgcagttggattaatgggccctttgctgagataaggatgactgcagaatgagctgtggcatctgtgcttcaggagctctgtgcagagatctgggctggagacgcctgctggcagatggtaactgaaaccacggtcatggatgaaatcgcccaggaaggaggggagggtgtgaaggaaaaaggccttagggctgagcccaggggaattccagcattcagagaaaagaaaaagtaagtagccagagaggtcagtgtgaaacttgctgagtgtgggggatggaggccaggggaagagggcatttcagcgatggaggagttatcagccctttccactaacccctaagactaatgtcagaaacagctattgctggagtggccatgaagtcactggcaacctccacagaagcatatttttgtgaggcatgatccaaaatgtttttggggtacaattaaaaaccgctgccatttatcctatagaggtcttgtgtgtttttgccttagtcctaggatagttctgaggttgtttttttaaaatttaaaattttaagatgttcttttttttctcatgggtttgctgaattatcttcattgttctccttaatataattttttattgagcaattggttttaatatctgaccagggaattagatcttgcccatgtaaagcattaaaattttatgtaatttttagcatttggagcacatatcatatgaaataataataaaatgacttatagttaaatcagaaagaaataacaacttgggatccctaaaaaatgtgcacagaatagacaagtggcctattgttagctctgtggacagcctgtggctgctgtgaggcctgtactcctttgtcgtcactgcagagaaattaccccacatccaaggaagtaaaactattctagagctagtgcaggaggcagatgaccagaggagaagcagaaggtaaccaaggggaggtggcagctgtgtgaccaggaatgctttgttccagggagagactgggcctgggcataacactctgtcatctcaaggtgactttccagccacccaggggatgtctccattccgcttgttgctaggaggttgatggtatcaaggctgacatgactttgcctgaggcctggtgttttgggttgattgtaggccaacctgggagctcctgaaggtgaggggtgagcagctgcttctcccggacctggctgtggccatggggcacctggatgttactttgtccctaccctattgagatgggtcccaaggtagactggcagtggatgagctggggcagcccacagcttctggcccctgttgtctctgaaccattcttgctcacagcagacactcatgtttgtttttggccaagagtgaagcctaaagggctgaagatttggagtttctgttttccatccaagccaatggctcttgattgcaccctccctggaatgctgctgggtaagagttttccttctccagtatgtttcagaggcacacacgttgtaagtaagccctcttggagagtcatgatgcttctttttttttttttttttttttttttttttgagacagtctttctctgtcacccaggctggagtgcagtggtgcgatctcggcttactgcaacctccacctcccgggttcaagccattctcctgcctcagcctcccgagtagctgggattacaggcgcccgccaccacgcccagctgattttttcgtatttttagtagagacggggtttcaccattttgggcaggctggtctcgaactcctgacctcgagatccacctgcctcagcctcccaaagtgctgggattataggcgtgagccaccgcgcccggcccatgatgcttcttaaaagagtcaaggctctgaagaggtcccgggtgcaaaacttgcttgcttggtttaacttggcattcttcaaaatgacctgagaactttctcctggcttttcctcctctccaaataccgctctatttttcaaggtgagagaaagaaagaaaaaagaaagagagagagagagggagagagaccgagaccaaatacctatctataccatagcacatacttcggaaaatgtaccaaatcaatgatgaatctattgaccacctaccaaccatggaaaaatcacaggtagtcagtggggtgggcgggggtgtggtcagtttcttctctcttttctatttatttttaagttttatttttattgtacatatttaaggtttacagcatgctgtttgatacacatagtgaaatggttactgtagttaagcaaattaatatatcttgcatagttaccatttttgcggtaagagcgcctaaaatctctcagcaaatttccagtatacaataaaatattattaactgtagtcctcatgctgtgcattagatctccagacttattcatcctgcatatcttcaatttcgtaccctttgacctacatctccccatttcctttctgccatagtaaccagtgttttattgtttctatgtatttgatattttcttttttttgattccacatataagtgagatcatgcactatttttcatttcgtgtctgccttatttcacttagcataatgtcctctaggtttatccatgttgtaaatggcaagatattttttaaggctgaataatattccattagacacacacacatatacctcttacaatttttcatccattcatctgttgacaggttttcttctctctctctttttttttttttttttcattttgagacagaatttcactcttgttgcccaggctggagtgcaatggtgaaatctcagttcactgcaacctctgcctcccaggttcaagcgattctcctgcctcagcctcccgagtagctgggattacaggtacctgccaccacgcccagctaatttttgtatttttagtggaaacgggatttcgccatgttggccaggctggtctcaaactcctgacctcaggtgatccgcccacctcagcttcccgaagtgctgggattacaggtgtgagccactgcgctcagtcctctttttaaaatgagtactaatcctggctgtttacaaaagtacaaaattgccatagattcaaatgaatctagtactttattgcattttcttggttccattaaaacaaatcttcctgtcccaaacatttggtgtaactgtgtgttttctaatcctcaatgaaacctctaatggagggaaagatttggagcagagcaattaaaaactccctcctctcttttttcactctagaaagacgtgctcggcacttctgccattcttctagtgtctttaataacagatatagcaatcttctaacacctagcaaaaactaggtcaattggatttgttgacagtgtggaattgtagatagaatttgctgtgctgtctggatcagccccgggtaatctgaccactttctctcaagaggtgcactagctgagctaggatcacgctgctgcactccagcctgggtgacagagaaaaatcctgtttctaaaaaaaattttttttaattctaaaaatttaaaaaaagatgcactggtttctccctttcctttctgctttctcatatttctcctgactcctggactttttctgccatagctgttaatcagatcttcaaatatcagtctttccaggtttgatttttctttcttttatctctcccctgaggtctctgatcaaaaatggcattttattccttagcaactctgtcttataaagtgaaccatctatgtatattttaaatctaatagtcatgttaagtaaaaacaagagtgaaattaactttagtaataagtcttatttaacccaatatatccaaaatagtatcttttcaacatataatgagatattttactttttaaaaaattttttacaagtttttacaggtttctttcaaggcttcaagtgacatcaggttttcacacttataatcccagcattttgggaggccaaagtcttgaaaatctggtgtcacttaaatcacatctcaatttggatgctaacttttcaataattgaagcgaaatattctacaaagtaaagttgtacttaacagaaaaatatttcatattgctttcattttaaaattaaaattagaggcaggaggattgcttaaggccaggagtttgagaccattctgggcaacatagcaagaccctgtctctacaaaaataaaaaataaaattagctgagcatggtggtgcatgtctgtaatcccagccactcaggaggccgaggggggtggatctcttgattccaggagttcgaagttacagtgagctatgatcacaccactgcactccagcctgggcaacagagtgataccctgtctctttaaaaaaaaaaaaattcagctccttggtctcatgagtcgtattttaagtgcttgataaccacatgtggcatatggctactatcttggacagcatattttagtagaattcatttatttaaacaattttcagtttttcataatttctaagttgatacaaagcatttgtgattgagtcttctcagtcataaggggaggcagagcacagagcaatataaggcatatatgccaagatctaaaagacaagctcctatttttcccatgaaaaacatttaaaaagtttggggccaactttggcatataacatttgaggaatatatttgaaataatttctgcttataataatttaattgcacatgcatattttaaattatataaattgtataaacttggaaatggtgcttttcccctgtgtttaaatctcatggaacaattttatttctgtacttttttttcatgtattattgcacttggttgcctttatcatcaccagcatgattttcagggctatctaacacagtttcaagctcatcctatttactttcttccaaattgtttgggattcagcacttttaaaattcataaatgatgctatctctggaaattctgtcctgagtcataagtgctcagtcacataacattaggagagttgatttttcttgtccagctcatatgtcaataagaaatctccataatggaaacacttcacattgctcttaaaaaaaaatagaaaacacctctttttattgaaaataacatcaatacaggcgagtgcataaatcataagtgtacagctcaatgagttagcacaaaatgaacacacctgagtaaccaacactcaagaaatattaatagagcaggagcaacagcctgaacccttcctgtagccacgcccacaattccccactccccttccaagggaagcctctctaacttctaacaccaaagggtggcttcgcctgtttgtataaatggtgtcttttgctcagcactgtgtctgtgagattcatttatgtcacagtggttcattggtgttcatttgtgtgtagaattcctgcattgctttgttttttgtttgtttgtttttaagggacagggtctcactgtgttgcccaagctagagtgcagtggtgcagtcatagctcactacagcttcaaaccctgagctcaagccatcctccctgctcagcctcccaagcagctaggattacgggtgtgcaccaccacacccagctaatttttttaagattttttttatagagatggggtcatgctatgttacccaggctggtctcaaatgccttttctggcctcaagtgatcctcccatcctggcctcccaaagtactgggattacaggtataagccatgatgcccagccctgcattgcttttttaaaagccatctttaagaagattgcctactatagcaccccaaattgttttccatgttgtaggaattattttaaatttttcttagatttattttcctccttaaaaaaaagtctggccgggtgcggtggctcacacctgtaatcccagcattttgggaggccgaggcaggcagatcatgaggtcaggagatcgagatgatcctggctaacacggtgaaaccccgtctatactaaaaatacaaaaaaattagccgggtatggtggcgggcacctgtagtcccacctacttgggaggctgaggcaggagaatggagtgaacccaggaggtggagctggcagtaagccaagaccgtgccactgcactacagcctgggtgagaaagcaagactccatctgaaaaaaaaaaaattaaaaaaaaaaagtccatcagcttatttcaataaatgtcccaaagtagctttgaatatgttttccccaagaagcatcttgctgttcaaaataaagtaactgagagagtccttatattgtgagagatcttgaacgtatgtaaatgtcagagcaattccctcatttttgagaaataacattttagggggtaaaatccaggagatcactaggttatatccaggctgtatagtgtatgagtgtttataagtggtgtatttcactttctgtcttatgtgcattggagttttatgctgtagttagtgaatattggtcccactcttggcagtgaacataatgtctatggtgcatctatccctagatatctgcttggctgattccttcacctccttcaaatcttcgttccaggttacctcagtgcacctaccttcccacccatctttaagagagcagcttgcctcctgccactccctaccctagtattttggactccctttgtctcctctattttccttttacctaaagttcttgccacctcttaagacacgttactgtttttacttattgtgtgtattgtttcttgtcattttttgtttgtttgtttgtttgatgctgagctcagaataggtcatttagcatgtgctcagtgaatgtttatagaatgaaagagcaagagcctgtgtgtttccaaggcttgcagggcctcagaattgtatgggaacagatgctgtgaacagtgatgcaatgaagataaagtacagagggttaggagactcacacattttctttttttgcaactccaagtagcttttttcagtatctggcatggttgggacttgttgaaaaaccctccctggaagtgacttgtgagggttggatatcacctgttaatgcttcatacgtcccagcagactcatttacaaatatggaatttgctgttatcaccaggaaaatttccagacttttatttatgatatatatatatatgtgtgtgtgtgtgtacatatatacacatataacttttatgtatgtataagtaatatatacttatatatgtaatatatacttttatatagatgtaatatatatttatatatgtaaactttttatgagctggaacatgttttgagtgtcaattatgcaccgtcagtgaacacatggggcagctgactggtttacagcacaggttgaactttcccatctgtgtgttcagaagtgctgaacatcccacctcggtgacacctcctgtctgggatccagcacagataatgagtgtgggaatttgaactaacctcatggcatgtgagggtggggtgtcttgtctgagaaatggagtgtatcctggcaggcagttaggctgcctgctgtatcttcccctgacactggaaggtttcattttaattgcttgtgattatgtaaaatcttttctgagggttttgagaatcagtgtgacagaattacaacccacataaggttttccccttttctgcctttgggagaattcccactcaaagagccaggtcccattaggattggagtcagcagggctgaagatggctagaggacactgcagggagggagaaagcacttggagatgagatactcaattattgaaactgacttgcctcctcaagaaatctggaactttaaacccagttccagaattctctcctgattccagttaaagaaacctactacctaataacttaggcagccatttaggtgggatgtttcactttctgaaattcttagctttcttccccgtaaaaaaaacaaaaaaaaaaacaaaaaaaaaaaacaaaaaaaaaacctttgcactagaatgataatctctaggattgcctatagctctgatattctgtgagtctatggtcaatccagcttttaaatgacttccccttcattatcaaagagccttatttgattagttcaggtttatgatagtggtgtgctgcgtttcggtgccatataccctcattttgtgaatttttctgggtatgtcttagtattccctctgctcttcatccactatggcagtgtttgctgattgattggtaactatttttgtcctcccacttaactaacaactgtaattggagctcaatataagggctattatttttacaaagtttgttttccttttaaggttaaaaataaacattgccttctgacactccagtggaaaaaatctgttgtgagaaaaatctaaactttaaatgattcatttgtgggatcacttttgacttcttatgtgtttaaaagaatgagaaaaagggcatattaccattataggggtggtactgtattctatacatgtaacccaggatatgtaagttggacaaaagagtcaagtattttaataattcattattataaatttagcatatgaaataatgagaaaatagaattaaactgaggtttcccatctaattaattacttcccaatctacatcttcattctgttagcctgatagcagcattcctagttttgaaaaggtagctggggggagattcgtagtgtagatgttagggatgagggtgatggaggtgttattcattggggtactagtgatggtcttggtaaaggtgatagtggtggtattgatggggtggtagggatgttattgggcaaaagcaaaagcagtcaaaggagctgttagaaagaaagattcttcagagagaaaaaggttgtcatggggggtacagggagtagaaatcagatggaaaacacctgaagagatggaaaaactttaaaagaaaatgtttaaatatattcctggtggaaataaagttagttttttgatgaactattcatcgttcagttggtgtagaaattttgtttccaatgacttcccagtttgaatgagatgcagtgtctactctgactaacttctaagacactccccagagggcaatgacagcttctcgttatgatgccttaagaataacacagatggatatattttttaagtttcaagcacaggagtctctgtgaccctttctgactctgatggtgcctgggaatgtgggcatcattctttattgcttttgaatagtaaagcatcatcattaattcatgctctgtacatttgtaacttgtgataaacaagaactaagcctaagtttgcatacaggtttgctaaaccaattaataatgtaagctaagctgcaggggcagtgtttatttacctcaaggctacctgctttttccagcagtttggatgcaccatcacaaactgagaggctagttacaaattgctcttacctctttattaaagcagatctctgaaggctcactccttcagagcttttgtgttatcctcgtttacatttctgtatatttgagtgtgctgctaactgcatcttttataaaggatttagattttacactttacaaaatcattgcagtctggtatttcctgtgggtatggattagtgacgatcactgtattttaaaagatgtctattgctgtgtaacaaaccaccccaaaacatattggctttaaacaatagcagtcatttattttgctcacaaatctgcaacttgggcagtacttggcagaggcagctaatctccatttcacatggtatcaactgggctgtttggtggtagctgggggatctactttcaagatggcacactcatatggctggcaagttggtgttggctgtaggcctctcgacagactgcttaaggcttcctcaaaacatggcagctaggttctaagagcaagcatcccaagagaagaaggtagaagttcatggaattctgatgattataccttggaggtcacataagggtccttttcacctactcattggttgaggccgtcataaggacccatagtggttgaagtacaggggacatgggttccagctcttgatggaggagtgacaaggttccagcagaccatgtggaatgagaaatattgttgtggccatctttggaaaatacagtctgccacatacatgaattccaacatgcttatgttcatttctggttcattcttctactaggagagaactttgagaatacgtaacaaataaaaatgaaggcgagaagtggaaataaattcagtattgaatataagggttattggacattgaagataatctttaaatgtataattctcagtagttgttaatgcaaagctgttccttccctcccccccgaaaaaaaacccatctcctatttgttactcaaagggatcacatatcttcatgtgctctgaaactctcttaaatcatttccatcttccagaaaaaccatcccagtgttctccagggtatttacaaaagaacaataaaacattcatttttttagcacactgtaatgaaaaccatccccaagtacttagtttaactgccttgtttaccgtgggagtttcaaatgtcattaggaccctgttatatttttgttggtctggagtcgtgggaatcacaaagtattttttaaccaagggttaaaactaggatagcaatgcccaatggcaccatctcaacattttgttaaagtgtgtttcattaatgctttggaagcctatgtaaatcagaggatggtggggggaagaaaaggtcacgaatactggatgttaaagcagtgtggtgtgaagagaaacatctgctcctggttaaattctttaaacttatgttcttttgactcactcatttaactgtggtgctgagatttgagttcaatgaagactctaaagctggttttccagaatgttccagggagtcttaatgaacccttgagttcttaaccccaagcttgtaattccaaggtcactggtattaccaaagtataaaactagggttgtcaacctcagcaactccaaaaaactgtctttttgttttttgggacctacattgcctcatcttagtgcctttgtgaaacaaggcccatgggtatgcctgattatgaggcattttttaccttgataagaagtagtgatattaacaaattgcttattgctacttcttttctttttcctgaggggaagattgacttggtttcttaagagatggactgaaaacccacgaactgcacattttaacagcaatgctttcttgagacatgtctctggacctgcaacccccttaatgtctctaggcctcagttttcttcactgttaagatgataggagtagcaaatgatgtgcaagttttctgaatctcaaatgaatatatttttaaaacattattggtcccagatggatatttcctgaaattgtagactcatagatgtttccacttgggggtaacctcagatactgcaaatttaatctcatgcctattcattcctttaataaatgcccaaggaatacttactgtgtaccaggaacagttccagatgctgaggacaaagcaggaggcaaaagagacaaactgcctgtcctcatagagctctcatccagctaggaaaaccagttgtagggagatggaggggggaacagcatgccaaacagagggatctgcaaagtgctgaggccccctgatgggaacaaatcttggggtaggggggaaacaatgacaaagacttgtgaaggtgtcaggagtttgggatgtggcctgagaggtgggcaagacccatttcaggggcagggcaagggttgggaatcttattctaaatgggacatcgttggagagttaaaacgagcagccttaactggctcacatctttcagataccagcctggctgctgtgagggctgtatacaggccagcatgcaggaagaaaaccagcagaaaggtggtggtgaggccaaggaagagcatctccaggaggaggggaatgcatgagctaccagagaggatggggtggtgagggctaaaaagcctgtgggatttggcgtcatggaggtgacaggagggctgtggggagctgccggtgaggaggcagtacagaagctagagagtgagtggaggtggagtcggtgaggcgggtgggtggacgaggcttgcttacttctattgttggttggattctttcctctttttcttcttttaaaaaaagataacttgaatttagttgtatgctgagtggaaggagccagtagagagagagagagagagagagagagagagagagagagagaaattgaggatatagaagagagaagtggtcctaagtagagctgggtcttccagggtgccagaaaacatgagctctatggcctgggttttgccttaaccgggtcacaccgatgctggggacaaagagtggagggccagaagaggacatggggatgggcttctcagcttctgacctcgattttgtctttaagtcatctctggaggtggtgggaaagtggggagagggtgggacccagcagaggggagaaagccctggggaagcacaagacagctgatcagggaggaagggagccactgcagggtggccgtgtggcctcagccttggcgggagaccttgagccctcctccttgtggccctgggtggactggatggatgcgacatttgtgggatgtgtcagacagagaaagccaaggatataataggaggagagtgatggaagcagtgggtcatgtgatggacagggaaggaagagaaggaacactcatctgtgtgcctcttaaagcagctttctgggtcttcactgctggtcacactgaaccaggtgaccatatgtcccagcttgttcagacaatcccagttcatgcctgtcatctaagcgtaattattattttactttttgcttcagttgtttgacaaatcagcatcccatggtgtgtcacagactgctgcctctactttttgtctcccgtggacttctcacatcctttcccatagcaagtgtaggctcttatgacctttcccatgagctctgcagttacttccgggccccagccatgtcccttgcctcctgtctcctcgctctgttaccaacccccacctcgatccataccacatcctgtgggcagatttcttttccttaggacaggcctgatcatgtcactttgctcagaagtcatgatggcatctcattgccttcagaataaaaagtccagactctaaagatgcaagactctgcaatctagccctggtatttcccagtacagcttagagtgtaggaacattgcaaatacagcgctgagcagcgtaacaggtagcaacgtgggctctggagccagctgcctaggtttgaatcctacttgccctttactagttgtctgaccttggggaagttgcccaatatctctgtgcctcagttctctaatctgtaagatagggatgaaaaataatacctattgttattattataaggattaaatgagttaatccacgtacagcctttaaaacagtgttgggcatacagtaagctctcagtaaattgtgattacagaatttcagctcaagcacactgaacatttgctcttccctgcatgacttctgaggctttcttgcctcttcacttttgctagccctgcttctcataggaatccttctcccaaatcatttctgtatgcacagattttacctgtgggtaaggttaaatccatggctaccaataatggattttgacagccacagaactaacagactgggaaggctggcatgcattctttgactcccacaggactatgacgaaagtctctttaaatgctttgctaacataacattttgaagtttgatttatcagtttccttgtgggtgtgcagcagcatttaatggaagcctgggggtcttgcagccttggagggggcagcagattctcctgccagttcttttcctcaatggtcctacttggatgatggcagttctcatgggccaaggtcgtctttgctccagaatcctgttctgaatgcagacaaccacacatatgttgaattctgctgatgggcatacactgaggaagattgggatgttctgggccaaggaaaatctgccagaggtgactcctgactactccagcgtgttgactctttgactgtgccctcctggtcagggcatgcatctactatgacaaactactctgtgcaatggaatggctgggggttgcttggtgattccaattggtattcagtaagtagttatggaatgaataaatgaatattagtatcttcattttatagattaagaaactgaggctaaaataaatcaactgatttgaccaataatataactactgagtaacagagccaggtccaaagctttaagccttcaaactctttgtccaagggcagattctaagacctctcagtcgctaaatgagaaaaccacaacagcagaaagtttacatgatctttccttgtggccctaaaacggagctaaacatccagcagcgcctggcaaagcttccaatttctgcagctaagtgttaacatgtcaaaactaaaggcggcttcagatgtgagctcaaacccgtgttatttttgagcctcccttttcagaaagctgtacaagagtgtaggtgacaagatgggaagggttgtgtgtgtctgataaaatattcactgtaaagactcatgtgtaactgcaacccagaatggcatttttgtacctgttcttgacacctagggcatgcctctgctgtgggctccctgcgtgtgctgtgctatgttgtcacggatcgggggcgtgtgagttatgagggagggccggagtgggcagtggtctgatctagggtatataagtatgtggatgtgagtcttggatttaccccatattatatgcctcagaaatcactgtcaaaaactctattattcagtattttatgtgatttattatgctctatagcagagctacccaatagaacgttctatgatgatggatatgttctacacctgcactgtccatggggtcatcactagccacaagtggctggtgggtgcttgaaatgtgactcatgtgactaaggagaggaatatttaaattttattttatttgaattaatttaaatttaaatagccacatgtggctagtggctacctattggacagcacagctctctattttttagcagtaggtttctgattcccagcattaattagctcattagttacaggcatttcattaagtttattatgtaacttgtagaaaataaatccatcagttatagatacaacctcccttacctggtgtgtagcagctctcctcaaagcacaatgggggaaatttcctttacctgggcaacagtgatggctgaaagcctccctgccacacttcagcctctcacgtaggacctggaatcgataccagatgaagtcctagttgtcttgtttctgtttggggctcactgtcatttgggagcctgtaccgaacttttatttcatgcctagtcaggtttagatttagagacctccatcaacttgccctgtgctatcttattttcccctacctcctggtgggaagagagaaaattgattattttaaggaactggctcatgtgatagtgggggccaacaagtctgacatctgcagggcagtccagcagactggacattcaggtaaggactggtgttgcagtctttgagtttgaaggggagaaaacccagggagaatttctgtgttgcagtccagaggcagaattctttttcctttgggaaatctcagtcttggctcttaaagccttcacctgattagatgagacccacctaataatggaggaatccactttaccgaaagtcaactgatagtaaatgttaatcacacatttaaaaaatacctttacagcaacatctagactagagttttaccaaacaattggtcaccatagttcagtcaagtggacataaaattaactgtgacaccatcctccttagagtcagacaaaacagtcttggaagtgtctctgactctttacccatgctatctactacaggctgtggacactccaatccctattgacctgtgagcaggaggcttttctcttccttttcctatgttccatatagccttcatttttatgaaatccaacctgtgtctcacttctttctgatttctcaccccgattgatacacatactctaaatcacaaatacgtatattcgcatgcacatagagtatatatcgcacttatcattagcaacatggtattcattttggacatagaaacagacaatccatcctagaaatctaatgtcatattatttttaataaaaataattcctcaaatatataaccaaagattttttttacaatgacttgtgactttttatataactacatttttttaaaaagaaatatttttcacatcatgattcctgattatagttacagtggagcatgtccttacttattatagagcaactgagtgaagttgtggattagtcaaaacagccatgtttaattttcagtgcctcaaccagaaattgttactctttaagtatttggggcaggtgggttcttacaggcagcagaaatgagaataaggtgggtgagggtgtatatcagtttaaacaggcatccacctgggcatcttggcacaggtcagattatctgaagtggaaagagtggtatcgttgaagaggcatcaggttgggcttaggatactcagagcgaaagccaggcatggctttgggtagttctgtgaggtttgaccagtcacagaatgtcttaagcagttttctcttctgtaaggtatgattttgaggcctaagggaatgcatgtgaaagttctttgtagaagagctgtgcaatgttaatagttgctgtttcctgtaatcgctgttgttagagatgttgtgggcatgcgtgggagtctgtggggagctccatggctgaggtgacctggctcctcatgacctgttcttccatgttgatttggttccatgctcatgaagaccctggcatcgcctgaggtcatggtgatgtccagcaacagatgatgagggcttgaaataaagtgagcttggatggtcactttatggagaaggaggaagtaattccagaaacactgggggataaatgtggtagggtgtggtgaacagacacacaggattagaaacagggaagaagatactgtgattccagctggtgagaccagatcaacagtggacccgtcagctgtgatcgtcttctgtgtaggtctgaacttgcaaggaaagccagggctaggggttcacacttaggaataatgaacatctgatttgtagctaaacccatgtgagtagaggaagtcaccaaggggagtgtagagtggaggagagctggcagccggggatgaaccctgatgaatacatcgcatgcccaccaccatgatgaatgtgagactggctcagtaaaggttataaatgcaagaatgagaagcaggatttactttagccataagtacacggtcaaatgactttctgaaaaagaggaaagtgtctatactagggtaagacagaactgtaagagtcgtggcccctagatctagccaaatattgatcttcataaaatctaaatgtggtcgtctagttaaaaaggactacgcaccctttttggtaaacaacttggcagcctctgccaagcctttgaaaagttaatatcccttcattcattaattctacttccaggaatctatttgaaggaaataagcagagctacaaatatgcttcctcttcttgggggtgtgaatttccctggaatgcataggataagggcagcatttaactttgacatctttttaaagtttggatcctaggtagcactatggtataagatacaaaatttgtgctgaagttgaaggtaaaagatgagcattcgaagaaatcttgcagttttccctcagactcccactctcctctgctcttgaggttatgactgtggtgggagagtcggatatgctggcctgcagggtgaactgagagcctttgcgggcatggatccaaggccatatgtgatccggtccttgtcatgtctagtcaagcttcatttctgggctcctcttggtttctcatgtcatgttccagaaatatttctagaaatttcctcaacacaccaggctgttgcatactgtcacgcttttgcccatcatgatccttccttgcctttacatggattgccctctccttttcctttacatatgtgctgaactcttattcatccttcaaagccttctgcagagtaggtcccaaataggttttgtctagcatggcattttggaaaaaaaaaattggatttgaatgctttaaggtgaggcatgcatgctccagttctgccacatttcttattcttccttttgtgttacaccacgtcatttgttacatccctgatctactcggagaaacttttctcaacctccccttcaggcagaaataatcaccattgtcactgtcatgtctatgccttcacatccattactatattatcctctatgaggaatttttacaatatttactttttcaattctaaaagtaacatccatgccccttaagtaaattttgaaaattacacagtaatagaaaaaaatcacttatagccccactccccaaatacagtgctgttttcattttggtgactgtttttatgcatagtttatgtatgtgtattacatagttgtcataataaagtgtatgaagtttagaatcttgactttttatatgtcatttcaagcattaattgttccatgatagtgtaattatttttaaactctgttcgtaataattggtcaaatcttcttgagggttggggatcctattttacattcctggtacctaagcaccgtgttggcctggaccagtgtaggggcttattaactatttgttggattctacagctgaaaaattaatgtctccatccctaccttcaaggagctcatttcgggagagaaggcatacatattcatccattatttaatatattcattcattcaacagatatttattgaggacctgctatatgtcagacatcattctattactggggatgcagcagtgcaaactaccccagccctcatgaaatgtgtattctagagcagtgattctcaaacatcaggctgcattggaatcactcggaggacttgttaagacacagattgctggatctcaccctcagagtttctgactcagtaggtctgtggtggggcctgagaatttgcatttctaacaggttcccaggggatgctgatgctctggtctggggcccacactttgagaacccctggcctagaggataaatttgcagtacaagatggcaaaggaatatggttgtctggtttgttgtgggagaagggcaggtgtctgtgtccaagcctctccaattcctccagtcccagtgaggaaggggagggctaggataatgccctgtgtctggagtcctcgcctcttcactctagatgacagcagtctctgcagggccgcagaagcccaggactgataaggagagaggttagagataccgtctttgtgccccatcctttggcgcacttgccatatgtaatgtctaaactaagtttcagtgcaactgcaaaataagtgtgttttcactcattttatacatgagaaaactgaggcacagaaagtttatataatctactctggttcctcaagatggtgagtcacgtatctggggctccacatcaggcctttccaaaagcctttaaacttcatgctatttccgtgactctagttgagactggcctatggttgagccctccatggaagcagttattaaaatgcttcagaagtcatagctgtttcctctgcagtaagagagtaatagcagaagctagtgcaggtgtctcctcatttcatttgagggctgtaaaacccattgcctttctcttttggcatatgttgccagaaagctcagaagtatgctttgcatgcagtggctttcctcagcctccaaagttctttggtataattatttccctgctattttcttttaaaatttgtgttgctgtgccttcttttaggagctttatagaataatttttaacataggtggatatcatagattaatgagggaaaaaattttcagaatggaatagatggctttaagatttttttgtcttttgttttttttaacttttgaagagtgaattgagccaactcggggcgtatgagtggacacatacatgcccatagacatgtatgtagttgatgctttgacatgtgtccactgagtcttgtgattaaaagaatgaactttggcccaggccagacctggttttgcactctggctactcactgcttgttttatgactttaatgtctctgggctccagtgtcctcatctgaaatggagacaatgataccatgcagcatcattgaaggatgaaacgttttgttgttttaatttatgtaaaatgcctagctcaatgcctagacatagtaggtctacagtagacagtaattactactattcttattttatgtctagcacaggctaggatttaaagactggactgcatgtttgcaactgcagttttccaggttgcgcagtgtggaacaaaaatgactttccatttaatgtcagggtggttcttccgaggagagctgtcagggcagcttctcctttagagagaatacctctgtgctggcaaaactgactctcaaatgagggtagattatcattgcagaggcctcaagattttctgaggtcatctgcttagagcttggtgactaagacttagacagctctgaggtctgcaccgccttatttatttgtaaaatgacttaagcatccttgcctggaaagtcccctaaaggctaccttctggctttggctggctcttgctttattttattaggttatttattttcaatttttctttcaaacttatgacttacattcaacccaattgccttgggctattttttagggagagggaaagttcaagtacctcggtactgcaggtgggtgttcatcccccatcccgttggtacagggagtgagaaggaaccatcacctcgctgctgatggtgtggaccaggacttggagagccaagagtcagtctgtggctgtgggctgggcatgatctgtgggctcctttgaccttccctaagcctgagagcaccagggagcaaggtgtccatcagatgatacctctcagggaggatttgcccacagccttggcacaggggtgattttcccacctctgcccttctctgccaaaactattgtccaaaaaggaagctctttgggccataaaatgccatctgttgtttgtatatggttatatagacaagctgtagttatacagtagcctgatgggcaggaagtcagtgattcgtccgaaaaaaagtgacaaaaaaaactaaactcttaataaaacaaacttcctccttcaaactctttgtttagaactttttccagcctctttaaaaaatgttaataaggactagtgtagtgtttcaaagtagtgatttcaactcttcaaagccaaatgctttatctttccatcagacaatatagttaaaacaaattaaaaaaactgtcttcttcagactagggtgtgggggcaggtgcccctgaggacatggagttcctgtcagcttggaattcttctcctgcacctgaaacagcctcgcaggcctcggggaggcgctttgcacgctgcacgtgtccctttgatagaccatttcattcacttgtttcccttccttttgtttgcctcacagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggagtaagtatgtcagcaatgggagttttgacccacttaaagagcagctaacagcttttcattaatccccatggtatctcagagaaaaaggaatggaatttagagtgtagagacagcagtccatcaaacaggagaaactttatcaagcagttatctgtgccacctgactgtttacttactgaagttatgacttctggggagttcagaaccacatgaaattgacttgcagtttgctccaaaatgtcacgtttgaagtggattctagactgtgagctcttttatctcctgtgctctcgaaattgcccttgaattatccagttttcacacaggaagtgtcagcctgccaggcaccgatgaaaacctacacaccacctgttaaaatacttgcctaaagcaagacattttacagctgagcaaactggggtttagagaggaaatttgttgcccagtctggaaataggcagttcgggcatatgaacccaggtggacttacccaccatcccttcacgcctctctgcttggtctttcctgtgtgatagactaacaagatttgccgaggcccttaataagatttacagggagcaaagtttccctccgtttctctgtatttcctttttctctactttcttcaggaaatcaaccatccatatttccccctttctccaggaaatctagcatctggtcatttcctgagagcaaggtacttacataagccatgtaagtaagaacaagtatgaaaactaacagaagacccccagggcttaggagggctttctgtttaggcctttctggatgatctccctggttaatattgttattaccatttatttacgaattcttgaatttagcctcttacaagtgataatgaacaggtggtgcttccagaagggaaaacaaggagaaacagtttcttttgttacatcagaacttcttgagaggaaaattatgggatggttaattccaggggcttatttgcaaagttgatttagagggagatattggagctgcgtcagttttgtgatgtagtaagactattgtttaatcaaggcattgagccttcttagtatgcactgaagtagagcccttcatctgtgtgatttttcgctgtttgaggcacatgcctgctgccctcatgaagtagctgagcatgcatttaagcccagtgtgtcgtcctcatgaacgcccaggtcttagtccagaaacctccatcttctcatggaggctgggctggatgtgtgtgctctgaatcctgggcaggaagatggacctcactggagtccttctgtacggtccaggactgtgggagggcgagagtcaggccaggcagaggcccccaggagaaagggcaggagtgatggagaggtgaggagcatggtgctcaagaatctagagtatacattccggcctgccttccgtgcctcagtttctcaccctttgaaatggggatagaacgatagtttctcatggaaaggttaaagttgtacatttaaagcactcggcactgtttgactcatgagtatgagctgctattattggggtacaggctcagtagtcctgacactcgacctccacctctcatggaatcctggctttgagaaaggaggcagttactattgaggtttcctcagtagctttcagatgcttcctgtgttccagagcccaccttcctccgatactccttccagacttcctgcctcctgtgagaggattattcactggggaaacttgtccaaggaacttccgcaggtgcccaggaccttcttgctaccccgtggccactcaccttcctcacccagaatctcccctgatggctgaacacagaaaaattgacacccaaagcatcttggcccctatcccatcacccaagtccctgttctctcctggagaaacagaccctgctggggaggaatgggtgaatgtgtgtgtttctggaggtggtcagcccaccagtggatgagaatttcagctctgcacgggtaggccaggaggagggattaaagcctccttcgagcccagtctccctaggcaggtaaacactgcctgtctctacacataaagcagtccctttatctctctgctcaggctgcgaatctctgaaatttaggcagctcactattatcccttttccctcctttgatggaatagatgagcttttgggtttttcatacagggatcatttcacatataagcctttcagtggtcacgatggcagtcaccctccaagtgccctattctgtgtccttcttgtgtcatctcagtaactcctcacaacagctttatggcagaagatgctattactagatccattttacaaatagggagtgtcaccttttatacccccatatagttaaatttctttatcacagcttgagtatttggcctccctgaaggctgaacgtccagggaccctgtccttattggttgtgaccctcacctgacccccagcctctctcctaatctttctcctaggaagcccactcactgtcactcccccacaggcacacacgggcccccccaggcacccctccccactgcctgctcagctcccagcttgccttctctcagagccccctaagggagggtgaagtgttttttactcctcttctgccaggtgggcttaaataggcaatcacagcaagacaattaaaaaaaatccagagggagtctccctcctcttccctccttctcctcagttaatttatttcctttataggaggccttggggagaggaatctaggcaatgcctgctcagacaggactttccagtggattctccatgcggaagcaggggcaggtcgtccctccccatctctgcgggctcggtgcagccgtcacgcctccttgcccctgcaggttcttggggaggcccgccgtgggttcctcttcctgctcgctgacttatttcctggtctgggggaatttccttttggttggaggtccgtgctgtgccgtgatcacctgagcctgtgcagggacagcctcagtgtctccgttgccacagcttccatcagagaaaccaggaggctagacaggttcacgaaaattctaatcattctcaccgtcaccaaaataacaagtcttccaagcactgcccttcctaccctgcacctcctcacttaaaatgcttagaaatgtcagccagaaacccaagcgtgtgatgccaatcatgtttctggctgagaggattttattcagtagccctccctggctgccagctcattgtgaatggccaaaacctgggggttgggctttcctgatgtgagggctccttccctcccaactcccttgggatagttggaccccatgatgcggccccctcccagatctgccacctgccgccatctttctggccttttactcagtccattaacaaacagctattgagctcccacccacggtcatcagcccctgccttctgtgtcctgatgaagttagcctcttgttagatttgggaaagagcccagggtttggggtttgaaagactcttggctgtgccacttactggcttgtgatttctgggggatccacttagcacttctgggcacagaaccagggccaccccctctcatcaagtttgggagagtcacatgagatggtgaaggtgaaaggcccttgtaaatatgggacacatgcctgtggctgctgtcatgcttgcaggtggagtcctgtggattgttgtgcacgcagcagcggtccctgcactttgcctttcctgctgccctggcaagcgggcctcactattagtacctgctattagtacccaagccttagcgaagcttgagcagccttgcccagatttaggcatctggatggagcagcctggggcccttctaccctcctgccctgcctcgccaccatggtgcccactgcctcccttcccaatgcaaacctttctgcttagttccttctgcccatgacctcagcagcctgcagtccccacccagcttggactgcccagccaagtgtgatgcccacttgttccttccaatgcagctaatgaccagctgcctcctcctcccacatctagcccttggagccccagattttcacccaggctctaaactctttcttctctccagaccagaggtctcctgggacagcagggcccagccagtcccctgcttaccctcaagacctgggctctctggggccccacctgcaggcaaactgcagccttccatcctgtgccagagtccccacgcccaggtacagacctcagggctggacagctgcctctttcctccccactccctagtagcctggcaaggcctgaatggaccaggctccaaggctggcaggactcagccacccccacccttgggccccatgcccccttaacctgccctcactttctcctctggttggcttaggtcaatacggtgaacacgtgtaacaggagggatctaaatgaggcaaggtgggggaaagggagagatgagaagacagtccaaatgctccttgggtgctctgccagtacagtccttcagccactcccagaacattctcaaaaacaatgccttccctatccctttgggacttaccatcccatgtctggaaaaatcttccagctggggtcatggcagagtcacagagcagctgagaaaatttaaacaaacgtggggcttctttttggaatctttggtgcttgctcacgtgaggatgtgtgttggagaatcagaatattaaaacatcaaaggacatcacttttggacagttctcttggctggtttccatgtgggtagagaaaggactggagacaaggagatgatggggcagaggagcgtacaagggttatgcatgtgcaatcaggtttctcccaatatttcattgctgctgatgctttggaggctcttcgttccaacactgtttccttttcctgagaaatttatttctgtctctggcttcagtctggccccctggggaggatcaagccgggaaagctgtcagcaccgtctaccttttctgagggtctctgtcttcctccgctacacccccagcattctcacttctcctttggccttccccttttcctggttcattacgcatttgggaaagttatgtttctgtcttgccattgagtgggagttccttctgtgtgatcaagtgttaccatgtagttttggactttggccacttccaaattccccacctacttctcccacacagaggctgtgatttttttcttcttcttcttaattcatttgcatttgtgcttgactgtagcaggctgtagcgagtggtgctatggcccatgttggggtcacctgtggacagctctggccgagcccaccgcttccttagcctctctacctgcagccattctcgggaatgggccctgaggaattaatgattcaggagtgaccttcaatttatggggataaatgtcccaccttccttgcccttggtgggtgaatctgaagtgtgttttacacagtgtctcagggtccttgttgggattgagccctagctgccccagtggtaacatgctcttcagtgcactcattcactggcatcatctccagctccttcctgttgcccattcctactccttccctctgtttcctgggatcacttcccaaataaactacttgcacaggaaagcttgcagggtctgctttcgaaggaatccaaataaacccaagaactcactaaaaccttgcttatcctcttgccctcggtagctgcagcttttaattgaacccctgacacccaggactggaaaacacccaatcatctagttcacctcctgcccaccccagccccaatttatggccggattccctccattacgaacctcctctgtgtcgctccatttctaaagtttgtattgtgaactcacaaactagtctagtgactgccagttctatacaccaagacctaatttctggtgtgaaagtacttcctggctggagatggcttcctgagtaagcaggagggctgagaaaagcaacttggcgtggggatgatgaacaggctagaattggtgtttaaaatacaggtggccacttccaaagacgggcaccttccttccctaattgttctattggatggaaagcctgaaatggctgctgttcattcaggtattgctgatgacaaagtaatatggcccagcgttggtccctagagatctctgctggtgttcgctcaggcggggctgtgagaagactttgtgacctatgtgagataattttagatgttagatggatgaacatatttggtgttaatgtgcttcatcattaccccttgtttttggcaagtggtagcggactgccttcatagtcatgaaacaaagtttcctttttctaaaaaaatgtgtttgtttaaataaaggaaagtgagtcaattaaaaaaatcaactagtacttggataccacaaaacattgtgagatactgaaatctgagaaacagcatcagagagtgtgggtccaggtgtttcatgcagggagcatgaatgtgctttgtccttcttgctaatgtcaaccattgtttatgacctttaaattcttgcttcaaagaagggtggggattttcttatgatttaagaagatatttttggaaaccaaagcatattcctgactagcctgtgtaagcaagactttttaagctgggtcaactgattgcttgactaaatgaggagcacaaaaatagactctcagacttagattgaaattccaggtatttgcttctggaggctgctactgctaagccacgcccagctgcacgtaggcagttgcggctcagctgctgggtggcagtgattattgattgctgaagaactgagctataaatgaaggaaccaaaagctcagcgcctcatcccctgtgccttcttggctgtttggaccgacctgccactccaggcaggaactctcatttacgggaacatatttatttttacatatcaatgatgtatttttgatgtacttgattaagtattatgggttcagccccaggaaacactactgcagtttataaatagtgagttcaggagtgtacaaggttcctggaattagagcagtatttttgtttttatgtgtctctgtacatttagttttccaaagaccattctcacccaagtatgtctgcttttatttctaaaacacatctttgtatgaatttctagaaccatctgctatgttcttttctcaaacacctagctgtgcctattaatcgcagataacagctattcattatattccagattaaaaacctaagttccccatcagaagcccaacccttcaggtccatgttactttaagccagcctcaacttattacttggaatgaggctttattatctggcaacaatacagcctcacagagatttcagcattcatcatatcatttattcaggctcctgagagattccacttaagccgatgaaacagatttttatcatcagttgacctcttctctctccactccctttacaaatcccaacagaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatggtatgtttggaattcacagtccttgggtggccctttgtgaactctgcttctaactcttgaaatcttagtccctcttcagagtctgcttcattcagaaagctctgcagccgataaccatgctgcattttatttctaattaacacatcttgaggaactttccataaagcccagggcctgtgctctcaaaacctctctacgagtcagccaggtatcttctgaaatgacagagaaagtggagtgattctatttcatcgaaggtggcctcagtctctgttgcttttaaaggcttttaaaaagattgttccctggatttgttaattaccccctgggattgtggcattccaaagtgcaaattgtttgtagacactattacagtttgaagtagcagtagcagcaccttgaaattaacagcagagaaataaattgaacagcctggtttctgtaagctccactgagacacacactgttcccaggtctcccagcacccagtaccccctccccagtaatgtgctgtctctagtggtttgctgcatgggatagcactattgatgtcagctctcctaaggcagaaagtctgcccacagtgggaaaatgtgtcaaacaaagaaaaggctttaggttaacgagaaggcaagttgagtcaccagggtgtgtcaagtctgggaggcaacttggggagtgggaccaacgtgccagcacgtgcgtatcctgaggactgccagtcagcaggattcctaagtgacacataacaccaaatttgtcaatcccagcaaaacctggcagggggcatcaacagcgccgtgtgttgttgttgagctgttttctctcaagaattaacagagtcacgaacagagtttggattctacattgtttgcaatccttgaaatgccagcaagcatcctgagaatagagaccattctgaattctaaatgaatgtactttaaatcatccaaagtcttagaacatgatacagcacagacagctcttaattttggatgcgagtctctatctaagtatcattgactaatattgacacgttatcatagtagcagcaggcattgtatagtgtagtggtccataaccatttgttgaatgcatgaatgacacaagaaaggtgattggcttgttaagaatacatccagagcagggctgtccaatagaagtgcccatgatgatggaggtgtttgttctgtacctgggttgtccagtatggcggccaccggctgcctgcggctactgagcacttgaaatgtggatactgcatctgaataattgaattttaaaattcatttaactttcattaagtttaaataactatatgtggctagtggctagtgtcactggtcagtgtgtacttggtcagtgcagttctagaatatacatgccttttttttttttggacagagtctcgctctgtcgcccaggctggagtgctggaatgcagtggcgcgatctcggctcactgcaagctccacctcccaggttcatgccattctcctgcctcagcctcccgagtagctgggattacaggcacccgccaccacgcaggctaatttttttgtatttttagtagagatggggtttcgctgtgttagccaggatggtctcagttccctgacctcgtgatccacccgccttggcctcccaaagtgctgggattacaggcgtgagccactgtgcccggccgaatatacgtgtctttaatacaactaatgtagggttacttctgtgccctggtggcaaggtgggtaacctccctctacacaaggaagccctccgtgggtacttacaaagttccccaaagccaggggttgtcacggtctggtttcagatgcatcataaaacaccagtggcggtacatgcttggggccaacttgggacagatgtttacagcctgacatatcagtgtcagagaaggccagggaggaacctttggctccctgtttcctgcagggacaccacattgcccatcttgggttgtggcaacagtggctcctttcatcccctctcggtgcccatagatgctatctgtggccatgcatagttttacattcctccctaggaaactgatggttagttgttgaaggtgtgcagagaggtgctggagatagtggatacacaggtggccacttggaatttcttcccctcttaggaaaactagggcatcagaaggaaggttttctctttgaccccactgcctgagcatgtcaggggccctaagacctccaagaaagaacacttggaacgttcacaaacccatttgctgttcctctaccattatggtttggtgatcaaggctgagttagcctcctctacttcccgtcaccccactcttcaacctggagtccagaaatgcagacaacttaagcagctttttcttcagatttgacttgagtgtttgaaatactgttatagcctcccttggctttaaccacattaaattcattcttcctgccctgaagacagaacatgaaatttcccctggcaagcgcaaccgtgaagtcctccacagggcccaggcatcttcctgtatgcagcccgtatcttagagcgccaccatagctgttcatctctatgtcagggagggctgcacaattctcagaacaaaatgaattgaaacccactctgactttaaacaccatttcaccctttatatgtcttttgggagggagagtatgactgggagtaatgcttcctgggttagggcgtttctgctctggaaaagtccaaggtttccgttggccagggatgaaatacgtgtgtgatcttttcccagaattaagaaaaaaaatggcaagctaatcgtaatcataagaggaacctatttctagtgagataattagtgtccttacaaataaagctggcagagctagaagcacatctttaagctgtttgccatctggaatggcactagtcacgactcctgaatagagatttatactccaaaatattttccacagggtcataaagctcatgagaactgtgtcccataaacaaggtgatgtttcagcctgaattacccagtgcagactccagagcttctgttcttgaggcattactcccctccccatgcctcccaccctgggacatagaaagacttgtacagtcctcaagtttgggctcctgctcatggtgtccaggactcctctccctgggtcgttcattaaaccttagaatgacccggtgtcttgggctgggggaggctctgcccgtgggctctggcaagcttagggcacagaggaggggcatagtgatgaccatggacacctagcggttgctttgtgtgggtgctggtctcagtaattcaaacttagcattgacttcatcctcacaatacctcagtgaagtaggtagttatgcctgtgttatagctgtggaaactgaggcacagagacattatgtcattgtcaaggttactggctagtaagagcaagaaggtggcaggaagaaagaagggggtaggcagacaaaaggaccatgaggtgggcgggatagaaaaggaaagacgtggctatgctggcaggagttgtggcccccagcgggactttggcggctctcccggtgggacgaggaggactccaaggtcactctagggaggtggcaggacccgatggaagcaagaatgagtccaggggccacatatagagcagccaggcactcaggaacatgtcggccagtgagatgaaggccagtttctctatttctagaggatgggaaagaccaggaggagagaccccgagctgagccagctgttgtggaggagttgggtgggagccaggagtttggggtaagactaaggctgcccacccctgaagacccagcgaggaggctgatttttcacgaaggcctctgggcctacagaatggctgctgccatcaccagccactgaggctgctgccgctgccaccatctctcttgccctgccttgcccagcattcctctggttctgtcctgtcccccgcctccaactaccctctttgccctgccttccctgctccacacccctgcccactcctgtcctcgttcctcatacccttggcctgtgcttgccctttcctaccctggcagtcctccacctctttgtttcagaaatggcctttgcagctgattatccaaaccagaatctactccagtaacagtcggtgtttgcggtgactgtatcctcacttctctttttgcctagaagagcccttttttctttccctgactgcttgaaaggaacctagcctcttattctgcagaatggcctgcatgatggtttcatctggtcagggctcatggtgtcattgatcttatatctccagcctctatttcctgtaacctggaagttagttctaaggccttgataagttaagaattatgacaagaatacgttccaggcaatgtgttctccacactgcatcacataggggtcacatgacacccagatgtctctctgctgccacctttttaaaagattaggtctcccttgagactttctccggtgccccagctgcatctaaatccaagtatcactttgtatgggtatttataccacctttttttgacacctagcatatcctccatgatcatatatttgcaaaatacataagtaaaacacatgtacatgttttaaataaaatatatattaaatatgtggggtatatattttatacagacatactcgcaaccaaccccccaggcaggtcctactttttgtactttcttaacatcacagtgctgtattcagaaggtggctaatgatagttctggatgatgctcaataatgccagtggtggtgagggaaaacactgatattggagtgtttccccaggaatctgcaggttttagggtgggactggtaaagagggagaatgaagtagtaccaggtgtttctgatagccactcccttgggacaccacccacctccaggaatgtctggcctagtggttacaggcagggcttctatttcaaagaagccacttaataatgtaggggctaaattgcacgtatgccattaaatgcattttctcatgtgtccataggacacctttaaaaaaacttttattgcagtttagcacacacgtaaaaaactgtacagatcataggatatagctcagtggcttttcacaaggtgagcacacccatgtcaccagcacagagatcaagacgtagaacttaacaagcccctagaagcccctgcgtgccccacgctgtttctatccccccagagtaaccacagtccctacttgaaacactgttgatgagttttgaactgtacagactttatatacttgtcattgtgggattcattcatatttttacatgtaattgaagaccattttctctcattgctgtgtgctattccattgtgtcaaatacacagctatatacgtaacttagccatttacaagcatatttttatttatttatttattttgccccatataggacagcatggcatctgcacagatgtggccccaaacagaagccctaagcccatctcattgtgacccaactgaaatctcaccctaaccaccgaggcagagagagtatggtgcagtggtcagaaaacaccagctctgcaagggtagaaacctagcctgtctagcacctacccccggtgcctcaaacaggatctgcttcaccatagtagtagctcaatgtctactgtggaaaacgagtaggttttaggatgaaacaaatcacatttcagatctggcttggcccttgaactccacatgaacatggactaatcatttaactcagttgtctacccactaaaagggaatgacagctcttacagaattttggggaggattcaatgaaaagccttgaactgcatctggcagagtgcttccacgtccagctaacactgaatcagaatgtttcttccctatctggtcagttaaatggcgctgcaacttgcaagctaacccttttctacctgaagaggagtaatatcttttctagattattcattgcctcaaattgagaatgtaggaaggcaggccggcccagagcagcagtgagtgttcaagaagcaagagaaggcagcagccttgctcattctttggttaatagagcaaattagctgcagtgtgattgggaagcaacatggcaccgttacctgggattggttgagcggtgattacatttgccatgggatcacatgtcatatgattgcatgtgcagttgggcttacgcagttggcgattgctaatcctggaatcaaggtggtgccaagaatcctggaatcaaggtggtgctgtgcgacctctgatggagagaaggcgccctcagagagccaagaggatctgttatgccagctagtccagggtggacaatctggtccagtctagcttgtttaaaggagaacagtaacactttgtctttaaccctgcaaaaatagaccaaatgcattgaccgcttgtcatggcatgcacattcaggctagactttggcgaagcacagcaccctggggctgagcctgaaggttagcttgatatagacagtcttaatgtctcagaggctgcagaagagtggttgcctcacagaatttacctcttgaaataatatggcaaatctccttttcccacatccttcttgtaaatcataagcttggaatattaaggtggccttttgccaaaagaccagcatcaaatatttatacagtacgagggaaaatagctttttgtgcacagtagggaagcatcttcgctttaataaaaaatgcagtgataatggaatgttttccatagacggagggcagtttaacctttttacattggagccttcactctaagataaacctatttatacccaattcagtgcacattatagtgaggctgagccatgaaggtaatgaggagacaaggagtggacaaggccgtcaaaacaagcgactctttaaaagcccagctgtctgctctctggttcattgacttttttgctgttacagataaccagattttgatagccattctgaacttcagcctcatggttaagtaggtgaatcagtgctctggattcagaatactggagcattaggctgaggtggggaggctgggaggcaggcagtggatgaggtgggtggtgaataaggatctgggtgtgttcctccttcatgccctcaagctagccgtagctttccctgcggactacacagcccccttcccaggcctgtgactcaggaggaaggagaggaagcccagcaggggatggagaaaaagtctggatgggctgtgagtgtccccttccctcttctggacctcggctctgccatgctcgccatgggcaggctaaacaccatcatataatttatgttgaattaagcacttaagtactgaaagcacatggcaggcacttttaaagggcttagaggttttccattgagaagatctgtatgtagaggctttggaaatttgatataacttatttttgtagtagtcttgaggaaatgtgtgctgtgttgatacaatcctgatggaatcattgagtgtcttctggtctcaagcatgcccaggtcaggatttgggagggctttactcaaaggggtctcttagggcatccctattgtgataggggctccagatggactcctggagtgttacccaggacttaaaaagtaagctggactatggtccatactcaccttggaccccaaaatacttgtgatgtgatttagctgcagagcagctgtttttccctgataacctatgaaacatgtctcttaggaggccatggaataagcacttgggaggaacatttcagcaaagcagatgagagaggcaagcttagcatctgccaaggctgtttgataacagactctcaggatgggaaacaagaagttggagtgtgttattggtttacccatagggctcttacttgaaatggagaactatcttatgttgggataatatcaggataaggctgctgtgcttattaccttacagccatggtttgttgaaccggttaggccttcctattattctggaatgaggacccaagctaagcaaagtacagtggtcttgtttttaggtctaggttgtgcattgtgtcagtcagctattgctccaataattctgtgtaacaaaccacttcagaactcattggcttacaatggtaacaatttactctggcagattttggggttggctggagcagctctgttgaggcagaactggtctcagctgggctccactgcggcagctctgctccatttgtccttcatctccctagaaccaactggctaactggggcatgccctctcaatgtaatggccaagacacaagaggccaagttcaaccacacacgtgctttttatgtctctgcttgcattacacctgctaatatcccattggccaagcaagtcagatgaacagagccctaagtggctggcctccccaccagtcaatttagtcttaaccaccttctctcctgattctgctgctcacctggtccttggctgtccttcgttcactctgcatgtcaggctggctgtcccttcctcctggaactctcaaaccctgcagatccatgttccttgcttgcttagttcactcgaagtggggagccctaccctgatgcctctttcaaaaatagccaccaccactgtgtccaccttcacactctccccttggcccacttagtatttttctagcatgtatcacctctgacatgatgttattgtcttcctcctccactgcaaggtaagcttcatgtaggcagggactttatcttgctgcttgtgagatctctagtgactacaggactacttggcacataatagattcccagtaggtgtcataatgaatggctggaaggttattcagtgcacttgaactccagtaacatgtcactcacccttctgaggccctatatgccatttttagactcctctaagggaagtttttctatttagattacactaaaatcatctccccatagttttaaaaaactctttgattctagttaggccttcaagagccttgtagaggagagaaaaaggaaattctttgtcatttgtgttgtccatttacttgtgttatacctgtattaacttgttaataacctcacagaaaaggatataaaagaaaactcaaattatatgtaattctaccacttataactgctgctagcattttgtgtatttccttaaagtttgtctaaaccattttaacataaaaatccatattgagctcatgtggcagttttatatcctagttttttctccataatattgtatctaaagcatttttccaaatcattaaattcccataatatttttagggacaggctagtattttatagaaatctccaaatttaactatttttctatggttaaatatttggattgttgaacatttagattaagtttttaagtaattttataagtaatgcttgtagatgggtatttgatggcattggaggttattacctcatgatagacaagaaaggtaagatttctgggtgaaagagggtggactttttgtggcaagctcctgcaacattgttaaattgctttctataaagattgtacagttaaaattcccttaagcactgtaaacttttgcatatcaccatacctttaccagcagtgaaaattttcttttcaaaatttgtcaccttgctaaataaaaaagaagttgaggcctggaacggtggctcttgcctgtaattccagcactttgggagtccagcagtccgaaactagcctgagaaacatagtgagaccgcatctctacaaataataaaaaattagctggggtggtggcatgtgcctgtggtcccagctactcgggaggctgtggtgggaggatcacttgagcccaggaggttgaggctgcagtgagccgtgattgtgccatggcactccagtctaagagacagagtgagaccctacctcaaacaaaaaaaaaaagaaactgcaatttttttcaatgtttactggccatggaaagataaagagaattaattaattgctttatgtcctttgtttctaatggtgtttcagtatttttaactataaaagctttttatatataaaaatattaagcttagcctttatttttgttattgttgttgcaaataattttctcatgctgatgaccttttgtttatggggtctcttgggagccaaagctaaagattgttatatattcacatttgtcagtctttttctttgtgacttctagaaaatactggcagttccaggaactccagcatgattcaggggactttctgaatttgtctcccttccctccccatgaaaaaaaaaaggtcacattattatggatttgccctattaaaaattgtccttttaaaagagcgtatcattgaaatgcgctttgtttgtatgtttactaggactgtcataacaaaataccacacactgcgtggcttaaacaacagacacttattttctctcagttctggaggatagaagtccatggtcaaggttcccacaacttcagtttctggctagggctctcttcctggcttgcagacagccaccttcctgctgtgtcctcacgtggcttttcctctttacacacgccaggaaagggagagagagggctctggtttctcttcctcttctaataaggacaccagtcctattagactaaggccccatcctaccctagttaaaggaggactaggacctcatttaaccttaattaccttcctaaaggctctgtctccaaatatagtcacattgtgggttagggcttcaacatacgaattttgggaggaaacaattcagtccataatattatgattgagcagtgtttatagcatcaagtctgggaaccaagagagattgtccataatcccatagatgagagacctagcccttgaaagagtcacatcacctttcatgatagagcctagcttcaaaccacttgcttctaagtcagtcttcttcccccaaatcccttatcaaaatgaacctaggacatttaggagccatgccccaaacaaaggggcaaaaggtgcttcccttagtgtattctatagggtcaaggactctgttcagtatttcttttttttttttttttttttggagacagaatctcgctctgtcacccaggctgaagtacagtggtgctatctcggctcactgcaacctccacctccccggttcaagcgattctcctgcctcagcctcccaagtagctgggattacagccataccctgccacgcccagctaattttttgtattttagtatagatagagtttcattgtgttgcccaggctggtctcgaactcctgagctcagtgaatcctcctgccttggctcccaaagtgctgggattacaggtgtgagccactgcgcctggcctgttctatatttctttttaccctcattgcctaagatagttcttgatcatgctatacatttcatgtatacttgtcgaattgtgcagagctcagaacctggtacattgactagagcagcacccagggaaacatttccagtggtaaattatttgggaaaattccctctcccccacattccacctcttgacaagagctgcctaagatgttgtctggactgcagcccacatcatgtgaacttccaaaaatcaacgcatctgacaagctcagatctggtgtgttatatctcttccctttaaaaaaaaagaaaaaagaaaaaaaaaaccctcacctaaatatagtttgcttctaaaaactgtctctaaatgactgtgttttaccctggataagttctccccagtgcatcctgacgctggagcatgaaaaggaaggtaaacgtgtgaaatcaaatggtgattgctaacaatgaaatttgggctcataaaatcaaggatattattcaaaactgtgaggtaaattagcctcattcattctgatagggctagatagactctatggcttgtgtgtgccttctttaattaacatgctgaaaagatgttctgattgggattattaatgaatgcagtggaaatgtttgctgcttagaagacttctgccacagacggtttacagaccccccccacccccgcctttttctttttccacagattccttacatggcttgacagatggagtattcatctttgaagctgtttccacagaagatagcaaaaccatacagggctatgatgctattgtggttgaacaatggacagtcctggaagtaagtgtggggttggcagccccgcttcttttgtttagacagcacttgttttatccgcctgcttgatctgaccgtggggctgtggctcagctgtggctttcttctgagagggagttgacctggtaggtcctagaaggatccccttagtcttttcattcccctcttttcccacccccaggtaggggtgggccccgctcttccctttctgcaagaaaagcacattgcatgtgcctggccatttggtggaaggagagttgtcttccattaatttgcatataactgacaactctaagtgatataaatgaggccacatagtttgtggcctccgttaatactcagagcagcatcaatattggagccagaccctgtggctccctctgcagctatccttagagttatgcacatgagctcacttaatctgcacaataagccttttaagtaaatactgttattgcccattatatagatgaggaaactgaggcacagagaggttaggtccctggtccaagattacacattaaatactgaagaatgtctttgagaaatgttgactcatgaggccaccaaattgctgtgggaaggggaattcctcaaaccacgttctgctgggactttggaggagctaatttacttccaagattcactagtgggtagctgaagggcatttctctaactgcggaagcatggactttttagcctagtctcttgtacacacagtgtctgggatataaagggagaagctatttggacatagagaactgaattcttggttttttttgtttgtttgtttgtttgtttttttgttttttttttttttgagatggcatcttgctctgtcgcccaggctggagtgcagtggcgcgatcttggctcactgcaacctctgcctcctgggttcaagcgattctcctgcctcagcctccagagtagctgggactacaggcacccgccaccacacccagctaatttttgtatttttagtaaagacagggtttcaccacgttggccaggctggtctcaaactcctgacctcaagtgatctgcctgccttggcctgttgaagtgctgggattacagcgtgagccaccgtgcccagccatggacatagagaactgctttctgaatgctttggaagaacacaggattggcattgctgggagggcctctgccaaagagggctctccaggccgagggaagacagaggtggatacaaccctttgtgaggagtgtggggcactgggaccctctagacagccagtgcttgccacacccttgtgcctgccagaactgcagccttgaggcagtcccttgcctggttattgaagtggagatgggatggtggggggtgagttggatgtcccccgggacactattactcagctttgaagctgcagcagttcccagcacacgtgaagtgaggagcaaggctgttggggggcatacctgcgtctgaacagggatgagaaataactgcttgcaagtgtgatagcaatggagtacccaaaggaactggagtcgtcagaagcaggagttggaaagtcacagcatccggggctggttagcgtaggggccagaagtcctgagggaagtcaggaaccaggtgacagcctggtgtgagatcagccccaccagttactcctgtgtgaccctgctgcccatggtctctccagggtccatgctcctaactagaaatgggatgcagaggaagtaaagctcagtccaagatgccaagcgagtgtgggcaggtcctgtcacctctcaggaccctgtccttcctcaacttgtaagctgggcaggtcacatggcccatcacgtgtggtggagtgaaggctccaggtggtggtgaaatatgaaatgccaagagttgaggatctgaaggactgagcagccggcattcagtttgctccgtaacatttggctgtaacagtagcgatgcatggctgcacccaaaacatgtgcctgtgccgagtgattggcaggccatggggatgtgtgtgaaattcctgctgtctgtatattaaaatggctgttaagggagggctctgtggttcctcaaaaaggatgacttgatggcagtgatccaaaatcatctataaaatggttcttaaaaattaatgtgactgcaggaccagtagcctcagcatcatgtgggaagttattagaaatgcagattcttgggccccactccagatctgctgaaccctccgggggtggggcctggcagtctgcgttttagcaggccctgcaggagattctgaggctcactccattttaagaaccagggcgggtatagatgccactcccatgtgggaactgtaccccacaaggtgatggatttgaaaggtgggaccccaggagtgatgaggctgcaaaggctccaccctcatggataggatgaatgcccttagaagagaggctgcagaccactgcctccccttttttggccttccacctttcatcatgcaaggacacctacatggcaccatctatgaggaatgggcctttgccagacattaaacctgttggtcagtgtcaagatgcctgatcttggacttgccagcctccagaaatgtgaggaataagtttctattatttataaattacccagcctgtggtacattgttataggagtaggaatggactgagacagaaattggtaccaagaagtggggttgttgctataacaaatacttgaaagtgtagaaatgactttggaacagggtaatgggtagacgctggaagagtttggacatacaggctagaaagagcctagatttctgtgaatggagtgttagggtgattctgttgagggctcagaagaagaggagagctgtagagagggcctcagacttatcggaaattatctaagtagtcatgatcagaatgttcatagaaatatggacagtaaaggccattctgatgaggtcttagatggaaatgaggaacaaggtattggaaactggaggaaaggccatccttattataaagtggcaaagaacttggctaaattgtgttcgtgtcctagcgctttgtggaaggcagaaccaaagagggacgaactaggatatttggtggaagaaatcactaagcaaagtgttcagggtgcagtgtagctgttcttggctgttgatagtaaaatgcaggaagagagaaacaaactgaaaatggagtttgtaatcaaaagggaagcagagcttaaagattgtgaaaattctcagcctggcttcgttgtcaagaatgagaaagtgtattcagaagacaaaaccaaggttggccaggctactgtttgatagggagattggtgctggtggaaggatgccatatgctattcaccaagacaacgaaaggaagacctgaaggcatttctgagatcatcaaggctgctgctcccatcagaggcctggagtgtcaatgcctgggggacagaactgtgtcaaaggaggtgacttgggcatcctcagtaccttcaggcttactgcccagtgctgtctcaagtttctgctccacgcagtcaggctaacgcagcctctgagattgacatctcctgaaagcagatggaggagagatcttgtgggaagactgtaactccttggtttatgggtttcttttcctctttgcagctggtggaaacaaccttcaggagtcagctcttaggtcacctcctgcagggtgaaagacccctcctctgtgttctcataactctctgggcatgaccctatcacagctcctgttgtactctatccttgttatttgtccactttcctccctccgttgtgagtttcttggtctgggaatattcatctttgttctccaaggcactccagtaaatgcttgctgattgggttgaaggctttttggttcagcccaaggtagactagtgtttctcaaaattgagcttgtatcagaatcacctggagaactttttaaaacacagctatccaggctctacccctatttcctattcaatggatgtcttagtctgcttgggctgccataacaaaataccagactagacggattaaacgacagaaatttctttcctctcagttctggaggctgaaaagtccaagatcaaggttctgggagggtttggtttctggtgagggctctcttcctggcttgcagatggcttccttctcactgtatcctcatatgcccttgcctctgagcacgcacaggtgggagggggctactctggtgtctcttcttataaggacactaatcctgttcaatcagggtcccatgcgtatgacttcatttaaccttaattacttctgtagaggccccatctccaaatacagccaaactagggcttggagcctcaacatacgcattgtgggaggatagaaaacatttagtctttaacggtggctctgagatggggcccaagaattttcatttctaaaacattttcaagtgagctgctgctgctggtgtgggaaccccaccttgagaatccctgtcttaggggaactaagtgtagacagctctgtaaccagcacagcccagcaatgtccagtccgggacaggttcccccgcacctcagctctttgaagaggctccgtcagaccctgacttgggcctgcagacagcccctctcctgcctgcccctctctaaggctgggggcatttttccagctctcacgtcttctacccttgagacccagctacttcttttccccacccttttggcctctgggaaagatttttcctttttaaggcctgagcaggtcccttttggcttctagttaactctgcttttctggtaaccactgtcctcccaggcaggcctataatctctagctctccgaccacaaaacgtccctgcccagctctttctcatgtctcacagtggggactggtctgtccctttcctgcctctttcctcctcctgtgctgatccctcagctctgtgtagatgtgccattccaattccaccctgtctcgctggcttccctctctcttcacgtgcatggacacacgaaaatgtagtgtgcggacagtgcagcacgttggcaagacagcggagattccagagtctggcctgagtgtgcatcctgcctctctgattccaagctgagtgacagactatgtgaaaagtaaaccacacctgctttttctattttcagttgtataaatggggatactggtaacaacctctcaaaattgatgagaattaaaagagaaaatatattaaaaagttgtgaatgtaggactgggcacatagtaagccctcactacatactgctttctgtgtcagtcacctggtatcatcagtgagacagatcctccccccattgccttcgttttatgctaaaagcacagaggaggttgggctagggaacctgtagagtcaaatacaaataattgcattttgctcggttggaaacctacagcctaaaattaaaggcatttgtaagataaatgtctatccatagggcatttataacaggtattttgtttactttctttgagtttacagtctagtatgtgagcagaaagggtaattcttggaaaggaaaggaaaaaactacatagatgaataggtaaagagcaagatacagagaccctcttcttccctctgaatctgtttatctttgagcctgacagcccatcagagcttatagacaccaccaggtgctacctgagccatagagccttttccatgtttatccctctccctggaatatgttctagcatatcagtgcttatcgtgaaatttggtgccagaatggaacataagagagtagaaaaagcacttacagctgatgcaattggtatggtggctggtgggttaattgaaaaagccaattaaagagacccaaagcaaatcagattcctatcttacacattttatttgaatgtaaagtatgtaaatacatgtccatttgccagtctttttgagttgagtgtctgctgaagtagagttctgcctcatctttctcatataaaccacacccaaagtgtgctggctacaatgcccagtgtcagtttctttaaaatatcaatggaatctgactgcagaatccatgttttcatgatttttttttctagtctttctagtcccctcacccaacacacccctaattcagccagttgttactttttagtgattgttctttgctgagtctattcaaggaattcaacttagttttttgagaaacaacttgtttttgcacttatagtttatatgcttttaaatcatttaaattaagacatgtaattaggataatgggtctaacttatatacagcttacccctgaagtgctcagttggtgaggtcagaagggcatgagcatcctagaaagcagctgctacctgcgaggacttgacttctgtcagggtggacttgtatttctgcaagtacagcctcaggtagaatggcttagggtatcattacagcctctgcaaccccgcagactttgtcatgaggctctggagtcagctcttctccactctctgcctgcgtattcaatcttttgttgagttaacccccattttatttcatactattcgcttctgcccatttccccagcctgtcaagacatttctgatcatggatatatcatccttcattctggggatcttccagccttggcttccctgaaggcttcatatgtatggaggctcctgactggtctcaatggcaaacagactggatcaaggacacagtccttggcgcgctgcaggaatctctccaccagtgcctgacactaacccaaaccattctgcagtggattcaggtggccctgttgttccatcttccattcctctattgtatttacatgaaaggctcgatgacacacttttctgtaactgaaacctactctggcctgtaaccctgtctcataatcctgtgaatcctgtgtaataacacattaggtctcacttgttcttcatgaagttctgcaggtttctggggctcaagcttttgctttcaaaggctcccaaccatctctttaagaatccactctaggatttgccagggagtaacatcaatttctatggtttctagaattcacaagggagccaatatttgttctttttaaaccatctggcttttttcttctattgccacagtttctccaagataattactttggttctgagatcatagtctttagtgccaaagacagcagttctctgcctttttcctgtgatagggatgattttcctgtgaataatcactcccatgaaaggcccaggaatcaacacccaaacccctcccaggctgcatctccatcctttcccactgcaaagcaaatcatagcacaggtgagtaacgaggaagtcagaatagcctcagatctactttagcagcgccttcagtactttgacttttatcaaattcttgtgtgccactcaccttgacagttacacacctgtttacagaatagtatgtatggatgagtgccttttcctttaaaaaaaaaaaaaaagtgattcatctcagcttgagctcatttaaaattttcaagtttgcttcagagggcaaactgctaacatctgttaacaatttgaaatgcccacgcccatccatgactcagcaatttcatacttcatgtccatctcttctaaagaaacaaatgcatgtgttcacaagaaggcatagacaaggatattatctcagcattacttgtaatatcaaaaaaggtaataatgttcatgtccatcagtaggggaatggttaaacaaaggataatatattcttattatagatgaggtcattctgtataagctgacatggaaggaattacaggaaatgttaaacgagaaaattaagttgcagaattgtcctgtgatggttaattttatgtcagctttgttgggctatagtactcacttacttgatcaaacaccaatctagatgttgctatgaaagtatttttagatgtgattaacattccactcagtagaagagtaaagcacattacccttcctaatgtgagtggacttcaatcagttgaaggccttaagaaaaaagattgagatcccggaagaggaaggaattcagcctgcagactcaaaactgcaacatcgactcctgctggaatatccagcctgctgggctaccctgcaaactttggattttacatcctccacagtcatgtaagccagttcctcaaaatgaatctttctagatacaagatagcctactgattctctttctcaggagaatcctgatgaatcagatacaaatgctgtgatgccattaatggggagaaaacttcacagtctcttagactttagccaaatttgtctccttgtagaaaagcaagtaaaataggagttgaataatcccatttttattgtcttgaacatacccttttcttgtgcaacttcttgctttgagcatgattttaaatggcgtatgtgtatacgtgtgcacacatgcacatacgtagttcacatacctcatctcattctaggctgaggtgcatgtgtgtatacctcacgccacctgcacacctcagctcattccaggctcaacattcctcctcttttgggtttgccttacttttgtcaccatccctggaggctcaggtacccccttctgtccttataaattcacactcatccatctctacagccacagtggttttccttagttgcctccaacttttatcttagggtgacaagtccacctggagccagcatgcctgtatttcttgccatggggccatattgaactttcctctgagcctctgaaattctttttcttcttgtctctggagatggccgctagtactcttctgctgttaggaacgtcacagagaaaagcttagtttatacagtttgtgttgcccaggtaagtcatttcccttcccataatgatggggaagagattacatttagaaatagtgaccccaaaaggccatgatctgattattgagtcctgacttctgatctgaaactttgaccctgtccttggatagtggagcctgggatggctgtctgtccctcttttacctcttttagccagaattttccctctgcctcctccttggcagcagccacttgctcgggtgttctgaaatgtgtgtggattgtggcagtggcaggacacagagatgatgggctattggaccaaaaccagtcctcctgcttcccagtggggcaggtgggctggacttaatccatgaaagagtacataaaaaatgagaaagaaccacttgagatggtgattaggggttccataacagaaccctcagggaactgggaaactccataggctcaaagagagtgactactttttgatgcccaggaacaaggatgcaaaggggcatttgctgaggccccacacatcaaggagcctcgggaagaagacatcctacaaaggaaatgggaaggcattcaaggctaattgtgccctgctgaccagaagtgccctgggagagagcagagactgaacaaggcctcctggacacagtgggctccagctgggtattggcaagtcaagccaggacttggatgggctaagggaattgagtgtgggggcttcctgctgtgggaagtgacaggagcagaggccagctggaagagaaggcacatctattaatttttttttataattagaacacatattggataatgtggatgatctcctagatgccttcaataatagataatgtgggtgatctcctagacgcctctgattatggataatgtcagtgatctagatgcctcggcttcctttttaccatcatgctttcacctcaaacaggcagcacttgtgcctcttagcaaagccctgctcctgagctccaggagcctgccctgctttaagcaacaagagccacaagtgctccgaggtggtcctcgtcgatgacagaggagtgtgggtgtatgaaagccctgctccctggcctcagatggggacaactctgagcataactcacccctcagagctccccacaggatcagactgagccgctggtcacgggatgttcttaaaattgtgtccttcctgggctgcttctactctgttgtacgacttctcccgctccctcactggcagcacatccttaataagttacttgcacgtgaatacttgttttagggtctccttatagggaacctgacctaagagcatgtgtaaaaaagtcccattgaggaatattacattgcaaatcgagataaaagttattggaggctttataataattttaaacaaaatgcttacagtgcaaatgtgtatatagtaaagactgaatcctcctctctcctctgaccctcaattccctagttcccctttcacagagaaagctccttccagagaggaggtggtgtacacacagaggtgagtgtgcacacagaggtgggtatgcatctgtgtaacagagaggcagagggagattttatacacatagaggtgaaggcagagtagagagttgaaaatgctttgaagattggagtagtgaggccacaagacaagaaatgccagcagccactagtgctggaaaaaaacaatgagcggattctccccctagcctccaaaaggagcatgggcctgttataaccttgacttttgacccagtgatactgattttgaacttctggcttccagaactgtgagaaatttctattgttgtaatccaccaattttgtggtcatttgttatagccccccctagaaaatggatataacatgcatggacgtctctccagggttgccctgtagggtgtccttgacagtatgtttgcatgtgaaaagtctggggaagaccgtgtgggtgaggcaagggcctggatttttgcaatgggttgaagggagccatagtgggattttcatcagagagctgtacactgggacaattggccctggagaaagggccagaatgggggaaaggccaacagaagcccagggaaatagaataagggtggtggtcatgggtatcagttgggttgctttccaccgttcatagcaggaaatccaactaaaagtggcttaagccgtaggggtgttcatctcatctcattgagcaggaagtctagagcaaggtggggaggttgcagagtcagctttgtcaacagcttaaagatgccaccagggatccagatgttgccatctttctgtactcatcctcagcctgtctgcagggctctccttatgatcctcctcacaaggtgactgtggcaattctaggtgtctcatgcaaatgtgatgacaaccgtgaagaacggggcagttttttcctgccacacgtccctttttattagcaagtaaaagctttcccagaaacccacaacagagatttcctcaggtctcattggccaggactgagtcacagacccatgccacttgtcaagagtcatggttgtccaggcctggggggtgtcagtgaggaagaagccctgggccatcgaggggctgttggctttggcagccaacagaatgtgccactgagggggactagcaaggcaggatgctcctagaggtattttcaagaagactggacttgttgacggtttggataatgagatgacaaaaggaagtatttgacctttaatctttatctgcacttttttcttccataaactcaattgtcctattttctcagacagccatatttcacttcatatacaaaatttagtgatacaagtaagttatatctttttaaaaatttatccaacaaataaatattgagttcctactgtgtgtcagccactgtgagagcatgatgaatggatgaaattcaggcaggaaggattgattccatttagtcaagggaaggtgtgtagtcattaaaaatgaatgtgcaccccctggcctttccacattcatcaataattcctcttcattgtcaagcttcctgaggggtgctggaagaccctaaatcataggaaccttttcaatctgacgaggggagaggcaagtatgccgttctggtgaagatcatggggcaaagtgaattttgattcttgctgcagaggaagagaggatgaaacaaatgatcacgttttcaaaatcctgtgacaaatgcggtttaaaatattcagtgtatgccacagaacaacaagaaagaagtgtattagggttctccagtaaaacagaaccagtaggagattatacacatacacatgcacatgtgcgcgtgcgcgcacgcgcgcgcgcacacacacacacacacacacacacacacagagatttattataaggttttggctcatgtgattatggaggctgaggagtcccacagtctgctatctgcaagctggagacccaggaaagccagtggtatggttcagaggcctgagagctagcagctgatggtgtggactccagtccaggtcccaagccctgagaaccaggagcaacaagggcagaagatggacgttcctgttcaagcagtcaggcggtgttaattcagccttcctccaccctttgttctgttcaggtcctcaatgactggatggtgtccacccacactggggagggccatctggtctactcagttgacccattcaaatgctaatcttttccagaaacaccctcacaacatgcccaaaaataatgtttatgcatcctgtggcaagttaagggctcaatgtgataacaggggctatatctttaggttttcccaatgtgtttgagataaaaaagtgggagataattctataacagctttaaacacacacacacacacacacacacacacacacacacaaccacctacttattatcttacagtttctgtgggccagaaatccaggtgggctgaactgggtcgtctgctgcttagggtctcaaaacactgaaatgggatgtcagcagagctgtgtgccttattagaggttttggtggggaagaatccacttccaagctcacttaggttgttggccttgtggttgcaggtctgaggtccttgttttcttgcaggcagttatccaggagctggtccttgctcctgggggctgcccccatttcttatgctttccatgtggccccctaaaagagcttaaaatgcatagtttgagagccacagatgaagagagggcaaatggttctccagagagaactgaagtatattaaatcagtgagcataaaaggttggggggtgttcttgtagttatgtgttcactcactaccactccttgaaatatgttctttgaaattcacctggccaaggcttttaatacaactaaataaaaaggaagggcctatgggtggtgtataactgattgagaggccgcacttggcaacgatgtgctttcattgggaggaggtctgtcttcatgagctttctgatgccatcctgtgccttggcctgtttcacatctttttcaggggcttgtgcagtgatctagaaggtggtggacctgaagagacctgattctgggaggccacagaataccttgggtggcccttgggatctaagaataagaacatggatgctcttgggctccacataaagcattctagttgggcgagggggaagaaggccagggcaggtctgagagtggggaagactctggaccacccacccatgccagtgtcaaccagagccgccttttctgaatgtatctgtttttacatgttgtttctaaattagattatagttgatgcctataggaagcatcctactaattaaaaaaaaaaaaccttgaaaattactgatctaatccactttcttttttgagtaggtttccctgacttcttaaaccccttccaatctgttacttcttagtatatgaatgttggacaaaaaccagcccaataaaatgtaataggaatacatttaagtatcaacaaattgtatttaagctccaaaaagtcaataatatagaatgaagcatacctgatttgacagcaattccaatgaaaaagagttaatacaggccaagaatgtctctactgcttccctccaagtgctctgggctgtgacccagtgaacatttccagatcacagcccatgtttctttctggttgctcactctctgctgagaccctgctccacctcagatcttcacttttgaggcagttgctcgtcatttccagcccaaccctaatgccaccagctttgtggggccatctataagactatcagctggctttgctctcccctccttttgaaacaaccacatttcaccttacctaggaattactgaagttatcaaattgctatgcaaactccttgagtcagggaccagccattccttatattcatggtttctggatccacattagttccttttgtgttgcaggtttttaacaaacattgattgaataaataattggataatatgaggttagcactgcttagaacagatatctttgaccaaatttatgaaaacacatgcatgaaggacttctccctgttttcttcagtccagtgctggctgacttagagtcttaggttccaccatgaccaccatatttgatgagaaacatcagcagactctagggtacaggtgaaagtgacagtgatgcgggagacacctggaaatggtgggaaacaattggacatgtttatcttggaggaggaaaaaacaagggtaatcaggtagctggcttcctcatatctttgaagggctgacttatgaggaaggaagtagactgtttttgttgattgtaagggaaaaactaggtctaattggagagtgtatgtggaactctttagcagaggaagtggctggggcctaggactgtcaactcccagatgctggtgtgacttggatgttccattaccactaattaggagtgatgttttaggcaggaaggactagcgcagtggttcccaaaccttgctagtcctcagaatcacctgaggacttattaaaaattcacattctggctggctggcttatgcctgtaatcccagctctttgggaggctgaagtgggaggactgtttaagcccaggagttcaaaaccagcctgggcaacatagtgagaccttgtctctctacattaaaaaaataaaaattagctgggcatggtggtgtgtgcctgtattcccagcgactcagaggggctgtagtgggaggctcacttgagcctgggaggttgaggctgcagtgagctgagatcgagactcaaagtcagtgggtcttcggggtggagattagggaactgcatgtaaaaaattcagccaggcctagcagccactggactagaggtccaccctgaccccttccaacttgaataagctgggcatgcatgttgacacagagcttttaaatcagtggcctctttaaacatccttttcgggtgaagtggcaaattaggcttggcaaattagacttaagaaggcttgagaactagtctagtgaggccaagaggcctctgctttcattcttataactttttttatttttataaaagtgatccatggacactttcccaaaatgttaaacatagttaccatatgacccagcaattccacccctatatttaagagaaatgaaaacatatgtccacataaagacctatgtacattaatgttgatggcagctttatttgtaatgtccaaaaagtagaaacaacttaaatgttcatcaaatgatgaataaactatggtatatccatatgatggaatattattttgcaataaaaaggaataaactactgatatatgctacatgtatgaaccttgaacatatgctaaagtgaaagaagccagttgcaaaagaccacatattatatgaatccatttatatgaaatatccaggtgaggcaagtgcatagagacaaaaagtggactcgtggttgcctcggggtgggtggggggaaaggggagtgactgctaataggtacagggtattggtgtggggggtgatgaaagtggtctaaacttagattgtggtgatggttgtataactctgaatatattataaaccactgaattgtttgctttaaataggtgaattttaagatatccaattatatatcaataaagatgttgaaaaaagtgacaagtggtcattaaagataatttagaaaatacaggtcaagaaaagaaagcaaagtaaaccccaactttcagcatcactagaaggtagctgcatagcatcttaggataatccttcctgtgtatattctatctatatttgcatattttttacaaaaatggtatcatactcttcaaactgttatacatttttgtatgtaactgtatgctgaaaatgtttctgttattaggcttttacttcattatttgtaatggccatagagtacttcaatctatgaaaaattttaatttatttaattagttttccattggtgggtttttgctgacttcaattttcttgctcttgtatagtaattcatgtcagttttgattcaaggtccttacttttttttagaaaaataaactttatattttagagtagttttaggttcatagcaaaactgaactgaatctacagagttcccatacagtatgtagccttttccagttggcttctttcacttagtaatatggatttaaggctcctccatctcttgagagctcattgctttttagtgctggataatatttcattgtatggttccactgcagtttctctgtcagttactgaagggcatcttggttgcttccaagttttagcaattatgaataaagctgctataaacagccatgtgtaggtttctgtgtggacaaaagttttcagcttatttgggtaaataccaaggagtatgattgctggatcatattgtaaagtatgtctagttttgtaagaaactgccaaactgtcttctgtagtggctgtactattttgcgtccccaccacagtgaacgagagttgctgttgttccacatcctcaccggcattaagtattgtcagtgttttggatcttggccattctaatgtggtcattctaaggtggactgtcttatttgcatttccctaatgacatatgatgttgagcatctttttatatgcttattatttgctacctgcatatcttctttggtgaggtatttgtttagaacttttgcccatttttaaattgggttgtttgttgtcttattgtttagtcttatgaattctttgtatattttggataaaagtcctttatcagatatggcttttgcagatatttctcctagtctttgacttgtcttctcattctcttgagggccttactttttgaaactagggaatttttatcccacggaaacaaatttcacctttgacttcaccttgaaaattcttgatgttgttcagaaacggtttggacaagaaggtgaggggtagggattagcacaaaagcattattctatttaaaatctataactgcagagttaccttcctgtataaagacaaggtaactttgaaagaagcagaaacactcatctccattaaatgtttgttggatgttttgtttttcagtctctatcagttggcttctgctgtgtaactaaccattccaaacttagtggcttcaaataaccatgtattagctcatgattctttaggtcatctgatcaatttttcagccatagggcaaccttgctgatctctgctgggctctctcatatgtcagctggtagctgaatgatctagagtggcctcattcatatgtctggcagttggctagaacagagccttgtgtatcttaacattcagtaagctaacctgaacctcttcacaggatggcagccacaggattcccaaaagcagcaagtgggcaagccccaatgtgctagcttatttcatgctgcggtttgcatcatatttgttaatgtactattggccaaagaaagtcacaaaaccagctcagagtcaagagatggagaaacaggcactacctcctgataggaccctctgtaatgcgtggcaatggaacagaaacagggaagaaacaagtttgtgtgtggctagctaaataatggccttgtgctttatggccagtacatgactgtgtctaattttcatacgtgaatatacttccaacttccacatgcaaaatacccataaaaatggtaacacagcatcctggcaaattaattcacatttttggtggcaaactcatgtctcattttaggcatgatttacagcaattttgataagactttgagagtacaagacaatggtggcagaacctacccacaaaatgctaggacaggtgcatttattcactcactcaacaactaattatcgaacaaatacttccttaagtgcctgggattcatcaagaacaagataaactccttgcctttgtggagtttgtgttctagtgcaggggcagaaaaacgaagcaccaagtcatgatcaatatgtggaaatggtaggacagggaagagtgatgggagaattttctagaggaccccaaataggattggccagtctctctgagaccattttcattttctggactttgggtttttcatcattggtttgtcccgtggtaggtctcagtgcagatgctgatggggacccggcagcgcatctgttatggctctggtggatttgtctctggtagagcagggagccagatagaatgggaggtggactgcaggacttgtaacattggactaatgaacagccagatgtctgatgtgtcctgaaggcaggatattccagctggaggtttctggcacctcagaagccctatcagagctgggtcctcaaagagcatgctgtgggattagtgcaatgcaatttggtttaaataagagcagagcataaggagggagggctgagtgagaattgtggtagccatagcaacatgatactgacagttgagtcaccacaaagagaatattggccaactgtgattgctccagcatggcttgagaatgtggcacctttgaagttaccaggcagagaaagttagggagagagaaatcccatgtcttacccaatcccttccttagtgagtcaagactgtgacagcccagcacatggtgtgttgtgtggctctgttcgttgttagctaggacagtgaaataatctttaatctccatttccctgtctcttaaggttttgaaccaacctttattcagagacctcttctgggtttgcattttatgattatcagtaagctgttaggaatccactgctgacaggtggaggggacaacgttgacagttttgggttctagaattcctgcagacagactggctctctccccaggtccccaactccaaaataaacaactttttaattatacactttggaaaagctccttttttcaatcccttttctcttttctaggtaatacataaggtgaaaaatcagaaagaagggctaaagatatgatataggatccctcattcatctctgatagtctaaagagagtaataaagtagcaagtcccatttactcccagaaagcctagttttctctctcatcaaagccagtaggagggacctggcaagtctctggatggagaaaatgtttcttttttaattgttatcaaacaaagctatttctaagttggcctgggaggaccccctcaccctgaagcactcaatgtgtgtttaagatgtcagcttctagaggacaggagccctgtgctattgcatacgtggtcccgatgagcagctgacaggatgtggcagctttgtgttgcttaaccacagtcagaactgcagtgcctgtccctgctacgggtcagagttggccccagccatcgccccttagccgccgcatgtccggcctcattaccttccctgtgatcaggagccttgcgtggttgcatgccttgcctggttctcattctgctcatgcaggtgtgtgtgggcagacacccctgataataaggatgcatgccatctcctgcccttccatcccgtagcccctttcttctttctgccttccaagtaactgacgttagagaaaccgcatgtaccaggaccagatcacccagcgtgtcccagaatccaggagaatgttatcttgcacatgcaggtttggttttcttgccagcttggcatggtgctttaggagaagccagggcaacatctcgagctaggacgatctacccagtgtgggtttttatctctctcttccagggcaagctggtggcactgctgggcctcacagtaggttatcataaattagacttcagggctccagaggtaatgcaaggccaaagtgtccggcctggagcaaataagggctaggtgtgccagccttgagtgtggtgacaaattaggaacactccccttcagcagtaactatatcattgtatttctctcaaatcaaatgaggtgactttcttttctttttttttttttttttgagatggagtctcgctctgtcgccaggctggagtgcagtggcgcaatctgggctcactgcaacctccgcctcctgggttcaagcgattctcctgcctcagcctcccgagtagctgggactacaggcgcctgccaccatgcttggctaatttttgtatttttagtagagacgaggtttcaccatgttggccagggtggtctcgatctcctgacctcatgatccacccacctctgcctcccaaagtgcagagattacaggcgtgagccactgagcccggccacaaatcaatgaggtgactttcattacaattttcctcctagaggtttgcctggtatttggttcttagaataatagtaataatagtaatacaccagttagcttctgctgtgtaataaagctccccaaagcttagtgagttaaaatcataacccaaacaggtcagctgggtgatttttccttcaacttttaggaaatcgactaatctcagcatgtgcctgcaggcgctgatgggtggaccacagctagcagctccaagatggcatctctcacgtctgctgcttagcagggccacaggtctctcatcatccgaaggctagcctgggcctgtcctcatggcgtaggcagggttcctggagagtgagcagaaacagcaaggctccttgaggcctaggttcaggatgaccgtaatgtcacatctgccatatcctatttgtcagagcaagtcccaagaccagccaagattcaaggggtgaccagagggactctccctcttatgggaggagctgccgagctgtgttggaaagtggcctggacacagggaagtcataatagacaccattcttccaaacaatatgtttcatgtaataataacaattattattttttatttcgttgagctcctaaaaggctactgagtttgctgcctttcttacctggtagagaaaatgagacaaagatgtgaattcaccagcactgggtgggtaaagagtctcagaactgaagctttttatgcactacatgtattttcctctgacccttttctgcatctaagaactaagcttttttaaaaaaaaaaaattattctctttgaacattatgaaagcctaagttgtctaaaatgagaagactgctctctcagactctattatgttgtcctgattacatatcagcaaaatgtttttctggggcattgtgcataaaacaaaggagaaaacaacatctctagccggccagcgtgcctgtccctccctcccgcagaggcctgggaggctgagggtgaggaaggccagctgtgctggctgcagagggctttgctgtttctccacagagcagcaggtcgccccttcccttctccctccctccacctcacctccatgggctccactggatgggaaccatgtgcttgttctccccacccctagactgggatctcctggggcagaagaggcttcccaagtggcacagacagagccaggctgactgaatgtgagattcatgaatgaacagtgataccaggcatagccctgccctttagcatcctgagggccacgtggagttttctgcaacactgcccgccgtgttccagcatctgccttccacttgctagggagaggtagaggtgaagtggcccttctttctgtcttggcattcctgtccaccctgcctctagatctccactttccatggccgtaggagaacaggacctctaccctcctcgagtgccgctatagccagcgtgtgctgagcagggcccaggcagccctgagaaggcgccagcatgctctgcctcctctgcactagcagctgccaccagtccttgctgtcggccacttccctcctgcggagtcctgcctgtggcctcctgagacctcaccatccatccatccagtttccaggctccttgtgacttgccctcttgagatatttgatggtgtgatcaaactcctttttttttttttttttttaaagttccagggtgcaagtgcaggatatgcaggcttgttacataggtaaacgtgtgccatgtgtgttgctgctcagatcaggctatcacctaggtatgaagcccagcatccattagctatttttcctgatgctctccctcctcccacacctccaacaggtcccagtgtgtgttgctccccaccatgtgtccatgtgttttcacatgtgttttcaccgttcagctctcccacttgtaagtgagaacatgtggtgtttgattttctgttcctgcgttagtttgctaaggataacagcttccagctccatccatgtccccacaaaggacgtgattcgttcctttttaaggctgcatagcattatggactggataaagaaaatgtggtacaaactcccttcttaagcctgtttcccatgcaggattgtccaagggctgattccttcccactcagcccattttcgttcatcttctgctcaccccctcacaaggaaatccagccctcagccagcctcatccctccaggagttttcacctaccctgcatctgtcagcacctccaagtgtttatccccatcccagccttttcctggccctgagctgtggattaatttcctgttgctgcggcaacaaatcacagatttagtgacttaaaacaacgcaagtttattgtcttacatttgttgagtcagaagtctgaaatgagtattaaggggctaaaaccaaggtgttgacaggaccacattctttgtggagacttttaggagacaatctgttaccgaccattgccagcttctggaagctgcccatgttccttggctcgtggccccttccctgcatcactccagcctctgctgctgccatcacatctcttcctctgactctggccttcctgcctgtccttataaggacccctgtgattatactgggcacacctggataatcctggataaactctccatctcaagatccttagcttaatcatatctgccacatccctttaccatgcgaagggaacattttcacaggctcctgggattaggctgtagacatctttggggccattattctgtctaccacaggctgtttcatttagttgcctcctggacatttccataggttcctcaaactcagggtgtctagaatagaattcattccctctcattgtccctcttcatcctgtatgccccggctcaacacatgagcagccattgcccagttctctgagctgttgtctgggtgaaacataatgttaaatacaaatccagcactgatgggcacttgagtagtttccagtgtcttgctactgcagaccgctctccagtgaataactctgtgcatttctcattttttaatacgtaggttaaattcccagaagtgagattgttgggtcaaagggaaaatgtgtttgtaattttgaaagatactgtcaaactgttctccaggagggttgaatcaatgagcccttccactagcaatgtacaagaacgcatgcttccccacggccttggcaacaaagcgggctgcctaacttttgggtttttaccagttcaataggtgaaaaaatagtatctcagggtattttttgttgttgttttttgtttttgtttttgttttgagacagagtcttgctctgtcgcccaggctggagtgcagtggcacgatctcggctcactgcagcttctgcctcctaggttcaagccattctcctgcctcagcctcccaagtagctgggactacaggcacccgccaccatgcccggctaattttttaaatttttagtagagacggggtttcaccgtgttagcccggatggtctcgatctcctgacctcgtgctctacccgcgtcggcctcccaaagtgctgggattacaggcgtgagccaccacgcccggctggtagttttaatttgcatttttcttatgagattctgcatttctctcatgcacttagtgggtgtttgaatcttctgtgatctctcttcatatctttggcccttttaaaatttggattattggattttttcttttcaatttttacaagcccttttttttctgtaatatgagctgcaaacatttttccattttgtcatttgtcttttatatcatatgagtttttatgtaatcaaatttgtcatttttattttttggtttctggattctaagttatttagaaaggccttccagtgttcactttaaacattaaaataataacattttattaaatgagggggattggacacaggcatctatttcttttctgaaaaatcctcatgaaatgaaactaaaggaatgacataattagatagatacaggcaattctcatattctcagattctgtatttgcaaattcatctgcttactaaaatttattgtaatcccaaaatcaatacaaatggcattttgtggccatttgcaaacatgtgcagaacagcaaaaattttgagttgcctaatgtgcacttttctagctaaggtcaaacaaggtaatattgtgcctggtttcaatgttcatactaaaagcaagtgtcctttttgtggtacacatagtgccacatttttcacatttttgtgctttttgttggtgatttagctgttaaaaatagcccctatgcatagtgctgaagtactgttgcctagtgttcctaagtgcaggaatgctatgatgtgctttacaaagcaaataccagtgagctttgttcaggcatgagttatagtgctgttggctgcaagttcaatgttcatgaatcaacactatctattaaacaaggttatatattgatcagtttgcaaaactgttgcgaccagatgcttccaagaccctaaccctatatttctcttatgggcaatggttcaatagtcactaatgcactgttcacaatgactttacagaacatagctaccaagaataatgaggttcaattgtaggtaggtaggtaggtagataaatcgatgcccacaagaacaaaaagattagaagaagataaagtagaagatgagtgatttcaacaaatttttagatagatggaaagtagatagaggaatctaactaatttagcaaaatgaaggaagctacaacctggacgagaagggtgccatttgtttcttgcagaacccaagaaaagctttggttttcaaagcataaatcaccatgggatgggaggttgggggatgtgaactgcagagcagaaaaccagggtactggtttaaaatcctaacgtggcgtggtaagatccctagttccccatctctgtcacatgcaacctgggaaccgtggagataatgtaggtatcagaagaaaccatttaaagagataaaataaatgtatccatgaagcaaaaacaagatgctgtaaaaaaaaaaaagaagcaatcaaaagataagaaagggcttttgaatcttaaaaatagggcagcagaaaatttaaaaaacataaaagttggaagacaaaatgaaggaaatctctcagaaagcaaaattaaaagagtaagaaaactgtgggggaaggtaataaaattaaaacatttatcacacattttgattaatagcaggtccagaaaaaaagaagatagaaaagggaggggagaaaacttatcaaaggggggaaaaatacatttttcagaactgaaggacaagaatcttcagattgcaaggccatcaggtgaacaatcctttgagtaaaaaagacccacaccaaagcacattgtcatgaaattccggaacttctaggggagaaaaaaaaaatcctaaaaactttcaaagcaatacaacaggttacagttaaaatattagtaatcagaatagattatctcaatagcattgctgacatctagaaactactagaggtactttcaaaattttgacggataaatcaatttcagcccagacgtctgtacctaaactattagttaacacaaaggcatttttagaaatgcacggattcagatgacttctagggcattgttgcctagagagtcactacaggatgtgctcctgcaaaatgagaaggaaaccaaaaaaagagaacataccagccatagacagtaatttacgaagaacccaggcatgaaaagcagccagaccagattagagcaaagtttcagaaatgatgtctccagtggggaaaaatggaactaatgtatttaggatcttggaatatttatcgatgagcattaaataggggtattgcaacatgtgggataaattagtgatgggttcaggtacaaccaggaagatgaaaaaaatggaggtaataattaactccaggaaaaacagagggttatataaaaaagaaggcatggtcatagtgcattatttgacccagcattgagcaatatttgcaaaactgtgataacacaaacattgacttttgatttactttaaattacaaaataaccatttggagcacaaagaaaaaggaaataagaaatgtttatgggagcactaaacctttatttcccatggtagaaaattaggatacctaaaactgataagtaaaataagagtagtataagcacaccctgccagtaatttgtgggcactagtgttttggtagcaattttacaaaagacacagaagtagtttttgcaggactctcccttacataccctaattggtgaaaggcaaggtctcagtcctgtggatgtcaggaatagaggcaaactgtccccagtcacttttctcaggtatggagaacaccccagaagtggtctcaagcacctttcagacaagggaaatcaaattcctttcttcatttacaatcatgtataaagagcaaaatattttctttcaaactccttttctcctagattgcttccacaggatgaaacacaggagaaaagaagagcaaactgacattcagaatgcaaactttctcactggaccaatttatgaattcctaattatttctctgcatagaagatcttttaaatcatcaaaagacaaacatatttcttagtaaactctacattctgttgtcctaatttttggagggtaaagaaaggttgtgtaggatgtctatttctttagttgatttgcaatcactggagaaattatagggaacaaaggaaaaaagagccataaatacaaatgaattccttttatacgagttgaaaaaccacaggacatgctccattttttaacactccaggtgtgatcggagattacgtatccaccacaggagagtggagagttaattaaaatttttgctcctactcagagaaagaaatgtctttttgtttgataagcaggctggcttttgagtgttgttggtgctttcttctctcctcactggagtgtcacaaaaaagcagatcaaagagagccttccatccggatatgtttcctaccacctttcttagctaatggacttaaaagtgtctttcactgacaggctcatcttgtattttagaaatgccatctctttactatattgataaatatgcaaacgggctgtgatagatgcttacggaaaatcacatttaacattaattaagccaagaccattccaaatagtcggagtgggagagtctggcagagtgcaacatctcacccctaccatttgtattttacttgtcaactcaccatgtgatggccagaaattaacacgtgagattgaaccttcagctctctcaagcagggttgttttgttgtgttttcccttttgcttttggcctttatgattctgtaccctctggctgacatctcctaccctgagggggaaaaaatgtttgggagaaatcctgctgattttttctttaagagagtgacaaaatgaaataaaacggagcaaaatagaagcagccggtttgcagtctgtctaagcaggcgggtcgggctgcagcaggggtcgttcattgtctcgcagctctgggtgcccgcagagaaaacctggcccgagatgcagccaccaataaaaggactccattctgccactcagggctttgtgaggcgccaaagcttgtcctggttgccatggctactgtctgattgtggcgggtttgtcacagtgcttgataaagtgggaaggttattcttgataggcccaagtaatcataacctcgcaaagcttgagagtgtggatttaaaattggttttcctcctctctttaaactgggaatacggggatgggggcagggattctcaggataaagcagcctcaggactccttcagcaggtggtgagcgtggcacccagcaggaggaatacgggctgtgctggtctggaagggaggtgtgcgtgtgcccagaggccaggcagaaaggatggtcacaactgctgggccatctctggcctgatagaggcttcagggaagggaccagaatggcattctctcctggccccacctgtaaacggattattcttgtacctctctctcctttcctcccttccctcctcccttccgccttcctttattaagtttcctctttccctttccctttctccacttccgccctgtctcggtccacttgtgctgttgtaacaggatacctgagatcaggcaatttataaaggacagacagttcttggctcctggtcctggaggctgggaagtccaaggtcgagggcctggcatcttgtgagggccttcttgctgcgtcatcccgaggcggaagcgcagaaaagaggggagagagcaggagactgaacttgtagcctcaagccctttgcctgagttggcattaacccattcacaagagtggagcccttctgacctaaacactcccaccaggcctcaccattcaatgtcattgcattggggattaagttttcaacacatggaaactttttgggggatacattcaaaccttagcactttccttcttttctccccttgcagtgtggcagaatttctaacagagctgatcctttaaaaatatatatttttttctcatggagaatgatgggaaaaagttagatttgaggcaacagctgatagattctggccacagaattacagacttttcttttgccaggagggacctacatgattacctaggcgatggttctcagacttagctgcatcaggactactgggaagggctttttaaaacacagattccggggccctactcccggagttcctgattcatcaggtctgggatggggccctgagaatctgggcttctaacaagttgccaggtgatgctgatgctgccggctcgggccatgctttgggaaccgacatagaccagtacccattttatacagcggaggaaagggaggctgccaagggataaattagtcgccaagggttcaggtgacttgatagccactctggaactggtgtccagttatagaagctttaaaagccatttgaagagacagggcaggtaggttgttcctcctctgccttccatcccactcgcccagggcatccagatgagctggttttgttcccaaagggccaccagcaggatagccactcaccacacgtggccaccttctgagtggagcactccagaccatggtcacgcgcgctgcctctgagttaagccgaccacagaccttggcactctaggcccagctttgccttctaatttttgccccaggaagcctgctttgactgtggctgggatctctcccacctctgctggcattcaaagtcccatggccctgccagagagcccttaggtttttcagttcctggcatgtttgtgctgttgcccctgctagcctgtgaactccaggggccggggctgtgcctttgcacccatcatggctctagagtacctgataaatgaactatgtgggcatacagggtggaaggaatctggatacatgtttgagattttcggaagccaactacaagaagccaaactatgagggatgaggagtccagttacacacagagcaggggtgggggctacactttgagtgttagtgaggaacccgtagtaagaaatgaggcctgttgcagtgagaacgcctgcagaggtggaagccagtgcaggggcctcacatcagggctctctccctgtgctagcagggggctgaagtttttttcgttttgtttttttttttgagatgggaatcccgctctgtcacccaggctggagtgcagtggtgccatctcagctcactgcaagctccacctcccgggttcacgccattctcctgcctcagcctcccgagtagctgggactacaggcgcccgccaccaggcctggctaattttttttgtatttttagtagagacggggtttcactgtgttagccaggatggtcttgatctcctgaccatgtgatccacctgcctcagcctcccaaagtgctgggattacagacgtgagccacagcacccggccggggctgagttttttaactgaaagacaaatgttagttccccaaatcctaatttgaaataaaacatggcagcattcatttatccctgcaaggcagggcacataacacaggcaaagcagcttctgcgtgtacacacacatgtggatgtgcatgtgtgtgttgctgtggctggacataaacgacttgatcatttgtcaaatgtaagttaactccccacaacacgctctgaactcattcagagcagcacgtgtagttatatgccctggataccgctcagaggtgagacagttatgcttcgtcagtgaaactcacaggaggctatttgtccagacaagaatcaaacaaaattaatggattaatcttttggctgtaattccttgctgacatcacagactgaaatggggcccagaaggaaatcccatgttggcagtttgactccaaacttttaaagtcttcagcaagcatcggagcaggagcctctgagtggccgggcaccgccacttcttttctgttttgcggattggcagactgaatagtcccctctcattgcctgggagttggcttgtggcagcagcagccctaatgctggccttgttcccccagggtgtcgaagtgcagacagactacgtgcccctgctgaactcgctggcggcctatggctggcagctcacctgtgtgctaccaactcccgtcgtcaagactaccaggtaacaataacagtaatcattaggattctattgaacacttactctgtgctagtcactgttcctaatgagcacctcacgtctataaattatttaatcctgtgcaagaggctggtagttatgtaaactctcccactgggaagcagcagagccagaatttcacattcttaaccaccgtcacccagagaactcccctgcacccctcttcccacatggggggccctgtgagtcattactgcccagaatgtcaaagatgagccgctcagactgagagggctcagagcctccaatgcaaaagaaattcagcacctactatgtgccttgtgctaggctaggtaggcactttatatataaaaatctcagtcctcaaaaagaaaagaaaaatactatgaggtagaattgtattattattaaacccattttgcagctgaggaaagtgtagccagggaggttgagggacttggccaagatcaagcactggtcaccagctccacaaaggggctgtaaaggcctgcctttcaggccttggtgcggcattccttataatttcaggttcatgctcatttgtccactctcagctctgcttacgctcccttgagcccagtcacaccaaccataaaaggccctccatctatatgttgggcttactatccaaattagtcttgccctgtggggttgtaagcatggatatgattcccattttgcagatgaggaaactgaggctaggggaggcttggtcacatacttaaggctacccagccagtaagtggcagaaactgggcctagaacctcagtctgcagaatcaggcacttttcctggagcaggccgtctctctgctgaccagcaaggatgcccccgctgtggcccccagagctccaccttccccaagccctactgcatattcaccactgcagagtgatggacagcatggggcaaggctggcaaaccagggtgattgagagtgcagaatcatggtgacaactgatgtctttcctagtccctcctctggctcaccaggatcctcagattccacattaggtcacagtgggtcagtgcaccagggggagccagtctgcggccacttttgagccccttggccactggaaaccaccatgttctttctcagccaagacttcgacaggcatagggcaatgcagtggtgtagaaagaaccctggatttggggcctgaagacttgaacccaagtcttcagtctgccacttacccactgtgtcatgttggtcaagtgacatagcttctctgagtcagtttcctggtcaatttccagaagacaagactcagaatgtatttgaatgtgaaggcccagctggttctgagccacctaagcccaggggctacagacaggtctctctgtctcagaccttcacacctgctaaataatccttcctaatcctccacctccctgttccttaaatgaccacttacggtggaatggagactgtgtggaactgggtagatctgtgtttgaatcctcactgtgtgatctccagcctgctcttgagctgagcttttgtttccttctataaaagtggtagttggattccgtggagcattgaggtgaagcttaaatgagccattatgtgtgaattcacccagcctagccgctacacaaaataggtgcagagtaaatattagttctctccctcctttttcttacagactttgtagctgaatgcagtaacatgtaaagaaatttacaaaacagatttaagaaatgcaaattaaaaccacagtgagatatagcctcacactgattgggatggctattataaaaaagacaagggtatagagaaaagagaacccttgtacactcttggtgggattgtaaattaatatagccattatggaaaatagtacagaggtttctcagaaaactaaagatagacttagcacatgatccagcaaacccacttctaggtatatatccaaaggaactgaaatcagtatgcagaagagggatctgcatttccatgatccttgcagcattattcacaacagctaagaaatggaaacaacttaggtgtccctcatcagatggatgaagaaaatgtgatatatatatataaaatacacacacacacacacacacacacacacacacacacacaatggaatactatgcaaccttaaaagggggggggtcagggacattctgttatttattacaaggatgagcctggaagacactatgctaagtgaaataaaccaggcacagaatgacataccttataatctctctcatacgtggaatctaaaaaagttgagtcatagaagcagagagtagaatggtgtttaccagaggctggggagtggggcggatgggcaaacgagagatgttgatcaaagggtacaaagtttcagttaggaggaataagccttggtcatctattgcacagaatggtgactattataaacaataatgccttgtatagtttacagttcctaaaagagtagcttttaaatgttttcaccacaaaaagtgctaagtatgtgaggtgatggatttgttaagtagcctgatttaatcagtccacattgtaaacatatatcaaaacatcacactctaccccataaatatacaattattatttgtaaattaaaaataaaatacaaaatcatcagaagggtggaagcaggggaaaaaaaaaacagtgatcttctttacaatacttctatcatctttagaggcagctccaggtcctgccttcctgggaagagagaattcactgtattgtaagatacgagtcgcccctccctcgcatgtgagccagagctggttaacaggcactgccttgcagggcccgcctggtgctgtgcagtctttggtgtgcctgcaggagccatgcatggctgagaccctggatgcagccatgacctctgtccactgtcctgtagcagctggagggctgagctcatcacccaggtccttatctacctgcccatcattaccagagacagatttggaaaaggcccctgcccctttgagatccactgaagcagccagtgtgtccacatttggccaagatgctgttacttcccattaagggaatgggcgtgtccagctaggaagctgactttgtagggatacccaaaaagcttttgttgggcatctgagatagcccctcggaagcaaggttggatggcctgggagcggaagagtagagcaggcgtctcttctaacctgtcataatcctgtgggtggtctgctttgatgaaattagggatggcaacatctgtgtcaggttttgggttcctctaaggcataaagtggctcattctcagctccgtgtgttacagcgaggggagtgtatccaccaagcagattgtctttcttcagagaccttgtctacctcagaaaatcaagaagaaggaatcgaaggtaagagactttgatggccttcctaggttttcctcagcagggcttcatcttcagtggattttctgcagcatttgagggggcagcctgctccagcttccaagggctcgcagagcccaaggaacacctgagcccctggcaacccgaatcacatctcaggctgctaaaacgggacagctgaggggactggagggccttgtctgccatcgtcctgctgggccggccagaaggatggaggagagaggctcttctggaggcttcagcctgctagatattcccactaggatgaaaagaagggcacgaagtcagctgcagcctgaccatggggtggggatggctcgagctcatggccagtttctttgtgtcttaatctcattatcagctagttggagctctggcctgccctgttaagattccttaggacattaaaagtgtggggatctaagcagagaccctgccaaaatttcttcatgacaggcctagacccaaaggcctctgtgtgacagctggtgatgctagctgtagcctgtggcagcaagtcctcaggccaggctgtcctcaagagatccccagggcccttttccccctctccggactctgaactaccctagaaacagtcgcacagagactggccttctcagagagtcttctctgtgattcctgaaggttgagcacaagggctgtacgaggtgcaagtgtcggcaacccttgtgccagatgattctgatgcttcccaccccaccctgagcagcctgtggtgcttttcctgaggacattttcaccagttgctggggaagaggccagtgagtcgagtggacacaccaaagcctgagtcaggcatcacctggattcagctcactgcacctttgatggctgaggccacattctcggcagggcctgcctgacctgctcggctcctcactcctggcatcactcctgcattcctcacgcttggttcctcatgttctttggacacagagccctgggaaggagcatcaagtaaatgaacagattggagcagcccctcaccagccaacaactccagggggagcccacttgtggaaggagtgccaaagcaatggtgacttgaagccagatgggctggagtgtggaggaaggtctttctccaggctctgaaggtgtaatgtgacaggtgacggcacaatggaccagaagggaactgccagcccaccatcaaccaccaggagcaggcagccaccagctggaagatggatcggctgcagagcgctgtcagtttcagctcagccacaggctcacgggaactgcatgcattcagcaagtgcaacattcaacacacagcacgcaaagggcccctgtcagatgctgacagacacccgctgcagccttacagagggagatggtgccacctttgcctaacaggttcctggtggtggggcacacagattccaaaggagagacatgtggttggatgttggtgtgaaggtcatggcatcgcatgcagggggacaagtcagtggaaacttgagtcggcagggagactttagagatagatttgtaaaagctgctgtaataaggttgaactgactctcctcagggaaaattcagagaggatgggacccactgttttttcagtcagtaaaaacttctaatcccaagcagctgtactcatctgggtggactgctttctctttccatgtacctaattatttcctgcctcattccaagactgtaggtgactggtgtggagcacttgttctacacaagaccctctgggtcacctcacagatgggagtcctccagagaggggggcttcacagccagactccttggaagaatcttctgcactgggtgtcccctcctcactcctcagctgacaagggtcagcgtcctactcccacaggcctgtgtcccctggtgaccgagagtcactccatctagtcctcatcatgcctgagctcttgcagcccggatgttgggaccacccccactccctgaagcagcttttctcttggttctttcccacctcattctcctggtttcccactaagttcctcagggttcagacccagccccatttctcccttcactcttgcctcttccttagaaaatctccttcaccacctctgtgccaatgaccattccgcctgcattttcagccctcactgcaccccaagactccagctccatccatcctgtggctcgaggaaacctatgactgtccccctccccatacctcgcccacctggccaaccgccaccctatctagaggaatggcattgcaccttaggggctatccctgctgaccctcccctctccttcccctatattcaatctatccttaagacccatctgtgttaggtcccggaggctctggaatccctccacttctctctaccatcactcgcctcagctattctaatctcctaataatagatatccccttcaaataggttccctattcagagcccaagtgatctgttaaaaagggaacttgaatcctgtcatcccactgctcaaaggagttctagttttgtatgactctgaagacaaagatggaaatcagtactgtggccctcaaggccccaagggatctggtccctcttacctcctctgccagcctcccattctctgtggcctccagctcctctgtggcctccagttcttccgtgtcccctctgccaaggacattctcctcctttctagctctactcgagcatccttttctcagaacagtgctgtctccttttataccaaaccagactcctttgtactaccctggaaaagaaccacgttcttctccttcagagctctcctttgggcttttagttatttgtgatcattattttatccttcccaggcagagtcagacatagtctccacaagagcaaagacctttttcctgtgttgtgtacccagattttagttggtgctcaacagatacttgtcgaatcaatgaatgagtaatcagcttcttagcgaggacacacatagtatgtctagcattaaaacttaagaaaagaaactgcaagattggcacaccgaggatgtggcatatttagtcttcttttaatcagcaacatggatagatttttctaatcaggacttttcagcattggaaagaaacctctgtgtacgtgcgtgtgattttcaaggcaaatattaaacttcttcaaagggagtaggtgatttctacaactcgggaagacttccttccagctaaactacttgaagtggacacatcatgggcagtttttaaaatgtgcaaattaaatccattggctcctgctgacatggaactctggacacacactgctgtaaagtgaaggatttctttttttcttttagacagttatttctgaattgggcggctaattggatttggtgacacacccaactgccacagatgctctggcttgggaaggcccccaactcagtgcaacctgttttatctgcggcttgctggttaagctcagagactcccccggtcctactcaaaacctggagtccattccccaggctggacttgcctgcctttaagtggtgtggatgtcagagctcacctcagaggctcaactgaaatctggcacagtccaggcctcctcttgctttctgagacgtctcctttttgaattgttgggatctgaaacagtttttgttgtttgttttctaccatttgtgttctcgttttgtattatatcagcagatcaacaagatgtgatcttctacaggaaactggatgtggccaggcatccaggggaaactatggaagctctgttatttagcaagagcagccccggagagagtatctgggctcatattagatggaaggtctagcacgtggtggaattgtcctcagttgtacactgcacaacagcagagggcgctattcacatcaaatacaatatgaatggggccctggaggtgtgcaccgcagccctggaggtagagacaaccattttagagatgagtaacttgaaactcagattcataacctgcctaaagactgacagctaatgagtgccagcactaggatttgaacccatactataatgctttgacattttagcacttaaggcctcttagccaaaacaatcaccacttttttggcaacagtaaaacttcctctgacttccctgagagccaactgcctctcggagtactatactacacaggtaggcttcactggtccttttctaaaaacacgtaaaatgatataaaatgtgaagaggctctgactgttttggaacatccattaaaaaaaaggagagactcttacatttgggctggaattaaaatgcaacggcagctgcctaacacagggcagcagttacgaaccataacacggtgcctggaaactatggaggcttggtggaggcagccacggtcatgctgagggctaaaatcaggggcctcctctggtgggtttggagcctcgagatgcctgcctggcaggctcggcttaagtaggaggtgggtctgagacaccacttagcctacagagtgattccattattgggatcctcacagtttgggtggaagaagctccacccatctcctaagggaagtctgtcagctacagtacgagacatttcaaaagaagtcaaaggagaaacccatccaacattgtaagtgaactcatttgggttttttgggggatacagggtgggaaaggaccagataaatgttaaatcctaacctcaacatgtatttcactcatgtttctctactttaatggaacattccattaccattcttatctaaaaggtgctaaatccaagaatcctataatgtattaaatctcagaattctgtgtttgggcaaatgttttatctgaggaaacagatctctaccgtggaaaactacaaaaatggcagatttttaaacatttacatagcacatttttggtttttcctagcaaagcgctcagaatgatttacaacatactaaagccttaagaaatcatttcccactgatggtgcaactgcattcctgggctcctctctctagcccagcaagaaatcataggaactgagagctccctttttctctcaattatataatgtctaagatttaagtgcgtatttggtgaaaccaatgagataacagctgaagcacaaggaagtggccatggtgggaactgaaaactaaaaccccacgtgcactctgggccaccgagatgagaaattcagattgagaaacttggccggtcagtgacggagctggggctcgctctcgggtggtcttgctccagagatttgatgagaccctggttgttgcccaactctattactggccgcgtgaccttgggactctgagcccctgacttccctgtcacaccaggaaatgcttggttgcaggttgggcccccgggaagcggcctctgagattggaagtttttagagggagttaccttagaacacttgtcggtacagtagcgggcagagggagaatttgggctgtgatgcagtcacaatcccccaggttggcttggagctgggatggcatttgcgttatcccaaattgggatcaggaaatgggttgttgtatcccacctggggcagtcattggttgtaggttgccctggtgtgacccttctgtgaggtggtggtcagcaaagggctatcggcctagctggggagcgggcccgccagtcctgtggggggatctgagcggtacagcacagtgtctgccccatgttctgggccctgccttactcaggtgacctagtgagagaatgccagccccgtgcctggtaatcctcagcctgctcagaatggaaatgagtagctgcagctctggctcttactgggggcaggcctcacatctcctctccatcctggccctccaaatgataggactttaggagccctttcctatgtgggcctttggtatagagccagtcaaaagaaatactgctctgccccaacagaacctgaaatctacatctaaaatacacatcctggaaggtgtggtgcaggctcttggggtgggtgtgatgtgatagtgtgcgattcaagtttggtgcctgtactgcctggctgggggatgctgggaattgtatgtctcactcagacatggtgtgggtatgaatgcaaacaaggctttgggtgaagctctgggttcccggaggcttgttatttatccccatcctttctgatttctagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttagtgcaccgtg

SEQ ID NO: 37756 - DNA, 4849 bp, Homo sapiens
ggctcccccgcaggcggtagcgaaggcagcagcagcggtggcgacatgagcagcggggcggcgtccgggacagggcgggggcggccccggggcgggggacctgggcccggggaccccccgcccagcgagacacacaagctggtggtcgtgggcggcggcggcgtgggcaagagcgcgctgaccatccagttcatccaggtagtgggccctcacccgggagggtgtcccccgggacccagaactgagcccttggggggatccccgagaccccttttcccccttgacccatcactgagaccctcctataaggccctctaatcttaaaagatccccacagattgtaacctaaactcttggagagcctccatcccctgcacgggggacccttccttctgcactcgcatcccgagacccactattccctctcccagtgcctaagaccccgcttacctgctgacctggctttgagcacctcctgggagcatgctaaatacaaaatactcaccccattcggaccctaagcactcccaggacccccaccacgcccttggtgccaccttccaccaccctgagccctatctcccccaaatcccagtccccaacttcccctctaagccattgagagccttcctgggagaatgccagtgcccagcacctttgagattccaccacgttcgattcttttttttctttttttttttttttgagacagagtctcactcactctgtcacccaggctggagtgcggtggagtgcagtggtgcgatgttggctcactgcaacctctgcctcctggattcaagcaattctcctgcctcagcctcccaagtagctgagactacaggcgagtgccaccatgcctggctaatttttgtattttttagtagagacggggtttcaccatattggactggtctcgaactcctgacctcgtgatcggcctgccttggactcccaaagtgctgggattacaggcatgagccaccgtgcccggccccacgtttgattcttagccccttccatgactgcccccagaatctagaaattctacccagaccctggccctgagactcttctgggactacccagtcctaagagagtcctgctctccgacccgagatttaaaaagacatcctgccccttggccattccagaaatctccaagaccccaagtcctgacaatcccccattcccggaggcccaaacctccactctcccaccccacccccaaggaaaaccagcccctcctccatcccatgctttctccgctgcaactccctgagcccctctcagaaaccctgaatagctctcaaatcatctccatggaagaagcccccagattcttggcacccccagaaagatctattccttgggagtttctctgaccccataaatgaactcaatgtttctaagactgtatatactataacctcccaaaacccctgagccacctccgggctggctcccagttctcagccctgagcttctcacgctgtgctctgaggtcacgcccctaactacccccagagccacaatccctcccagggcttgatccttacagcctccctccaggacaagcccctcaccaagcacccctctaaccgacagatgcagccttcagacccctagcctccacatcaccccctttcctgaaattccaccccagcccaggaaacctcctccccattcctgagggaggtcctcccagcttcaaagaaatcctagaaaagtgtcttggcctgacatgctaccgcagaggccccggggccccaggacacccccctcacccccaccaagagaccccttcaagggcctgggaggaagccctgcttgtgtagagaaaggccccagccctgggccccttgcacccagaggcagtcccagagctggccaaaggcttggctggcagcgggcaggacccaggcaggaagggaggggctggggcccgagggtggggcagcctctccgcagccggattggaaccgggaccttcccctgggaggagacgctggaggccgcctgagcaggagaaggagacgggggaggaggagacgggggaggaggaagagagggaggaagcagaagaggagggagagatataaacaggcagtctggacaacaacgcctccgataactgatacattcaatatttaatggggttttgctccgaatcttgccagtgctggatggagtgtagtgctgttcttagcctcctttttcaaatgaggaaactgaggctcagagaggggaagtgatttgttcagtgtcacacagctaggatgtaatcacgatgtgggacatgtaccttataccagaaagagaggaccaggagtgactcagagagaagaagactggtaggaggggtggggggcagggaaaggggggcaggggagcagctacccaaagagaaggggacagagacccagagagagagagtaatagagactcagagagacagaggggacagagacccagagaaaagggggcagagacccagcaacaaggacagacatctggagagagagagaaggacagggcagggcgcagtggctcacatctgtaatcccagcactttgggagacccaggcgggcggatcacctgaggtcaggagttcgagaccagcctgaccaacacagcctgaccaacacatctctactaaaaatacaaaattagccaggtgtggtggcgcatgcctgtaatcccagctacttgggaggctgaggcaggagaatctcttgaacccaggaggcggaggttgcagtgagccgagatctcgccattgcactccagcctgtgcaacaagagcgaaactccgtctcaaaaaaaaaaaaaaaaaaaaaagactcagagagacagacgggacagagacccagagaaaagggggcagagacccagcaacagggacagacatttagagagagagggacagagactgagagaggcatcccaagggcagggcttcgtcctgtctgccggggcactgcagtaactatcctctccccaccccgccagtcctacttcgtgtctgactacgaccccactattgaggactcctacacgaagatctgcagtgtggatggcatcccagcccggctggacagtgagggcggcaaggatggatgatggatgggggtggtgtcagtgggggctgagggctcttgggggtgactgcggggagcctggtccccacgatggcccctctccctgtctctgcagtcctggacaccgcgggccaggaagagttcggggccatgagagagcagtacatgcgtgctggccacggcttcctgctggtgttcgccattaacgaccggcagaggtgacaggggttgctggtggcggagcagtgggtgggtgtggggaggacctgggctctgcagctggctggacctcatgcctccggcttcactcgcagtttcaacgaggtgggcaagctcttcacgcagattctgcgggtcaaggaccgcgacgacttccccgttgtgttggtcgggaacaaggcagatctggagtcacagcgccaggttcgggacacccctctttctggggaccccatctcagtctgggaggctccttccagcacacctgtcccccatcagcatcctcctctgttcctgcagtgctgcgactgccactgtcacacagctcacctagatgggttacccccaaactggaccttcagggtccccggcatcaccgagcagagggcctagcatgcaagtgtcctcaggagaggctgctggacggaacaaaggacattcaccccccgtccgccagctctctttgccccttcctcgcattcctcccttccagccaacctcccaccagccccagcacctcccctgctcatggccggccccctccatggctccccagttcctccccaggtgccagatgccccgcacagttgcgcccctcctttccctgctcccatcacttcccccacaacgatttccacacagaactcatccatctggcaaaggctctggggatttccaggctttggggttccgcctgcctctgccgggaacaccctgacttccctgcctgcccactcctggttatctaaggcatagcagggcaagtgcccacgaagcctgcccccatcccttacttagaagacaccaagcccctgcggcatctccctccataatctctcaggagctcttcctctttgagttctcacagtgggtcacctctcctagagtatccagcctgcctgtctgtctctctggctgcggtcaccctgagtgcagggacctgactcccccgtgtcccccctacccccaggtcccccgatcagaagcctctgccttcggcgcctcccaccacgtggcctactttgaggcctcggccaaactgcgtctcaacgtggacgaggcttttgagcagctggtgcgggctgtccggtgagccaagtccccttcctgtcgtccttgtccccagcccttccactccaaactcactggcgttttcccacaggaaataccaggaacaagagctcccaccgagccctcccagtgcccccaggaagaagggcgggggctgcccctgcgtcctcctgtagcccaggcaagagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacg

SEQ ID NO: 37757 - DNA, 131999 bp, Homo sapiens
ggcgggacccagagccgccgcgggagcttccagcgtccccaggtagcgcgggcgtcgcggggcgtggcggggcgggagcgcgcccgggaggagccgcgccagggtgggcgggattatggggggtctctctgcccacccgcagtccccacatccgcaggctcatggggacgcgagagcttggagcatccctttgcacccttgaaaggagggtgacctggttacctttcgctgacctcctcacagctagcccagctgctctgacaaagcacagggccccagagggtgcttgcttccagaatactttgggtgtcttgagcagcctcctacctaagcgtcccccagcacacacacacacacacacgcgtgcgcgcgcgcgcactcacacacacacacacactggcggaggcgggggtggccagagggattagagagataaagtcactgtcagtcagaaaagataagaatctgggctggacgtgccacactggggtcttctgaaagtaggcgcagcatctgcagctcctcatgcccggccctaaggtgatgcgggattgatttttcttggtttgttagccgtgaaagccccgggctgtaaaaaggtttgggtcaagaactagactttgatttattgaggcttgctttgccctgctatgccacaccttgtggtgtctggagatggggtattttggagcactcatacaaagtttgaactggtattcaagtgagcttgaatactcacttgatttttaacacttgggaattaaaaaaaaatgaagatatacattctcttagtttaaattgagttttatttttcaatacacatgcatgtattttaagagaagtaatcactggtgatgtcactcaaataatgagtccagcaggtgtggcattgttagaatttgaattcgaaactaagtttaccgtatagttttagagaaattgactgcttctttatgtgcctttttatgcgctgtattactgagaggtgtgtgtgctgagaatcctgtcgcatcatcttgctcttggtgagaaggtctcccctggtgttggccaccagatctgggaaaaaacccaaaatatatattttttattactagtgtttcagtgtgtgcaactctgcttcttgggccgctagccttagtctctggtgagaagaagtaggtatcaaaaatgtgccctagacacatttgggagcaaggaggaaggctgtagatttctttttccccattaaagttttcatgtattggcaatttaaaccccaaagcattgtttaccacctgtcagatgcactcggaagcgtaaggattaactaataaaagatttgtaaaatgcttcctgagtctaaaattctataaatatgctaaatagtaataatccacccattgttaaatttatgtagctgcttatgccatgcatgtaagatgatttagatgcatgtttcctgtcaattaaacaatgagtttggagcaaaataacgagttcagttcacatcctatgaaactttgaaataaaatttctcccataaagcaacagcagagaatcgtaaaataagctgcatttcaaaaagctgtatatgaaatggcatttaccttacggttgggtgaagagggacccagtgaacttctgaaactaagaaatagtcagccctggttcatgtgtgtctgaaccataaacattccctaacagggagggcatgcaggtttttgtggaatagcctcatagctttccagtctaatccatgaaatatgcctcttggcattttaaggttgaattcaacctgtggttttgttcacagacaatgaagaaaatctgtatacctacttggattaattattgattcctccaatatcatgggcttggttttgaagcatccttaacaccagctatcattttaatatcctgcagataattggtttgttcccagttgatttagtggcatattaacatttttctcttagcatggtttgaataacaaagtgtgtcgttcttctgtttaccgacatcctagagtaaaacccgtttcttatacgctacttttaagtataaatactgatacaagggatcttttttgttgttgttttaggtagacaactctagatttaccactagcaggttaagctgtgaccttaatgaagttggggatgtcttttttttgacacttgtccattttagtggacttttcttttcatttccttcactaaaatttggatgcgcagttgctaaataggctccattccagtattctacaaccttccctctgccgccactcctcctttatccaagtaacttaacctctgctctactttgtcttgatttgacaacaagttggtacaggtgaaagtgcactaggtgaaaaataaaagagcttgcatttccggagcagctgtgatatactaggcactgtgccacaatatctcattaaattcttgtaataatctggtgaggcaggcgttgtctgtgtttcacagaaaagaaaactgaggctcaaagaagctttcatgcccaaggatgagcagtttatgaatagaaaagccaggatttgaaccactacagtctggtacttcctgctgcgttgcagtctctaagaagagttcacattctgcactgaagtgtggaagagttcttctattaattagccatttgacctcagagaagtcctttaaaccctctgggcctctggtttcctttcactagctttggattaaattatctctcagagatagaagagacagttccaggattttggatgccaagcacataagctatttctcccacaggatcccagcatatgctctcccttcccctttttccacccccttccttcccgtttttcttcttttcttcctttaggtctaagtaaattgcacttcctctaggagtcttcttctgaacacctttctgttcttctctatctcagccctcagttatccctcacggagccgattacaaaccgaagtctcttatttatatttgtttaatatgactgttgtttttgtcttcttccccatcactccttacttccccatcagaatgtaggctgcataggccagaactctgttttctgacttttttcattactgtattcccagggcctagcacagtgatgaatagcacatagttgttggtctgtaagtatgtttgaataagtaattatctcttataaaagacacgtgtgaatggctaatatattgtcccttccttgggaaagcctaaatgaagcatcattgatcttatagtgttagagagggtgagcctgaattatgaatggagatctgagtaccataatggagacgacagggccgccctcagacacacaggacaaatggacacactgcacctagtacaaccccatattttacggcagaggaaactgaagctcagaatgataatagaaatttaggtctagacaataccttagagatcagctaatagtctcagccattgttttattgatgagcaaactgaagccccccaaaacagaccataagctatagaacctaagccttctgacttataaacagcattcttttcactcagatcaaaaatagtgaggaccacccagtcaacagcagtaaggagctttggacaatgatgctttctttcagaaattcaaaagagccttaggttgcccagaccaatcctgagtagcagcattagaacatcttagtatgtataacctatttttaaatttcttctggtctctataaacttcggtgacacatttactattttaataatccatcaagcagccttttaatacttatcattagtttaccaattctatttaaatgcttggacagtccaaatagaaaatttacagggctgagcatttaacactggtgtgatagattaaagatacatttaaaagatgattgctagtttgaacctcaaaatattgatggcttatctttaagcaccaaaatgttaacttttcttctctaacatagacagcaatccttgctaaagtattacattttataaacaaacagttcttaaagtttagagggcataaaaatcatctggaaggctttttaaaatcacagattgcttggagccattatgcacagttctgaattaataggtttgagattgcacccacacaactgcattttgacaaatatctttggtgatttctcaatcaaatggtccgaagatctcattttgagatccaatcacaattttgatatctttttaatttccccagattcttcctaagaggatatttttaaaaaagatatttcgggaggaactcagtgtgtttgaatccagctaatagcagagatgattaaaattgtttgctaggtatgatgacatttgtttcattgtagcaaaagctgtgtgtgtgtgtgtgtgtgtgtgtgtgtgtgtgtgtgtgtacataaccatgctgtggctactagacttgatattggctcaaatcaagcatgttcaaaaatgtttctattggaccacaaaaataaattgataagtagtaataagagttgagtgttaagtttcatgaggaaatagtgaagtcccttgttctccagatggttacattctgtacagctgagagataagattaatatccacaaaacattcaggataagtttgcaaatcaaatacaggatgcctagttaaatctggatttcaaatacacaacaaatcatgttttagtaaaattgtgtctcccgtataatatttttatttgctaaatctggcattcctgatcagagaacattagtgttcagtgtcattagtttctagaagtaagggtgctgagtggtggttgttaagcttaatgaaattgataaaagctctggacgtcctcctgagaaaaatgcccccatggcacattccaacagccctcgcataaccatcccttgggttccaggctgccgaagctctcggggacatcaggtcatctacagtgggggacatcaggtcatctacaatggtggacagcgaggcaaattcctcaggctattttctctgggctggaaaggtctggaaggtgactgtgaaaagtatagttgaactaggccttaaagagcagtagaatttagctggattgtgggtgggaagacatctgaagctttgaaaggaggcagattccctcaggccttgagggtatttagttcagaatactgataaatcagcttgggcaggtaaaaaaaagaactggattgtggacagtcttaagttctgaagggtttagactgcccatgttggaaaataaagagtcttcattgatatgtaagtggggagaacatgatcaaactaaaggaaagaataagaaaaatcataggaagcccaagctccagagtcaatcagcctggtaagagctcctccatttacgagctatgagttctttgacttgtgagcaacttctgtgagtccccatctcctgagttgtgaattgggaataataatagaagctactaatggggttgttgtgagaataaaatgaagttgtttggtgcttagcacagtgtgtgatactgcataaatattcaattaatggtgcataaatactatgatatgctcctgctgcccctaatattgttcaagaaaggcaagtctcagcaacctgcttgaacctgatttttttttttatcttgggggaagtgaaaaaaagaggaaaatgattgatttctggatttgaatatagctttaaaatctcccttttccaagttgaaattgcattaacaaaaaacaataagggcagaaacaagtgagcaaaatgctgtgtgtacttctgagattttttaaataagtacattcaaccctttattatttctcctaagaggaaatattatggataattcagataatttactctgatccaaataaacattttcaaattgtatgtgttactcttaatagcaggtttgccatcttttttggccaatatttaaattaatcagcgtgtgaatgttgttccccaaagccttttaaacagtaagataaaatgaggttatcagagataatttgcaaagcagccaggtttcccttgagtaggtaataaggctgaccactaattttggaaatgatatcttgggtgctctggagccagactgcttaggttccaatctctgatggttcctcccccaggccagtcattttgcttctctacaccttagtttcttcctataggtaaaataaaagtagtaacatcccttcctcaaaggtatgtgcactgagtcctcagtaaggtgcctggtacacagtaagcatttgccagcatgtaagaatttcccagcatggaattttgtgaccaaagcaatatagtcctcttactggtatattattttctttgatatactcataaataatttagttcaagaaagcatctaataatgtgggagctatttatgatctttagtcacaccttaatgtattgatgtacgcagccagggttgtttaaaccattttccaagccatggagtacaatgttactccatggcttggaaaatttgaaagaatttttagccgcatctttcattatgtgctctgttttttgttttgttttgttttgtttttttacttatctatcttcaactgtgacagggtgattggtgcctttctaaagagctttgggtttcttgtgcattaaagtgtctgggccctagaatttacttggctcataaacttatgagatggaacaatacaagattggtttaaggtacatcatagttgcatgtatgacagttattttttatttagtttatgctaagcacctggagagcatctcccacagtgccttaaagatagtagactcaaatatttattgaatgaatttaatgtataataaaatgcattgcattttttttcctgaggatatctttccctcacattagaaaatctaactttttaaaaaaagagaagggaaacatcatgcagatatttcaagactgaagtattatggaaaatgtgaacttggagatctaccatttgtattttctggaagtgctatcattttcacaagcctgtttctcccatagggtctttgcattattagctgttacgtttctctggaatattcttccctcagatggtgcttggcccagataagatgtcacctcctcagagaagtcctccctgaccacctaatctcactcactttctattacatcactttgttttatttattgtagtatactaccatttgattatttcattttttaattgcttatcctcatccttactggactagaagtaccctgaggtcagaggtcaagcctgcatgtttactgttgtcttcccaggatctattatagtgccaggcatttcacagatactcaacaaatattttgtcaattcgttgaattaataaagatcaggatatggttttttagtgttatcctaacacatagcaataatttctaatattttgagtcacatttacctttcagaattggattaaaattttgaaactcctccccagtgaaaatttacatacacaattttttgcatataatttaagttcatggatctcaggctaagaacctcagctctaaaagtgtatatacaaatattaagaaaatctaattgcactattgagctaaatgtcaccaaaaaattaattactacaaaagaattataaattttaatgctcatatttttacagtaatcaattacatgttgcctttggagaattttgcaaccctccagaggaaaaaaaaaagactacctataaatgttatatattttatttatatgctggaaaggatttagggcctacagaaaaaggctaataaaatatacaccgtagagcaatataaaatgtatttcaaataggtaagaaaaaatgagtcaaaggaaaaaaataaggctaagaacataagatagggccatgagagagattcatactgaaaatttatgccatgaaattcaacactcttgctagaagatagtaacaaattttgttctcagtttttgagcaggcaatgcaaaggagaaaaaaatcagttatgccttgcagagggtcatattttatatatacttacacatgaatatatgcatatgtatataatagaaactacctcttaaaagaagaaagcttgagtattgtaataaggaataaagagatatatttctggtgttttgtttttggcatgtgcccttgtagctgagcctgaaataacccattaaaaaatgctttaaaatgactagcactttgaacgtttataattaaggttttatggcttattgtaatttttgtcagcagtagacctttggaaagaggcctcattacaccagtaagaagagatggagctggtgcaatgaagacaatgggttttctccattttcttacagctcctctttttacctaaccaagcagagagacacgtcccctccatcattccaccatttccattgttacacactatttaataaaatgcccgaagccctcgttctcttcttaaagaggcatgcacctaagacattgactaaagcaagttattcctgctaaccttagtttccttggataggagtctatctgggacttctacgatttctttctttgagagagcaaatacaataactggcttctttagaacattatgtggatttgtggcattctctgtggggctataaatggatcacattgacagctttatttgtcattcttaaatggaatgtgtttttttcccctttgtgttagatcaaaatcagatggcatttcttatttcaatgtggaatgtttttactctcataattgcagaagtgcattcataactgatactattctaatttacaaaatttgtgtttcatgatttgggggcatgagaaaaatgtgactgagggaaaacatcttatgcaacatttgagtttcgcctatttattgagatcctgatacagttgctagaattctgtcaccatatggaagcagagacaattatattgcatttgatgacataaattttagaagctaagatataaaaaggcatatccagcagaatatctacaatccagagacttaggcatttttgaaatatcttctctcctttgtgtcccctccagcatgtctgtggactttgtccttcattcctccccttgtaatgactcttattcaatatatacagtagcgaaaatgaagataataggattggaaaatactaccttcatatcttagcacacatcttatatcataaaaccagttacatctgctcaggtgaaatgtttcattcaaaaacccctattattcccattcacccactactaagcgtgaatgagaaggtaaatcttcctactttcgtttcttatatccattcaaggctttcaatgctcttgtgactgaccccagttctgtgcaaaatgtaccccaggatttaaaaatcctgagttggatttttaaatgccagcctaggggtacatgtttctcactgaatttatgtcttttcatactgatttcacacactcacactttcaaaaaagttgtctttattgataatctactatgtgttagacaccgaattgcatcagatactctctgcctccatttagcctatggactagaaggggaagacagacaataaaagaatgacacacatgaatatggaaccgaaactcttctaagtgctacaaaagagagttagaaggttctgtaaaatgagatccaaatgatgcacaggcatcaactagaccgggcatacacacagaaggcatgctacatggggaagtcctctagaaggagacagaacaggcagcatgaaagactgagggaaggtcgggtgcggtggctcatgtctgtaatcccagcactttgggaggctgaggcgggtggatcacaaggtcaggagtttgagaccagcctggccaacatggtgaaaccccgtctctactaaaaaaatacaaaaattagccgggcatggtggcatgcgcttgtaatcccagctgctcaggaggctgaggcaggagaattgcttgaacccaggaggcagaggttgcagtgagccaggattgcaccactgcactccagcctgcgtgacagagcaagattctgtctcaaaaaaaaaaaaaaaaagtactgagggaaggccacactgtctggagtgcagaagaggagtgaactgcttaagtctggggatgtcatcaggtccatcaccaagggagcctttttagccatatcaagaaatatgcctttatcctaggaccagtgagaagattgaggatttttgttgtttatcgtttttttggtgggggtgtggggagtgctgtagttagttacatcatcaattttacattttgaaaatatatttctggctaccgtgtggaatatgggttggcaagggggaagagtatgcatatcagtgaaatatttcagtagagagatagtgataccctggcctaaaggagaaggatgaggtgtcagtgacttccaaaaggtgaatggattcaagagatatgtaggaggtaaaattgacaggccaccttctgtgatatctatgtgcaccccatgaggaagtgtcagggaacaatggtggaggaacatgtgtgtgaaaacagatgctaagttcagtgttggatgtgttgagtttgagatgtcttgagacatcacgggagacagcagacagacattggattatgggtgtggggcttgtcagagatataaacttctgactcattgtgacattcataggtctggaggcagataagattgcttagagaaagataatgaagcaagttatagaagaaaacactgaggccaaaatgcctggaggaaatcaaacccataatggcccagtagtgaaagatgagcccacagaggatggaagaatagcaaaagaaacagaaggaaatgcagggattcctgggtcatggggggcagaggagcaagggttctaggaaagtagcagtggtcagctgagttgaaagaagactgagaaatgtgtgttttattgagcacggatggagaatactggtcaggagagaattatttttgaattaaaataaagagaaattgctaagtgatatgtacaggaaatacagttgtaactggttctgtctgtcgtcctgcctgtttgagagtattttacgtgttcatgtcttgcatctgtctcaaaaagattcttggggagtagacaagatagagagaaaaatcattggcctattggtgtccactagaaagagagagaaactaggatggagtttgggcatagaacagtctgaggttggccgggcacggtggctgacgcctgtaatcccagcactttgggaggccgaggcgggcagatcacgaggtcaggagatcgagaccatcctggctaacatggtgaaaccccgactctactaaaaaatacaaaaaattatccaggcgtggtggcgggcgcctgtagtcccagctactcgggaggctgaggcaggagaatggcatgaactcaggaggcggagcttgcagtgagccgagatcgcgccactgcactccagcctaggcgacagaacgagactccatctcaaaaaaaaaaaaaaaaaaaaaaggacattctgaggttctgaggtctgaattggagagaaaagattgaacctgcataccaagagtattgtatgagcacagccccacctgtttctcccatcagtggtgctcctacagccagggtaaataaatgtcacgaagcagtgctggcttgcctctcccacctgcttgcattgctgtgtggggagagagcaggggtggagggagcctaggacatcacagagcacatgtctggggacttccctgagctacagcctcagttttccttcctgcttctgcttcagcaccaaagttggaaacctacccagagtaggggcaaagtggacgtcactgtctcagcacaggaaacaaggtgctaaggcagaggttagactgaactgctgtgagctgtcactgggtggtaagagaagaaagatgagtgtctatgattatttgcagtagtttgcctatgaagaggaagtgagagattagcgggcaactggagagagataaggctgagtaaacatttattcattcaacaagtatcaacgtatcttatatgtactaggcattaggactaggacaggcaccaggaagacattttccgtccctcatggaaaatctaccataaaatatacttatgcaatgaaataaattcatgtgataatctcaaatgcattttgtaatctgatgtcttaaaacaagtgcaacattttccctcagatttaaatacttacttgatttttataaaacagtcaaatttgtgttttaagaaagaaaaataacacatcaacttctactttttttctctctcatttgctcttttcattctttttgtctttcaaatcagacagtcttgctgttgtcacttattattaaaaaatattttctaaaatggtgtccttaacccagtgttcagagcctttcacagtgatatttgactgaaaaaaatcctttaatctcctataatttttagagcattgaatattatcccatggaagttagaaatgtgaataaagcaaggtttccctagctagactgtaaacttcctgatagcaaaggcactgctgggtgtatagctatctagaataaagccagagtactataaatgcgactttcataggaagggtacaattaaggatccttggtttgtagaagaggaggatacaatgaattcttaaccaaggattcaggaagacccctgaaggaggtggcatttaaacttgctattaattcatgtgttcttcacatcactattcacaatagcaaagacatggaatcaacctaggtgcccatcagtggtggattgaataaagaaaatgtggtgtacatacaccatggaatactttgtagccataaaagtaacaaaatcatgtcccttgcgacaatgtgaatgcagctggaggccatcatcctaagggaattatcacagaactggtaaaccaaatactgtatattctcacttatgagtgggagctaaatgttgggtacacatggacataaagaatggaacaacagacactggggactactagatagggagggaggggcaagggctgaacaactaccagttgggtactatgctcactacctgggtaacaggaaaatttgtaccccaaacctcagcatcacacattatatctatgtaacaaacctgcacatgtatcccttgaatataaaataaaagtagaaattatattttttaaaaaataaaatcttagttctttgaaataaataaatataactgtgtgttaaaagttgagtatttcaggccgggcgtgatggctcacgcctgcaatcccagcactttgggaggccgaggcgggcagatcacgaggtcaggaggtcgagaccatcctggctaacacagtgaaatcccgtctctaataagaatacaaaaaaaaattagccgggcgtggtggtgggcgcctgtagtcccagctacccgggaggctgaggcaggagaatggcgtacccaggaggcacagcttgcagtgagctgagatcgcgccagtgcactccatcctgggggacagagcgagactcggtcttaaaaaaaaaaaaaaaaaaaaaaaaaaaaaaaagttgagtatttcagacagcagacagctactaaccaaggtctcagaggcaggaaacaacttttgtcaggggttagggggtggagagcatttgatagtgaggggagatggtttagaatgtctgcaaaggttatgtggaaagtggtaaaacatattgatctcagatcttggaaagcgtacttgaaaagtttatcctgttgaggtctgttgaagagctgttagaagttttcaagcaaggggagaagcatgaggtttaagaaaaagactagaagcacccggaaacctgggaaatgatgggagattggaagcaggaacacattagatgagaggtcattgcctacatgggagatggaggatggtgggtgagtttctgaactatgacagtgaccttggatatgtcaatgggaaatagggctttttgtatgcaaggtggccataatctaatcattggttatgtgtgttgtggggagtaagagaatgaagatgatgccaagtgttgaaccagggagagtggcagtgccactgattttaaggaacaggggaaaaaggcaaattcaggagaggatggggatgaagcatccaaaaagatataatttaagctctagatatgaataaaattgctgccaagtggagaaccttgtggaaggcccacgtttaagggaaggcagaagagaagccagaagaagaaaattcaggggagtttcttgagatgggaattgaggtttcagggaagtcaagaaaaagatgtggatttcaaggaagaggcctcatgctgtgatttgtttcactgatataatcactaggttgtgccttttctctttctcttcctttccctgtggcacagccccacgaaatgggctgtgcagctgtccgttttgtctcacatctgggtccacacttcatttttgcagttctgcccttactcattaatgagcagcaactggcctggagccaccggcaatcaacaatttccttcagaaactcctccttactgttgagaaaatgacttagtaaggaagctgcttgtgtctttgttagagaggcacagaaagggaggagagctggatgatttgctaattgggagttattggttttgtatttaaggtttcctgattcaagcttcaggtttgtttctaggaataatacagtttttacagcaataataactacctccaagcaaaagtactgttttgcccttcagtttttatattaggtagtcagtcgtactcataaaatagtccattttatctcaatgcctctatttcaggttttacatgaaaaatttctcaatgaattttttattaggaggataaaatatttggtttctttggaggaagtgatatgttttctcctaagaataggacttacagggtttctcctaagaataggacttcgttttcctttcacctaaattaccaagaaattcaaatccatattataacttcaatcacttcaactgtgttgaccagtatatatggcctatatatattttatatatatatatatatatatatatatcttttatttatatttcattaatttcttggaaagcacctcaaatcctcaaggtaaaaagaaagtcatggcataaataaataattttactgttaactaaattcctttccaaacattatctcatttgactgtcaaaacagtcccactgagtaactggtattattacttccacctggaagatgagggaagcatcaccaggaagttaagtacttaaagttcactcagatggaaactatgagtgcgatttgaccccagatattctgtctccaaaggcagtagtcatttcagccttctttgctctaacttttgtaagcagctaggagacttgtaaatggcatgtagttggctggcatacttctcattctcatgagaaataatcactgacatgagaaactaatattgtttgagtggttttcttcttgatagtgaaacattccatgcttgtatatatctctttcctaggttttataataatcaagaagcacatgaaagaggcctcttcatcaagcattcttgactaagttatgaaaatggaattgaagtttattttcccccttcatatggtaagtaactactaatttaggtaacagaattggctttcccctttcttacaatatttaacaaagaaatggaaaagcatcttgtgtaaagatggcatgacttatgaataatatctagattgtcttcattatgtttcacaaaaaatagaaatatttcgttttttagttcaattatgggttttataaattctacttgaatatattttatctggtttagaatttgagtcatttggacctacatatgagttttgattactaaaataacataactcttctatccactttatacacagttaaaattctttagtgcgtagcattttgtacaggaaattgacatgtggactctgaaaagtcatggccatatacaaggaagatttagaaatgaccagattgctgtgcgtggcatttctctttttcccagatgccttagcttggagcatccgccctttttggcctgggcactgaatgtctttaattagaaaatcttattagaactagagtcatcccaagtgagtaaaatcagcttttgaaaaaaggtccacattattgagttttttccccagagtattgtgcctaaaaaacgtagaattatttgaaatggacagtttactctcctttgtccacccataaaattatttgttattttcactcttcattgtattttatttttcttcatatgtttatatgttctaatgcatatttaaaaggaaaactctctgtgtgtagctgcaaatattgtaaaatttcatttattccaaagaattaagatggtgggcatatctgaatttgtgggaaagctgaattatagataactcttaaacaaatgtggcttttattatctttaactacatatagtaacttcaacaaatcataataaagtagaagtccttaaggagacctgttataataaatcatatgaacattttgttattagcatatagattggatgtatgtaggaacttgtaaagtgcctgaggttccttgaaaattgtttattctgtgtctaaaatgtgtacataagactgaaaataaatgtttaaaacaccatatattatccacctataaataaagtatttacaaagcaaaagtaaatgtccacccagctcatgaacaaattatcgaaagattttaaatttattgaagtcccaaattaatgagatattaccatgtgtgcataaataacttaaagaataaaatttgctgatccttctctcatatgggtatttgtgctaatgaaccaggatcctatttacactattagtccccaaagtaattgcttatttgaagaagttctgtcttatgggttttcagttaattaaatctatttgcattttatgcacacatttcaaattctcaagccctacgtttcataagccagattcaaatatgttcatgtaataatatctctcattaaggctgtagtctttcatttttaaaggaacattcagaatagtcatatgcataaaacacttattaataaaatcctttcaatattttagaaaagtcaatccattaaatgttatttttttagtttaaattttcctatttgtaatggtgattactatgctgaacagacttccaatctctaatgtttccgttaacttaatttattcaatgatttttttgctttgattttgcatgtcagtttttaacttctaatatgcctttagaattacaagcacccttttcaaggtacgtgcatattaactggttgatcttgcctacccaattggagcaaaaatatggagcaaaacttttctaattttaatactgaggaacagagtacaacaattcagaaagttagagagattttaagtggtatagttttcaggtagttgtcaaatatttgaccaagaagttgggaattaaagtacgtaagtgataaaaattgtaaacgtcttcattagatccaaactatggaaatctttcattgctatcctacctgggaagcttgaaaaagatactgaaattaggagatggaagaagtagagggacaggccagaaggagggcggggccgggaagctctgcagggtccatgctgtgtagcaaggcaaggccagacattggggaaggtacccaggggcacaatttggaaagcaggtttgaaatctagttttgaaatcatgccatactaaactatctttagggggttattacatgctcacctatttcagtgtttaggtgtattagagtgcatctaggtgtattcctctttgcaaagatgtaaaatgcaaaatctgaatacatttagattcaaaaattccagcctagtattatatctgaatcaataaagagtaaagtatccaagaggaaaaaagaaagaaagaaatgatatcctaaaatcaggataagcatgacacttattttattcttttacatagaacaatattggacaataatgtgcttttgttctcatcttaacatgggattatactataactataagaagaaaaacaatttttgatgccctgaaaaatcatatgtcttataataagcaaatttcattcagttaattgttatttattcatttaagcaatgatctatgtaaagtgtaataccaatagtctcctaagaagatatcattttcactggaatagccctaaggaagcatttcttctcatttagagaaagtagggataaagcacttgtattaccatttgtataaatttttaatactgaataaaatattagtatttagcttaatattgattcccaacataatattcctccataatggcatgctaattggttagaattaaatcagacagattcaagaacactgagaatagaccatctagcacttgtaattttttttcattagtttccagaattccagttaaaatggaattaatctgtcgattaaaagaccatggaacaataaaagttctgtgccttatgtcatgtgcaccgcctttccctcccactgctccatgcccaccataagaagggagcggaagaggaaagagggcaaatgaaacgcacatgaaattcacatgtgaatttcaacctcaatgtcattgtgttcaagagtgagagtctacatgcattctagccctgtaacttactatgtgtgagaaaggcattttacataagtctctgggagtcacaatttcctcatcagtaatattagtctaacagtatcagcctcttagagtcataaaggaagtaaaacagaggttcccaataggaggaaattttgcccatcaggaggcatttggtaatgactggagattgttttggctataacgattggaggggttgagtgtgctactggtatctagggaggccaaggatgcttgctaatatccctagatgcataggatggcccccaacaacagagtcatctggccaacaaaatcaatggtatcaaggttgagaaaccctggagtaatgtgaagtaatatatgcaatgagcacaatgcctgatacacaatacaccctcaaaaatcttagtataattatgttgttactgttgtcatttgagaaggaactccacatcacctaaatggtatccgtactgagtactgtcaacagttcagcaagcccatcccagtacagttagtcaggcctatctgctaagttacctacttgaagtggccaatatataggtgcctttaggagtagagtgacccacttaatacttgactagtctagaaggcacatagatatgattatagcaaagttcatgggccgccatttaatttctcagaaagtagtcatttaatcttcttagaaattggaagaaatagaaaaagacaaataaaaagtaacttacaggccagccacagtggctcatgcctgtaatcccagccctttgggaggccgaggccagtggatcacctgaggtcaggagtttgagaccagcctggctaacatggtgcaaacccatttcaactacaaatacaaaaaattagccaggcatggtggtgcacacctgtaatcccagctacttgggaggctgaagcaggagaatcacttgaacccaggaggcagaggttgcagtgagccgaggtcgcaccattgcaccccagcttgggcaacaaaagcgaaactccgtgttaaaaaaaaaaagtaacttataataccaagtgactgttaattttttaacttttgctgttagtaatgcatcaggagtctcctgattgtcatgttttactttataaaataagctaatatttggacaaatggctcagaaatatggtctgattaatatgagatcttgattaattggttatgtgatacatgaatattatcaatttcaaaaccagttgaatgcatcaaaatagttttgacttgatgctaaaccattttaaagggggaaaaaatcttggttaatgcaagagttttgaggtcagacgtgagtttgcatttcagctttacaaccttcaagctgtgtgaccttggataatttacctaatttctctgcactcagtttcttcatctgtttaacaggcataaatttaccttgtagggctcttgagagaattgagacacaaaatatttggcatatatgagaagtgagtaaatgaaaacagttattattttcatcatctttattattttgaccctaaagtaattctggggacctcgcattgccttggagttctaattatagccttctcttctcattgtaaagaatgataactatgatgttaagtactttttactgacagagaaacttcaaatggcatttgttacctcaataaacaaaaatcttagactcatttcaaaaaaattcatttctgaagaaaaaagaaaacttacatatcaaacatagaatttcccagtaaggatatttttaaggaaatggcagatttccaaaattaaagaatgaataatgtacacatctttctagcatattttaatatagttgataatccactttttaattagccacctaattataaaccattacaaatttccccaggtgaatgtagtaacctacttcagagagggaagtggctctttgaatgggcattcctactatgaaatttgacactttttcagtcccaatttgttctaaacttaaacagctcaggagagatgggaaagagctctgtttcataacctaatcatttctactgccagaaagattgagtagaaggctaaattctaaattcacctttcatcaatgtttaggtttttcctttttctttattccccagagaagaccccactttttatgtgtgttcccatcattcgtatgttctaagtttgaaaataaaacatttacaattaatccaaactctgggttccttcatttttcttggtggtatgctttctgcttagctcatgtttccccaacttaaaactctcaataagcaaaggactgaaaggtacctgagaagagcatctcaatgtcataatagacaattgtttaattccacaacccagacaatgttaaggagggacatttttaatctattccttagcattcaatgcttgaagttcccaaagtttaatcatttttttatcgtatattcataaccttagtcaaaaatgtgttcaacttaccaattggtccagcggacatttattgatttttgtattgaattctctcttccagccagttttagctttgtgtagttacaactctaatatgtttgcatttaattttaaactatcacctatcattaatgtcttgctcatattcattaagctaatgcaaagcggagagttgaactattaattttaatgaatttaactgatcactttgcttccacccttgcctcctatagtcttttttcaataaagtataaatcatataattttgctccttgactcagaacctccattggctccctgtttcactcagagtcagccagcagtgacctgcctgacctcacttccttccggttcctccctctcccattctactatattccagccaccctgccagaacatatagtgtgtttctgccttatgaccttttcacttgctgtttagtctgtctgggacacttttcttcagtcacacatccacgacctgctctctcacttccatgaagtcttttgttcaaatctcaccttctcaataagaccttcactaactacctctaaaaatgtaatctcttcccacacttcctagttcccttttctgatttatttctctctttgatacttgccaacttctgataaatgatgtaattcactcgttgttacagtctttctccctcatctaaaacataagctgcaggcaggcaatgattgttgttgactttcactagtgtatcccaaccatgtactccagtgcctggtattggttaaattgaattgaagttgaattgcacccttattcacctcatttcttttccctcagagccataatttgccattctgcaatatagtgattgtatattctggtgttctgcctttattatagtttgtttaggaaaattttgatccccttacccacagctagacttacgagatggaggccatggtttcattgtattttctttttgaccattgataaactttaactaggtaagtttgcattttagccatattcctttccttattatttttcctattgggcaagacactgttatcaccaaaatggtaaatttactgggataaattagaatcatgatcaaaacactgggtaaattcttaggcaaaaaaaggtagatacagatgaaaataacaagctccacaagcaattaaataaaaaaacaaaagaggattagtttcctttgaacctaggcacacttttcctagcatacatgttcctagcataaatattagagccttgaacctggttcgagaaaatacctacctactgatgacaaggaagccataaatataatttatgaccaaaaattagtcactgtttattattgctggtgacacatgatacatagggggagatttggcagtgtttcagacatctccagccagccatttatcatatcatagaagaagaggaggtatttctatattaatggcctctataaaaggaagtgagtagaggaatgtctgatatgttttgtcattgagaatcaaagggacattgacaatgttaaaaatgtgctgagtggattacaggttttgtataagtagttcttcaaaataacaatgctctattaaaaaaagaaaaagaagaagtagaagaagaaaggaactatgttctatgttgcttagctctctcttgtgccctcgaatgacatttctggatgcgagctgagaaacaaaagcttgatttatctctagaaccagcaacattttgagcagcttgatagccttgagaccctgctgactcacagccatgctactgtcccagcacgggtttacactgcagatcgttttgatacaatacgcagagacccaacatacccactctctctcccaacttagccttaattctttatctcagtctataatgtagaataaaacaaagaccaaatcatgttaataacttccacttgattgagaaatgcaaacccatgttccctttgtaactactatgtctatgcaagtggagacataaagccctttgggagaagactttaaatatggggttggagatgtgaacagccaggaactttgtctcagaaacggtaggaataagccactaaaaagttgttttaacatggccaataacttctgtgatgctttgcagaattctgaagacgccattaaaaattaaataaaaagcctcagctcagttttgtgtatgcttcaataggcaaaaatatatatttaatgcagagggtgttgaatctgaattagtacaaatattattaatttaatgttcatactgcattttatggtttataaactgcttagcaataattttatacatttttcctcacagcagcactgtaaaatatatcggcattttattttcccattttatagatgaggcaacctttaataagtgatctatttctttcctgtgcatatcagttaacgggtaaatgattaatttatgtctacatgaacttcatcatgcagaatatttattttagtgtgagttggtatttattttacccacaaagcattacagtatccaattatatatgcatgttttaaaggcagtaaagcagccaccagtagttaatgcaacattaagtcagagatttttaaatctacataaattctgagttagggtattaaatcaaccatccctttttcaccaccttggttcatgtgggtgagaaatggtccttctataaaatgaccacatggcatctggggattgggacagaaaagatgtattgagatttacagaatttacaatattaacagtaaaaaaagaaccaagtgatttataattacatttggtgagaaaaaagtaaacaaatcttatcatttgcctctgcctgtggaatagcttgtgatcatgagacatcttttttggtctctttcttctttcactttctgccttcatttcttccttttgttttctttattaatttttgcatctgtaaaattgttgtcttagctgcttgtatggaggagcataagcagccatacataagtgacatgttaaggtttcataaatagggcaacaccccatgaagctgtcattggcattatttctccatattgcattatattatattgagctataagtaaaattgcttctttgaaagtgtatggtacttaaaggccaaggatctcaaaatgctccctaagcactgactcagctaatacacttctaatatcaatctactactctaatgctacaatttagagaggaaaaagcaccaaaaatttcagtcattttattctaagtcagaatttgtttaattagaaacgtgccttctttccatgacaatttataatatataattctccttcatttacagatctcaagactcttaaatttagccaatgaagctaagattttaaaaaatttattgcaaggagtccctgccctaattccacatgcaaaagtttctgataaagtctaaagattggcttgttagctgagctgtcaaaggcgcagatgatttaaaacacattttgtgtgttaaatattaaactctttctgaatccagaaattctctctcaaatttaacatgtatttttgaaaccaaaaagtacttacaaatccagaaagtgctctgatgtgaatttaaagaaaatatttttattattaaaaattttgtatatagtgaaatataaaacccattacattagatctaccaataagacaacatattatgaggtaatatttttaaatgtgtgatttcctatcgggtctgttggacaatgtctacttaattgggcatagaagttttaaaaactgaatctttaaaacaaacaaggggcattactacagaggaatgtcactgaaatatttgtttcagacttcttgcataaagactggctataaaaggaacaagacggggctgtacttcagtatacagtttcttaactcggagttagatacacttgacctgtgagtgggcattggagattatttttatataatgaaggcttttactatatgaatataaatatggagatttcagcgatcttactctctgtgataaaaatagaaaagaatatatatataatatatatacatatagtcaaaaggagcatttcaaatattcgagtacaaattaaatatatgaagtacataaattttctcctttaaaaaatccttccatgtaataaaatatcctaatgaaatgctgttactgctttccttatgtgccaccgttgcaatatctagtacccctgggcttttcctagtccaagactttttcgatggcatttattattcccatttatatttatttgacccatattgcagcttctaaattggatatatcattttcccctgagaatttcttgtccttacctagccttacaagagaactgtgaatttatatcactttctagtgcaacaatgaactgactgggcagagaaccagataagactcctcccttccacttcctcattttccaccatccccttatagatcatgaggtgcaagtgagcatcccattattgtaaatgttgaactgggcttgattcccaggttctcagttttgtaatctcagaacccattattacagtgtttctgttttcattggtcatctttgtatatattattctgttagcttttgccaaaatgaaacatttcgaagagagatgcttatatggaaaaactgaaaaaccattttgttcctgctaagtaaaaacactgtattccctttcaaagagaatttatgtataatcaggtattcatgatttttcagaacagcacgtggagaatgttactgaaactccatcttgcttccacataaagtcagcacagcacttagtcagttattacctagtatttccatgcaagcgaataagtagcattttagcttaaaatttcagcatttagtttacacatcacttaaaaactcttatgagtaaacatgcctatccattagaaattgtttttatttgatagtgcaagtacagaacagagagaggcaaaagggcaaatgcaggcagtgtctttccaacaattgataggacaaggagattctgggccaggaacacaagtctctggaccatgtagcaaatgtgtccctggtgagagaaaaatgcattaggttgtcatggcctaaaaacaccagccatttacacattctgacgaattcccctgattctgaacccagactaacttggtaaccagttcattgattatgattctccttcccatatacctggatttatatctatatctatacctttagagaaaaatacagcaatcagtcagtatagttcattagcttgatggacatatttttattgtaaattagtatattggcatgctgctataaggaagcattttaattaatgtggttgttatcaatgaggtcattttaagatcatacagctctcagccacacatacagaggtagaagttccatttctggaacaagagatgagtcatttcttattcacatttgcttataaaaaatacagtcatccccatacatgccatcacgatgccttctctaccccacagaaaagagaactaatgtttgtaagaaattacagtcagtttaccactatcctcagagaaataaagtctcttctgcaggttcctgcaaccagtaagtaattagaggtgacattaaaactcagttctgacagacgtcctttcaactaaacttgtgtctctgtctagaatcaactgctagcaacatgccctgactaggagaaacagatgagatttctttggctgctagagaataaacactgatcatattggttacttcctctaaacaagtctaaactcaaatcccatgcccaagaaatgggtgttctgtactgaccccccaatctcgatggatgtgtagaaaaaccttgtctaatcatttagctatgtatattttttggagtctgattttaaaatgaatgacaaacacaaaggcattttgttcatagtgaacttaagtattcattgtattctccttatcttgaaatttgaaaaacaaagagaaactatagttattttatcaagcagtttgatagttgtctttcatgtctatttatatctcttgatttagtcagagtatgtaattagtcatgaacccagtttccattattacgttttgtcaattgaaatattgttttgtttccaagtatacatttatattatttacctgcaactaatttgaaaatggttttaaatatatgtatttgaaactgctggaaagaggggtgacaacactcttaactgattatagacttagtgatgcacaggtaaaatattttagatttgcaccacacactttagatattaggagtattatatttcatgttatggagatagaaaattctgatgactattttttatcctaaagaataacagacaccaaatggcatttattcagtcattttgatttagtttaataaggtcattcttccatcttcaggtaaactatttggcctaaactacttcaaacattagaacctttactttgagaaaagatcatcgtcaaagataaaattgtatcacctacatcgggagctcatttcagtgtttagtgtccctcctcactttgaagaaattcttcctaacatataactcaagtcagcccccaaatggcccatatgttctcttctgcaagtaatgtaataaatacttaattattttgcttattcttgatttttcatccttttaatgctcagtttgaatctatgttcttttcccattatcccaggccaccaggtttctcctagtctagtattgcttcatgggccttctgtgttactgatggcattatctcagttgttggtgttgtttcttttgaatatgaaactcagcaagctttgccctcctcatttagttctgatgtttctatgatgtaatccctaaattacttttttcagaattccttcagaaatgaagtgctaattaaaaacaacaacaaaaaagaaggctgttaagaaggctcaaatacagtttatgctaaaaattttaaagaagacgatggacagttttctctcttggatgctgttttgaatgtagacagaaagataaactaaatgaccccctgatgatctcctagctctgtgattttgtaataatcttagcttgtaacatctcattttctgcaaccactaaaatcttatctgccctgagatatgtgagtgtttaacagatgagaaccttttgatagaggaaagacgctgcttgttttctcagaagtaattttcttaataattgcttacctttatatttgaggcagtccatattgaatccttaaatctagagaaaatcataaaaaaaaattaacagacatactatataatgatatgcaatcaatccttggcttttgcctttgttgccccggcattagaaatatttacttctatagtcacggtttaaggattcatgaaccccattttttcaaactaaaatcattcttgctttcgacactgcacttgtttctatttaaaaggggagttttgttaacatcagtgggtattttgcctccaagtgaggctaccttccaagcagggttgccatagagcaaattgcatttgacaaggctgtctggggaagatttagcagtagttagattaagcttgagcttgccatttaatccaccactactggtattgtgtgctaagctgatgatcatacttagaagcacaacaattaggttattagttttctctctttttttctttttttattatactttaagttctgggatacatgtgcagaacatacaggtttgttacataggcatacacgtgccatggtggtttgctgcacccatcaacctgtcatctacattaggtatttctcctaatgctatccctcttctagccccccatgccccgacaggccccagtgtgtgatgttccccttcctgtgtccctgtgttctcattgttcatctcctacttatgagtgagaacatgcgatgtttggttttctgttcctgtgttagtttgctgagaatgatggtttccagcttcatccatgtccctgcaaaagacaggaactcatcctttttatggctgcatagtattccatggtgtatatgtgccacattttctttatccagtctatcatgatgggcatttgggttggttccaagtctttgctattgtgaatagtgccacaataaacatacatgtgcttgtgtctatagtagaatggtttataatcatttgggtataaactcaataatgggattgctgggtcaaatggtatttctggttttagatccttgaggaatcgccacactgtcttccacaatggttgaactaatttacactcccaccaacaatgtaaaagcattcctatttctccacatcctctccagcatctgttgtttcctggctttttaatgattgccattctaactcgtgtgagatggtatctcattatggttttgatttgcatttctctaatgaccagtgttgatgagctttttttcatgtttattggcttcataaatgtcttcttttgagaagtgtctgttcatatccttttcccagtttttgatggggttgttttattcttgtaaatttgtttaagttctttgtagattctggatattagcagtttgtcagatggatagattgcaaaatttttctcctattctgtaggttgcctgctcactctgttgatagtttcttttgctgtgcagaagctctttagtttagttagatcccttttgtcaatttggcttttgttgccattgcttttggtgttttagtcatgaagtctttgcccatgcctgtgttctgaatggtattgtcaaggttttcttctagggtttgtatggttttaggtcttatgtttaagtctttaatccatcttgaggtaatttttgtataaggtgtaaggaatgggtccagtttcagttttctgcatatggctagccagttttcccaacagcatttttttaatagggaatcctttccccattgcttgtttttgtcaggtttgtcaaagatcagatggttgtagatgtgtggcattatttctgaggcctctgttctgttccattggtctatatatctgttttggtaccagtaccatgctgttttggttactgtagccttgtagtatggtttgaagtcaggtagcgtgatgcctccagctttgttcttttcgcttaggattatcttggctatataggctctttttcagctattttggaaccagtagaaaattttataaataatttctacaaatacaaagtgaaaaaatagacctcatgtatcagatggataatttacttaaattcaggtgctcatgttattattattaattacatcaataatgataatgatgatggtaagagtgtcccataaaaactagctaccctgagctaatctgtggcaaaactttatatgtatgattttcactgaatcgtcacaaaagttctctgaagttttaccgaaataaaaatggtgagttatgcatatattctgggacattttttctgatactgagtttgactctccatgaatatttttacaaggagttgtttagcattcagttgattattttttgttatttggtccaactgcagtttagatgatacagaatgaacatagaaaaccatagcattaatcttgcactgtaaaagccctatttgtattgtgacaaaaatataaatgtgaagtaagcagaaaaaaaaagctatgtaagctcttttctgaccacggaactgttaaaaagtatttgagtcttatgttgtttggtaacgtttctattgtgcttactataaatgcgaaaataattatgctactgtccaaaatgattctaaagtttcatagtgaactatttttatcaaaaatttattagttcctcaggtaaatgtgaagcattgaacttaatacaattaccaagatctatgaaatacagaattaatattcaataccgatctgaattatatggatcagtaaatatttgatctaaggaactaaaaaggaaaaatgcatgttattattaatattcctgtctcttgaataaatacatgacttctgggtggaatagtgagtttatatacctgaagagagcagggtttagttatgctgaatataagctgtgactaccactcaaatcacctaagccccactgtactcaaaattaggaaacatttttaatataataagcaaaattggaatagacttgtaaccacaaataaccaatttttttaattatagcattgacagaaaggttgctattaactattacaggcaaacaatcagtgatcactatgacattttgctaaatgacagcaagcttcatccacagcattggatgatgccctgaccagatacaactggagagtgcactggaaatacagtctttgagtaatgattttacccagttggccttctatgtgtcaatcaaacggttggcccagtttgccagttctctccttgctgacatcagaactgaaatgggttgatgtttgaagtcctatagtcttctctcaggtgtccacctgagaatggaggaagggattataagccttatattccattatcatccaaggtattattattctatttctttaaatactaaaagcatagcctaaaagtgatccaaaaagctaagtcatattatgatgtaataaatgcctagtaaacaactctagaactgaagactctcaagattgaaggtgacttcaaaggtcatagatgatgatcctaaactcttctgacaactgaagtgatgctaaaacacacagacaataggactctcttgaccttccaaattcaggctgttctgattgatagaaaatcctaattgagccataatctgtctctctataaattccctttactggtcccagatgtaacctttggggctaatgaactgttgacttcctctttgatgccctgacaagctcctttccaacacttcactatttcttctgttttccttccttcaacaccctactcactttcccctgaacatactctgatttttaatgttttacaaacccagggtattgcaaaaacaggataaagcacaattagcaacagctcattctaagcactgtctttctcttaacaccaaagttgcttttgtggctgctatatcagagtgacacctgaaattcctaagtgcttctcaaatatctaagccaagtcatatgtgccgcaccctgtatctgcacagttgggtttaggttttttgtttgttttggacctccataggagacctcacatctatttccattaatgttacctcattaaatttgttccatctcaacttcaattttattttcatttggaatgtagactgtattctaattctgtcatctcacttactcagtaagtgaaatcctaactttgcatcagctgtaaatttaactagcatacttatactttctatttattcaaatacctgatttttaaaaaatattgacaataacaagaacacgggcatcagcattagaaatgtccttctagactgccatccattgccatctctagctgtgaccattcaacaaactgccaacacccctgatgtctcgctcatattttttcatcttagccccaaggatgccatgtgatgccttggcgaacatcctgtagaaatccagataccttaataaccaccattggttaacctagtaactctttcagggaaaggaaatgatgtttgtctacaagatctgttccttagtgaatcatttggtgcccggctgtcagtctcaaaatggtttatttgaggcttacttatatgtaggttttgagaaactatctccctccccattttgaaaatcagatccacattcaacaatcctttgcttgtgtacacctctcctgctttctgcagctcctcaaagatggtcagcaagggctcagtaggtttcattgatagcagggacctcagcttactcattgtccctagcacccagctctgtgtctgcaacataagagatatcctgctatttttaagaatcaaaacactaaaaacttgttattttggtgctcatactcctgttttaaaacattgaactaggaattacatatgtctggaaacaaaattcatttacacactacatttgaattttgaattgaacaaaggaacactcctacacctgaccacatgccacgcccacttaccacccttccatgtcatctttctgtggttttaaatgacattctctgggtttccagaaagataatttacatttctccagagacacattgagcaccagttttcctgtagaggtgcagatggagctacatttgaattggctggtgaagaggtaggagagaaaagcatggggcactgaagaaaacaagaggaaggcagaacagggttcagagaagtggggttgtggggaggtttccaattcagtccctctgtcctaggactgcagtccctctgctcccttctttccctccagcgctaaattctcctaggaccagaccccttttctaccagcataatggaacttctcccttcctagtcatcttaagtaaatttaagccagaacagggacattttgagtggaacaacttctgaacacaaatgaaagggtaatatgaccaaatctcacatttcaataaaattctggtaatttatttggattaatcaaaatatagaaacaccagcattgtctctttgccctggggttgcaatcatttctaaggaataaagaaatggataaacagggacacagctctcacccctgaaggcatttagaatgcaaagtgtcctcttaccctctctttattcatcttctcttccctctctgcaatagtagtctatcgtttcccttccaaacatcattctctccttgacataaacaacaaaaagaaaaaaatcttacagctctgttctttttctcatccatcaggattgccatcctctctcagctgccggtctgttttttgagggaacaatgtgttccttgaacctgaaaagcaaacaaagactggacacactggctcacacctgtaatcccagctactttggaggctgaggtgcaagaatcgcttgaacccaggaggtggagattgcggtgagccaagacagggccattgcactccagcctgggcaacagagtgagactctgtctaaaaaagaaaaaaaaaaaaaaaaaaacaggcaaacaaagaaaaacctaaatgtattctgctatattttttttttctaattggtcttagatcatttgagaattttcctttttacttgctattcccttgcccggactactactctttacctggattttcacagggccaatgcataccgttcaggtctccgacctagagtcagtgcctcctcaaaccctgactgcggtgtccgaaacaaccatactgcatcgctccctcacccccaccctgctttatttttcccaaaagcaccattgttaactggaattaaagatgtgccttgtttatttataatatttctccccaagaactttgtcgtgcttacacttgtatccccagtgcctggcgcagtgctgctatatagaagtttcttaatagaacacttggacacaggaaggggaacatcacacactggggcctgttgtggggtggggggaggggggagggatagcattaggagatgtacctaatgtaaatgacgagttaatgggtgcagcacaccaacatgacacatgtatacatatgtaacaaacctgcacgttgtgcacatgtaccctagaacttaaagtatagtaaaaaaaataaagattaaaaaaaaagaaccaaaaaaaaaagaagtttctcaataaatgtgtgctcaattaatgaagcaaaatagatggtttaaagattatgtaaagcagagctacacagaaactagaaagaagatcacataataaccactgtagtggtttcttcattatagtttccaactttttttttttttaattagagatagggtctggctatgttgcccaagctgatctcaaactcctggtctcaagtgatcctcccaccttggcctcccaaagcgctgggattacaggggtgagctaccacccctggcctccaactgtctttcacttcagaattatgtgcaactacatggtagaacttgctattttaaagtaacttttgcttttttttttttcgaatataatcagaattgctttgataacctgaaaagtcactttgtagacagctaaaaatatagacagataaacttgaaaagaaattactcataatcctaacatcagagaaaactaatattaaaagttttttggtatgtttagaatttttgcaaacatctcaatcttttcaagacattattcctttcaaattcttatgctatagaattcttctagtctgttcttcaaactttaaaaaaatctgttctcataaatttgccatatttgtctgattttttcagacctatccccatcacagtttttaaaattatatatttattgtctgtaagattcctgttatttctgcatggccaaccacttcccccgatgagttagaatttgattttttttttaaatatcagttcctccctttatttcctcaaattttcgaacaatgaaattgccaacaaggcaagacaatgtcctatcagatgtcctgaggttagcagaaaatgaattctaggatggatggttagaggttaccatcataaaaacacttgtctcatttagtcttatgactttattccccaactacggatagaccatgagaattaaggtaatggaaaaatcctgaagaattgccaagaaacctgtattcattcattcattcattcattcagttattaatttttgaagacctattttgtgtcaaacatggaggcacttgaaatactaccttagaatcaaagagcacattactcacaaaaggcacaccaattaattctcttacaaatatgtattgaacacctactacatgccaggcaccatgctaggcacacaaatagggaagaatcatgataccaacaatacaaacacacttgagtttaaatctactacatgctagcttataaattgccaaagcatttttttcatctataaactgaggacttaataatagtccacttaaaggactattatgagactttaaaaaactaagtcatccaagagtctagtgatacagagatgagcaaaataaatgctctattctcaaggtactaggagtttagtatataatatatataaaacctaagcatttcaacaatacttattgaatacaattaaatttaatacatggcaaaatatgctgctataatatttgtcttctctactgaatggtaagtttctttgtatatgtacaacccctaacatactatctgataagtaatggcatactcaacgaatgttaaatggttgaacaaatagatgccttataagtaactcactcttcctatcaccctaaagttgtgaaattctctcccaaaggcagagggtttatttccagagactttgttttagtattactaatttaaattcttccttaagactttaggaatgaaagagcagattaatttctgcctataaggtaggattacattagatattatccctaatttttataaagaaggttgaagtttaatccaccctgtaaaaatcacaagttgatctttgctctccacttgaaattattgaagcttctcttcccagaaataagtaacagtttggaaattttcgcatatttttctctatacaaactaacttcattaagaaagactaaaagagctggagtttctggtttctggggcattgaaaatgaaaagctgaaagtctaaacaatgactaacacattagtcatagtaagcagctgttttctaatagaacaagaaatgacgtgtttaaaatgctgcaggaaaattaggatagacataataaagaaatttttatctggcaagagtgactccaaagcaggtggccttagaaaagcatgcaatgtaaagtttttaagggttatacagcaatccttgaagtaattgtaattttaaaattgtcttccttaatacaagttgattggatgagatgatttcccaaggtctcaaatttttggcttgagagactttgcttattttccatgtgtcccctagagggcagtggtggcccaaaacccaggagagcgtttataatcagttgtatcctctctggcgccaaccttctctccagcctctttgctaattcacctcacaaatctgtcttctgtgagcaaattggcagtaacatgtttattcctaagtacctaacgagcaaaaccactacatattagaaaataacgttgcatgcgttatatttttacaaagatggaaaagaaaaatctcattttgctaagattatattttatgtttgcatgtattgcctgccttaacacatgcaccaaggttggtaggtcttttttgtgcatttttcatgaatttgggggtagagaatgttgtgagacagtggggaaaggtgacaagatgtgtcaaggcaaacaaatcaaggttttttcccttcagttggaaattcattttgaaacaatccttaagtattactgaatgactactcacccaatcatttattcactgaggagttacctaatagtctaagaaccattattagatgctatcgttggtaatgtgtggaacaaagaaaatatttcagggaacttgtaatttggaaagtgatactaaattacttgatacaggtataaggaaggatgacacaggaaggtatccaacttgtgaattttagtagcaacataacacaaaaaccattactccttttacaaatgctttggatatcttttggaggaccacagatctgaaatatttttcctgttccaatggaacacatgacctcatgttttaaaggtgatgactaaccacaggaagcttcctagatagacaaagggagagcctgaatatgcatttttctaaggcagaggctttctgttgtaatgttgctgtctaaatattttattcttctgagaaacatttttatgcaaagggtgcaactttcaaaggagcctttttgcagggttgccctaaaagcctcttctaatacctgagaatttatctttcaggatctcttttattgtagtcagaatatttgctgattaaattcactttcatcgtctgaaattgggagcaagatacaaacctcaagtatgcaaagaaaaagattgatgacatcaaaattataattcagtcaatacttgctgagccatttgggtctctgtatggagcggagggcaatgaaaattgcctacccatacagcaatgagtggctttgagaacattcctgccataacttttggtcaaaccaaatggtgtggtttgtttatgtgatcacttgtttatgaagattgctttggttgcaaattatacatatttgcaatacttcttggaagaattctgccatcacatctgtagccgtggtctgtattacaatcaagactatttagatgttagaaaatagattttcagtcctaacaacatggctggggattatttatgatattctaactctagattaggaatggcatacattgaaactggtagatattttaagtggcattgctttgaagagttaaagtagtaaaatcacagtattgtcagtgtacaggttatgcttaggaaaccaggactgactcagaaagaagacaaaattgttacgatgggaccagaaatcagaacattttaaaaaactatttctacttccccaaaattgactgggccagcagttttttccaagatcatggtaaattgttttaagactttaccgaaggacagaagctttaaatacttcttaaatggaaaacttctttagaggaaaacaaaattaggataaagacctagaaaattattttatacagaaaaaaatactatataatttgcttcttcctgaagtatggaaatttccctaaaaagcaacaaatattattttgtataaagagcatactttatacataagatccaatttggactttataaatactttcgactttattttgcatttgcaatttgagacaaacctgtaaatggttactgttaaatgatcattcttcctcccctgtcatgtctgcgcacttgtatttatcagtcattgggcatattttgatatattatctattgtaggtaagtatctctttttctgttgggaagagttatattggtggtcacagacaaccagattattttaattttagttccaacaaagaattacagactgctagctgcatataaactttataatgcatagacattttctaatttgtggctcattatgaaaatttccacttacaacgatcctatcattggatctcaggtacaaaaaaaaagccattataaatgggccaggcacagtggcttaggcctgtaatcctagcattttaagaggccgaggccggcggatcaattcaggtcaggagtttgagaccagcctggccaacatggtgaaactccatctctattaaaaatacaaaaattatccaggcgtggtagtgcatgcctataatcccagctactcaggaggctggagcaggagaatcatttgaacccaggagcggaggttgcagtgagccaagatcatcccattacactccagcctgggtgatagagggaaactctgtctcaaaaaaaaaaaaaaacaaaaaaaggttataaatcaccactgcattaatagcattgcaataatatattcatagaaaaataacttatcttccttagaatgtatagcttgtgaaagcactttcatatatacagcaatgcatttgaacttcatgctaatcctaggtgggtatggttaagtccccccatctctaagaatttgagaggatgggggagcttctcaaggtcacatagtttgaaaattgttaagctggttctcagacaagctttcattctgaatctagatccatgtgacattcttatgaggctgtatttactacatcattgtattcattttattgtacaaggcagcctacttatatgttcatgtaaaatattcacaatggtgttattattgtgtgaatggcagtatacttaatgcaccggtgttatttgccccccttttggagaggagaaagcagagcttcagcaaggtcacataatacatccagaattgtaccgctagtaagcagtggagccagggttctaatccagatgtgtccagctctaggcatactgtgtcatctcatagtatgttcttcctgaatacaaggtttcctatatgttcacaaggacatttttgtgagctctattttgagtgtaatttgcatggcatgccacagtgcctcttgaacatcaacagaagaccaactgaagtcacctgggaagccccagggtcctttgagaatgacagccccacacccctttcctttggttggttgaagggctagaagaaaaagaggggctgggtaaagcacagttgactctctgagtacagtacagatagagttagtgaatccccatacttaaccaccctccacccccacgaaccccaagtcaatgaaaagataaagaagagctttagaaggggagagtttgacaatgaccacaatcctgctgtcagctctgtggacatgatggtgacaaaaaaatcttcctgaagtggtaataacaagctcatggatattagcagtggtaagcaacaaggtagctgccaagaggcagcacccactgacatcaaagggtgcaggccattaggggtagctgccagggcagcccaagaggctacagaaaatgcaatctaattgtaatcatttcaagttctttacgacttggattatgatctcccataaataagaaagcatcagatgtatggtggggacatgatccaagaggaatataacttaaaccccactcaagaatatttccagtattaatattccatccaaccaaatagttcaaactctcagacagatagtatgaatatgactttcagacaaaacagtcatttatttggtacaatatattatgttacaaatacagattattaaatttctagttctctaaggggccattttgtttgtgtgagtagtttatttacaactggcaagatccacatgtctgactagacgtcagactctgttgtgttacttacgtaaacatactatttgattaaattcgccagcataatcaatagggggttctggttgtcacattaattacattctatggaaattctatggaagcatcatttaattagatttttcacttagtacttaacagagtataagaaatgtcatcatagttttttgcacatggtaatgaaatcattggtacattaccaagattaaatcatacaagaatgtctacccttctgttttcctctctgctaaaattataaagcttcttacagtaccacctgtgatgataggcaggatacacagaatttcaaagctttctacaacacctaccaatctccatgtcagaacaaattagtatttccagcctactgtttattattatggcattttagagcttaatagctcaatcttaacattaatacatctgcctttattgtgtgtttaatatgtgcagtgaatatgttaagtgctccatttacataattgtatttaatcttcaaagaaacactttgaggtttctttcccattatacagaggtggaaactgaggcacagatcacttagatggtaaagaatagagccaggatttactcagttctgattcattccaagtcccatctagttattttttagttgcagaaacaggcccagagagataaagtgtctttccaaagtacacataactggaaagtggcagagacaaaactagcactcaggttttctgactcctgcctgttagttttattgccagagccatcactgtaggactgagaagttcagctatttgtttgtttgtttgtttcatttttgtttcagccaatagcagccaggctcagagacatgtgagcaacatccactagcactgctgcctgtgatgtgtagagcaatcacatttttaatggactgtgtgtctgagtcctttcttgtccacgtagcttttaaagtgatctggagtaaatctattgctcacttggcaatcagtatttggcattgttcctcaaatggtggagttagatatctggattttgctttctcctacatccctggaaactttttcctgagagtgccatactgtaggtccgttttccaagagcaagaactgtgactgtttcataaagaacctttcagtctaagcagcaaatatgtggccatgtctttcccttgctttaaacactcagataagagtttgttttgtatttttttagtcacagatgggtgttacattttaccagttgcttatttgtatctcttgaacatatggttttctattttactaatgtggtgatttatgactgatttttgaacgttgaggcaactttgcattcctgaccacttagtcctgatgtactattgtttgtatatactgggaggcagggctcactggagaccaccaaagtaatagtttaccaaaatgaagatgccactatattaattacaaaaatgaagtctttttatttaaatatcctactctgggccaggtgcggtgcctcacacctgtaatcccagcactttgggagtcctaggcaggaggatcacttgagctgaggatttggagaccagcctgcacaacatggcaaaatctcattgctactaaaaatacaaaaatttactgggcatggtggtgcacacctgtaatcccagctactcaggagactcaggtaggaggatcacctcttcctaggcagtcaaggcagtgaactgtgatcatgcctctgtactccagcatgggcaaccgagtgagacccctttttgaacaaacaaacaaaacaacaacataaacccaaaaagcttctactctgtcttctgtgttgaagatgtggttgatggttgatattttgtgagattctcctgaaaaaaaatgttttggaaatccatatctatatagtgtttcaattccaagttttgccctatagatccatttattcctactcttcaaataaaaaagtaaaattttaacttctctgacctgtgcaatattaagatcccaaacctcttaaaaactaaaatctgtcaagttccttttgcaagacggttggctcagaagtttgggcttctaaagaaatgagagtttaacatttttatattggacatattttcagaaaatttagaatcccattagtgttctttgtaacatgctgtgctcaaaactaaattttttcaggcttcaaccttatgcatataaaaatgggttcacctcaagttccttatgatttctttcctttagaggtgcttgacttttctacctcctttagtttgacgttggctgttttgtgtactgagtcttttcaccacatgtcccgaggacccaattactggctttttaatgagattaactgtggggtctgtatctgttctggcagacactcacaagtggtgtctgctcacagtaagtcattccacttttcagtaatattgtattatggttgtgaatttgagtttcatttagactttcagttttaatccttgaactcccctttctagggatgtggtattgcacaagtgacttaacctcccatacctcagctttcctgtccgtacagtgggaatggtaaaggagatacagtgggaaaagcactgaacagtgtgtcagctatggagtgagcattcaataaatatcattaccattggacaagttatgaatctctttcagttattcagaagcaggttattaaatttccaagttatccaaaaaccttttttttttcttttaccactacttactcacttggatctgctttttagcactttcaatatcattttagcatttgattcagattggttggttttgaggatgggagaagaggggaatttgtattgaccgtaaggcttggtggtggctgcaccactgcaccaatctgggaaccatttaagtccctcagaagactacagtcctgcaccatataatgacatttcagtcaactgtgaacagcacatacgacagcggtcccataacattataatggagctgaaaaattcttattgcctagtgacattacagccatctgaacaccacacattactcacattctatgatgctgctgctgtaaacaaatgtacaaagctgacggtcatataaaagtatagaacatattaatacaattaggtacagcacatagtatttgataaggataacaagggactctattactggttatgtgttgactatcctttttgtcattattttagaacgtactcctgtttgtatatattttaagttaagtgtcaaacagccttaggctggtctttcaggaggtattccagaagaaggtattgttatcataggagaggacagctccatatatgttattgccccagaagacaaaattgttataaatatagcaaaatgtttaagtgaaaaatacttcatcaatcatgatagcacattcttagtgttcaagacagcgatatgttggtttttcaagctgtaaacaagtttgatgcacatatgggttcctgtttcccttgcattcaaactctggacccttctgagtatctgtaactgacacattgtagaccacaaatttagatggagggaatgctttctaatactgagtcagctgcctctctgctaccctaattactgtttgataataacattttccagtgggacaaaatgtggaggtgaaagacagtgatattgatgatcctgaccctgtgtaagcctaggctaatgtgtgtgtttgtgtcctagattttaacaaaaaaaaaaaagtctaaaaagtaaaaacatgaaaataaaacacttttaaaaataataaaacttatacaataaggatataaagaagatatttttgtacagctaaatgtgtttgtattttaagccaaatgttattataaaatagccaaaaggtttttaaaaattaagcttacaaaataaaaaagttatagtaacctaagattaatttattaatgaagaaagaaaaatattatcttatgaatatagtgtagcctgagagtacagtgtttataaagtctacaggaatgtgtagtaatgtcctaggccttcacattcacccactatttactcactgactcacccagaacaacttccagtcctgcatgttccattcctagtaaatgccctatacaggcataccatttttttagtcttttattcatatttttactgtaccttttctgtgtttagatacacaaatactgatcattgtgttacaattgcctacaggattcaatccagtaacatgctgtacaggtttgcagcctagaaacaacgggctataccatatagcctaggtgtgtagtaggctatgccatctaggtttgtgtaagcacactgtatgatgtttgcacaacgatgaaattgcctaaggacatgtttctcagaatctatccctgttgttaagggatgcatgactgtattaccagactattaacaaatgaggcccactgtgatatttttgcagaataccacatgatagtagttcaatgtgttgagtgagaaaattaataattaaaagttgttataaatgtaacaaaatatttaaatgaaaaatacttcatcaatcgtgatagcacatccttagttttcaagatagtgatatgttggtttttcaagctgtaaacaagtttgatgcacatatgggttcctgtttcccttgcattcaaactctggacccttctgagtatctgtaactgacacattgtagaccacaaatttagactaagggaaggctttcttacactgagtcagctgcctctctgctaccctaattactctgttttataatcagcattgctggtacacaatagtctggcaattcaaatggaagtatttgtgctttgtaatgatagctagcaactctctgtggtttgggatagctcaggacagatactccttgaataattaccctgctcaatcagaaggaagcattcttgttatattgctgtgcatgattgatccatgtctgtacagcatttttttgttatttactctgatgttcacaaagtgtgttcagttaacacatgaattgaattgtggcattttaaaaccataaagaaggttccccttgctggctgggtgtggtggttcatgcctgtaatcccagcactttgggaggccgaagcaggcggatcacgagatcaggagttcaagaccagccttgccaacatggtgaaaccccatctactaaaaatacaaaaattagctggaagtggtggtgcacgcctgtaatcccagctacttaggaggctgaagcaggaggatcgcttgaacccaggaagtggaggttgcagtaagcagagatggcaccactgcattccagcctgggcaacagaacaagactacatcttaaaaaaaaaaaaaaaaaaagaaagaaagaaaagaaaagattccccttgtcaaataagtatgggtagctcaaagtggactatttccctcttataaatgcataatttactttcacatataaatgccctgagaacccttattagaaattataattttctttaagaggaggataaaatatgaactatttccgaaacttgaccatttatgttaaataataaaagactatttccctttttttaatagtttcactcagggctggtacaacagaacacactttgggaaatgttacttgaccaacttatctccttttatttattaaattcactttttgggtaatttcaaaaataattttgtcacatttccttccatccaatttttctcctctttctcatccattttttcaagtaggtttccagatttatcaaataagaatacgcgacaccactgacacttgaattttaaacaaactgaataatctcttggtacaggtatgtgccaaatattgcatgggatatttgaatgtaatggggtgtcctctattttatctggcaaccctaaacccaagccaaatgatagcaatcagtgagtaaataataaaactgtcagtttaatttaataaaaagaacatggaaagaattcattcagtgctcattgaatatgtttttaagtatttccaaaataaaagtgtaaagcctttttgagactgctatatcttctgtatttttataataatttcaacatgaagagtgtaataaccctggtactctggtctgtcataaactcttttactccactcagagcactttcattttacagaggaggaaactggactcagagaagtgacttgacttgcccaaggaaattctcccacaggagctgataactgccaggcttgaggcgttttctactttcaagccaatggtctatattctcaccaggctaatgttcattgtatttgtagagccaaataaataaataaaactacacacaaacacacacacacatacacttttaaaaaaggtagtggttataattagccaagtttaccgctttaattgattaaaccacaataacatggaatagagttaaagtaaatttaaagcttaaaattacactttatataacttaatgtttcttttaacaggacattttaccatctcccaatatctcagtccctcattaatgtgtagtaagaaagagtataaactgaaagtgaatttcaaagggtttttcatgtgtctttgtgtttctatttataaactattgttcaggatatatatgctttttttttcatcattagccacctcaactgttttatcgagaagaaacatcaagcccagaaatattacagtataaacaagatactgttatgacactagactattctgttatcactgtaataacagtatactgtatactgtaattacagtgtaaatgataatgcttataaaaacaacaggtgtgatagatttctttcaatagaaaacagaactccttatcttcacagtacatggcatatcacctctgttattaaaaagaggaattgttcggattgaggtattgaaaactgttaagacaaaagtcgcttaggtactactttttgtttcctaggagtgtctcatttggtattcattccacacaaatgccactgtttcttcaggtgccatgtaacttcagagaaaggcatgagagaagccgggccttcagcaaggatatgggactggctaagaattaagaagaaagaagcctcactttagaactaatggggtcttgtatgtatagcttattcccccactggatagatatggatacttaaacattgagaaatctttattctctacttgaatagttgagaacaaacgatacactcacgaggaggctaaccttacccatgttgtccatatatttaaatgaaattttataataactccatctgttgaaatgggctgtgtgtttttccgcatgactttcccattttatctcatcaacctgaccttgctggcacaaggtacaatcactgtagtatcctgcttgtttcatcaggaagtggagcaatagtttaatttgttaaggaaatcccaaggaatgaactaaagcttgcgttgtgtgttttcccacaaattgtgttttctttgaatttgtggttgtgagggcatatcgctcatcgacacctgatccacaagtattggctgtttgtcaaggaccccgagaatcctgaagttgtcacgtcatagagatcagttctcttcaactctactcaacctttaatctacatgaaactttggatatataaaatactaaggtagtttacctgagtttaatatcagaatttaagatgagctgtagcccattagtctttcaagtatataggatgatgtcatgcattgtaatcagcaatactttgaatgaatagggaagggtaaatatgaaatgctaattatatgaaagtagaatctttctctgtcagtagtacctactttaagatgaataatactttctaagtatttgacctgtggcaagtgacttgctctttttgatcctcggcttcctcatctataaaatggggataatagtggtgcctccttcattaagtcattgtgaggagttaatgaaagtgagtataaaagcatttggcttcatgcccaacacatagtgggtacttactaagtgctaattagtattattacagcttaaaaagacaggtggtgatcttggtgtttattattatcatgtgcactagtcccatacttgtttatgacactgtaatctttgtgaaacatttttttatgatctcaaagtgccttttcatgggtgatcagtgttgacagtgatcacagtagaacagataacaccataaaagacagttttaaaattccagctttaaaattccagctttgcataaatcatatagctggcctttatatatgagtgattaaaagaaattataactaactcatcttataaaagttttatcatgtaccgttcttttttgggggggtggggggctgtgacagagtctcgctctgttgtccaggctggagtgcagtgtcatgatctcagctcactgcaacctccacctcctgggttcaagcaattctcctgcctcagcctcctgagtaactgggattacaggtgcctgccagcatgcccggctaattttttgtatttttagtagagacggggtttcatcatgttgaccaggctggtctcaaactcctgacctcaggcaatctgcccgccttggcctcccaaatcatttaccattattaacaaccatttaccattattaacaaccatttaccattattaacaaccattgggcactttcctgcccaaagtgccattcaaagcaccatggggatggagaagcatgaagcttccgtgcctctcaccaaatcttcaagctcttctaagatggataccgtgacaggatgtgagccttagcctctgatccctggaatcatcggcttatgtttacaagctaagtgattgtgcaccttcgatgctgaccctgaagtgtttaatggcttatgtcacccacatgtgatgcagttaactacttgaccataaagggggagtttaccaaatgataaatttaggtcatgtgaagtattaaagtaggcataaatatttacagagctaaggatactctgaaattgtgtgcagagagaaggatattattgagtcaggcgcaagaagtgaggtcatctttgcttttagattaggaaccattatgaaaggagtggtggtgccaattaaggaaagcctcacaattcagcttctttccaagaactgatgggtaggtctccttccaggacactggtgtttctaaagcacttgtattccttttgaagtggtatctatatacaagttagtgtactatacactaaattacttcaaaagctttgcatccacatagtcagaagatcagggttagattaaatgacatgtatattacagatgcttggtatgcaggaaaatgtgatatgaacataggggaaattatttttctgaagtagggtgtttgtgtatgtatttgtagtccacttattttcctagtttctgcatgtagtttagctaacttgtacagatgggagaagacacagcagttgcaagtcaacggcagagcaaaacattcaaacttcaaatactaaactttctacctcatacaatttggtggaagcttttatgtataatacttacagtcagcatttggggagggaggaattgggggaatgatacagttgctatattattaatctttggcactcctaaatcaaatgataccctatgctgcacagcattgtttaaggggcctcataatgagcccgtttttacacttatgagtaggtatagagctttacatcttacaaaacattttccacaaacatcatttcatttagtcaccttaaggactttttggaaagttattattcttgtccccatttgacatatggaactttgcggtgtagtgggttaaggaagtagcacagaattacatcctagttagtgagatggccaaaatacaataccgctttctttctctttctgttaccctctgatccctttaatctttgtttcgtttttggttttttaaacttgtttcataaagagaaagttatatgaaacaggtggtcaggcaagatagccttaaatgtgctgtgacacataaatgtaatttatttttaattaggtaaagttgaaatctagcattaacaccttttgtaatattaagaatgtagttcatgaaataaatttctctctcaaatgtagattttttccagtacaaaatcatatttttgctttttaaaatgtcaaagatacacattatacattaaattgttgtctttttcttttctagagttgtgacatacatgttttccaatctgctatgccatgcctaaacaaagtcagacagatgaccataaaaactgtttgctacctcctcttatgcatgttgagctagaccagtggaacaccatcttggtaggacaaattttgacagaaagactgcagttagagttgcagaatttgcaaaatcacatttttaccaaactcaccctaccccaacagaaaacctaatgaatgaatccacacagaaaggactttaggtaaacctacacaaataatgtaacatgctataagaaaaggataccttttggtctattttcagtacatagcctacatttcattggtgcccagtaaaatagaaactgcaatggaaaagatactttgtcttcacagaactaacaatgaaaagtacacagtatctaatgcttctgtctttaaatgggtaatcataggaaatgccaagaatagatccattaggttagcttaagtatttatctataaatttgtttccaaagttatgctttaaaaaaaaaaaaaaaaaaaaaaaaagcttcacctggaaaccacatcaataccaacagtcataactggactgcaaacctaagagttaatttccagctgtagcttttaggaaaaagacatcactttttagttgattcctacaccaaaacttgctccaatttcccccagaacagtgggaagaaaataggagctttagagatctgaagagttggtctgagtaatacctgagataattcccaagtagtcaaaatcctgcagagctgggctactcacgctgaagggtctttcacttttacccaagtgcaaaaactacgaacacacagattctttcaaagacagcccgtggtatttgggacagaaagggttagtgatggtaggttatgccttgatgttgacatatccatgacatgaaagctggggaagggaccctagatggaaggctggacatcatcttgtttgagacttgtctgactcagaagcaccttggagaagcatctactttagcaggaatacttgagtgactgaacgcaataaggtattttaggagaaacagaggtcccaggaggtcaagtcattttctttatgacccatcaatacttagcattaatgaagagcctcagaacagtcagtctttcctgtttgtcatcactagctggagcccaacagcctattagacctgtgctgtccagactgacctcattgctagaagctaacatgtaaaatgatttgttcaaggaagctgccactaaaccactgctaaaggccagtgcccagccttcttattctcctgtgtagtccagaagtatttccttaaaagtcagaaaatccataagcatgagcagtataaatatgtcaccagcctcttcctctttaggaagccagaaagttgttgggtgttattaaagccactggcttaactgcaagaatctactccaacaactgtttcccaatatacctttctaccaaacacttattctttaaaatgggccatacatgagcttattctctttcgtgcttcaaacccctgttagtactagtccccaaaatttctctgtaactcctggaactcatcatccaggataatttctcctaaatagccaatgacagcatcacatgctgcatccagagcagagagatggacagcatgaatctctcttcttaggttagtcctgattggacaaagccactgctgtgaccagctgcattggccccaggaggcatctgcacctgtcacaaggctcagcctcgactacacgtggctaaggtctccctgtttcttaccaaccactgaaatgcagtcttataaaataaacctgaaaagaccctttctataggagttttatgtaagtacttctcttacctaagaatgttcttgataaaattgatggcaatagaaatgttgaacaatatatttgagttgaaaatagagttcccttgggatggtagtacttaatttgcaatttgagaattctaccaccccagaatgtatttttttaaactcttaaaaactcaacagtaaaaagacagacaatccaattataaaataggcaaaagacttgagcagatatttcagcaaagaggagataagagtggcaaaaaaagccaatgaaaatatattcaacattattattcattaggggaatgcaaagtaacactacaatgagttgtctctacacaactattataacaagtgaaactttgtaaacaatgatgataatacaaatgctagtgaggatgtggagatctctcatacattactggtggaaatgtgaacggtgcagccattctggaaaatggtttagcagttttttatttagcatatgacctagcaattgcattcttcagtattcatcccacagaaataaaaacttatgctcacacaaaacctatacacaaatgtttacggaagtgtttttcataatattaatagcaaaatactggaaactactcaaatatccttcagtgggtgaatggataaacaaactctgatacatccatgcaataaaaatttaattcagcaataataaggaatgaactattgatacattcaataccatggatgaaattcaagagcattaagcttagtaaaaaaacaaacaaacaaaaaaagtcaatctcaaaacatcacatacttatgttccgattaatataacagtctcacaataaaaaaactctagagatggagaacagattaatggttggggattgggggtgcaaatatgaagaggtagtatgagaggattcttttgtgatagtggaacaattctatgtctagcttgtgggattttttttaatcctatgactttgataaaatatttgccataaaaactagtcaaaagttttaaaatcacctttgtgcaacagaaacatgaaaagtgtttaaagatacaatgttgcttgaattccatttaggtaccattttttatgtttacttaaaggaatggtactgattctatcagcaagcaatgattttagtatacaaaaatggatcttttcatggaaataacaagagcagagataaactcatgacagtgattacaggcgttatttgatatgattccttttctctcttttcctattagcaaaatacggtctgtactacttgctgcattttctccaacttttccacagtctgagattttataagtaaagtttggggctgcatagtaccatgtggcaacgtctttctctgatcactgcccttgtttggaggcactttccagaacaatgacttttcctctgctctatctgaattactgttgataccaacttattttcttgaaaggtcttccagtttccctcagatttaggcattcaactaggtaattccaacatggctgactgttctttatcccctttagaaggagcatcttttggaagcctgtgagccttggtgtgccctgggggtggaggtcaagagctgaagggtaccctgacaagtggggtctttgtgtgtctttctggtataggcacctgcctattatttaagagaagcatgacactgaactttttttaacttagaactgagaaaatggaagaaactgaggaaaagcaggctgttaaaaagcaggtcagtgataaaataagactttggcacagacaaccccaggtgcaaatgcaactgtcaagacatcagaaaactaacttctgcatgcctgttacctcgtctgtaaaataattaggataattatagcatctgcctcatcagttgttgtggggattacatgagaaaatgtgttttaagccactcagccctgtgcccccccacatatgagggccgtgatacatgttgattcccatttcttttgagtttctaccctattttttagctgccagggcagtttgatgagaaatagcttgtaatgaagaggactgattgctaggagtgaacagggttaattaacttttcccaagaaatttgtacctgaaaagaatgtattttgtttaaggctttcaagatggagtcattttgcaaaatactaagggaagtcagttttttgttttttttttttctgagaaggagtcttgctctgtcgcccaggctggagtgcagtggcgcgatctcggctcactgcaacctccgcctcccaggttcaagcgattcttctgcctcagtctcccaagtagctgggactacaggcgtgcgccaccgcgcccagccaatttttgtatttttaatagagacggggttttaccatgttggccaggctggtttcgaactcctgacctcgtgatccgcgcgcctcggcctcccaaagcgctaggattacaggcgtgagccacccgcctgggccgggaagtcagttttatgccaagtaaatgatcacccacctcttggatgtgttcttggagtagacacctgtacttgacttttcactaccctctctttctgatatcaaagactagggccttggtaactccattttcaaaaatactgccgtgggaatggcttaaacaaatgaggttgccggtgataactttcctcgtaaaaacattggattccactattttctggggtctctgggggatttagagagcaccaggcaagcctttgacttcaagagaatacaagcaagtgaggaagagtagaaatatccactggactggaagtcacctgggaatcttggctggagggtaattcatcaggaaactgaagacggtttcctggaagaaactgagggaccaagaagtgtgtttgcttttagaattttttcacgcatcctgtttttggggggataagccaaagaagcatcccttataataggatggactctcttttcccagtccttcagtatcttaggaacacattacctgagaaccggtgaggccaagaatgacattgtttccatctttgtatccctagctctctgcacacagcctactcaataaaggtttattaaatgaatatattcattcctctcggtagctgaacacagttgtgtctttattccccagtgatctctttacaggctaggagtgatgggtttcataaggcatactaattttagcaggctgactgaaagctccctgatggcaggcacccggttgtttgctttcactgtcacctccgtagagcttggccaggcacctggcatcttgtcactctataagcatttatgtgaatgcatgaaaactacccctggttctgtcctcagaactcacggtcagcctggaagagagagaagtttctgtgaggaggcatgggctgtcttggaagaccaagacagcccatggaggccacagtcaatttcacctcctcactcagccatttgcaggaggttataaatcacctctgtacccgggtcggggtcagcggtgcgtccctacgccccctggggggacccctcccgccaagtcgcggaggaaggtaacccagagtggaggagccagccagcacgtgcagccgcccagggaggaggaggctgggctaatgcagcccttagtcagcagctgggctcggttttgaaacaaaagccaatgtcctccctcggagtccgcggccggtcagctcctagggggaagaaagccatgctgcccagccggttagtggcccaacttacttttccagagcctgggacaaagggccagcaaaggcacgggagtgggtgggatgttggggcaggggtacggggacacagatggcccagactctcccctcccggcagcgcggggaaagggccggggtctcccatgctctgtgtcggtttgtcccgggcgatccgcctccgtgcccgggcccgtcgggtctgcgtagagccgaggaacctttgccacccgtgtcccagagcacagacacaccaggccccggtttcatgaatgaaatccaatcgtgtggatataaatagccgcgaaggctgctaacgtcacagtgcgagcggcggccgccacggcggcggagcgaggtgccgggtgctccgttccgcctggctgccccgcctgggagcggggtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaggttctgtgtcgtgagtgctctatgctatgaaacttctccgagcagccgctgcggagcccccaccgccccggccccagcgggtggcaagtgggggccctgggccgtgccacgaggccagcagcgccccgagagagagttgtgggaccgagccgctaggggggcctccctcgcctctctgagaggccggggaccctcccatcagaggcaagcacaagagatttctaggagcgcccgcacagccgcacccctaacttggagctgagaaaatgtacaacaggcacccttagcaggctggctgcgccagggagggggtggtgccgcgccgacgagaaggcgcttccccttcgaaggccagtatggggaggccgggcggggaccggaggacccggacaggggaatacgctagcccctttggcgcttgcaccctcttgagagttgactggccagcccacagtcgctcccctcccctcccccgcaaccccgtgtctatggagtctgttgtgagttgctgtgacaacaggaggagctgccatgaggggcttgcagagcaccttaccttgtctgtgtgtgctcagctttggggaaaacaaccaaggggtgatgtgcagacaggagaatccagccctctgccccccgaaaagaagtggaaggcaactatgtagaaatatatcattagatcctactgttagctgcaccgtttccatccccagcagtatcaaacatctcaactgaggagcgatgtcaatatttagacttggacaagccagaaagttagaagggagcgccaagcacagggttttgacttcgctttgcacgttagcacacaagctgtgcctttggagctgactgtacacaattgctgggggcaaaaatgcatgaaggttaatatatacacagaggcacccagatctaggaaaatctaggaagttaagaccagaagagtcgccctgactttgaacttccccatcctgtgctgttcactgagccttgttgaactccagccagacgctcagcttgagatttcactggtttggggctcccccacccccaaccgctgcggtggtgtacgttctgcactaacatactctaaacagaaaaaaaaaaaaataccgttatcggtggtttcatctttgtataagtcctctgacgagcagcagatagtaaatagtcaataggctgtgtttgtttggtcttagcaaggcttagacctttttaaacatactctggtaagtttgtttacaaaccctgtttagaaatttggaactacgtttcatttccagtaaccttgtagatgcctaagagagtcactggttgctagaaaataaacacaagctcttttcagcataaataatgtctgcattctgctccccaggtggagtgggcagtaaattattatattaaacatggtttcctctgagattcctgaatcatatttggacatattaatgggaaaaaggtttaaccagttgatcctagtgcagaaggctttggaaaatcattaggaagcaggaatatcatagtcaatatactaattttgcccatgattgttttcccagagtttgaagatagtgtaaaattttttaagtgcataacacaggctctgtgatcacacaggtggaaatagaaacacatgtaacagtttgatgttattggctcaataatacaaattataagctatacaaatacaacaggaaaagccaaaattgtttggtcttttaattatgattatattgtctaaaaatgctattttgaataggatgaccacatctatgagttctgtattgtaaaatgcctgtaagattttcattgttatctatcggtttgtggccaaatgtttttagggttttgttttgttttgtttgtttttttggtatcgtcccaagagctcaaaaatatattttcacaaatcctgcaaaatgttaacctagctatttcaggatgtatttgacccaaagaaatgccacattaacactggcacttagcaaaagtaaagcagattcttccctttctcgggggaaaaagagaaaacaacgtatgttgaaaattttagtggctccccatgtactcctggcaggcagtagaatttataaagtatttctctcttttatgtaggtaagtccagctgtgagcagagtgttctgttcttcacttccagcaagccaggtcagtgtctttgtgcaaacccatgactatagattggtaacatcctgtgtctaattttgagcatgcatttcagaacaggtttcttaatcatttgtcttttaaaaattttgtctttgacttttttatggactcagttatgaatgtcataagttcaatgattattaaaattattgcttactctgggagtacaatggtacaaatatgggcctcaaaccagtttgtccatcatacgactttttatttttcactttaggcatcagagtggtgcccgtggttgagaatactggggatctggatgcttgataattgagggtttacttctatcctaatcttagcactctggggctggaagaaacttgatatagtaataattgacttattgagcatgaatcacggttcaggtaatgtgctgcattctttatgttaatattcttattctgcttcagaaagaaaaaaaaaatctctgggaggtgaaaccactgtcttgagtcccaaactataggtgaggagttggaagtttagagacattagataatatgttcaattcttacttctattaaatggcacaaataggattttttaaaaagtttttgtcttactctaagacctaaactctctagttgaaaaattgttttccagtagggaaactgaagacaaagaaggttaagtgacttgtctaagatagcttggtaattactagcacatataataacaatggcccagttgttgcaaaataataaattctattctcttaagtaaattagtgaaattgtaagtattcatgtgtactttctggcatgacactgtcaaagatataagaaagtttttattgtggggtctctggccttgaagattttatggaagatttaaaaggcaagatgttaaacattcaggtatgcaacaatagagaataaatcaagattatacttgccagaaggctgaattggggatcaatggtacatttatgagaagttcagcattttccactctgtggaattactttgcaattccatatatgcatgaaaaaaatttccaagcacattttttttgtctggatagatgattaatcggtgagagtttgggaaaggacagaatgtagaatttcaacccaacagggagagattatgtagtcatccagaaccgctaaattgcagtatctcaaactcaaagatgttattgcttcacaagcatggtaacccaaaattgtgagctgtttgaatctgcacagcatctttgagaaagcataatttggcatgacatttaaaagtactggatttttcctggaacctcagtttgtctgaaaggcaccacgtagatggatttggatacataatagataaatcctaaccaaagtcctgataacaaccaaatattaagcaagactttttcaggttttgcctgaattaacaggcttctctctcttctgttcccctacttcccttctcccctctttcttttcgtagagtaatttgtaacagttgttaatccttcttagctaattttatataaaggggtactaaaaaatgaaatggggaacaaattattaaagcaaaccttaggatatcatcttttttaatgtgctgataacccccactcaagctaatagctctaaaatcttaattagtgaagatattttttaagcatttaaagggatattataagctgtcctataacacgtctgtcctgtaaaagttgttatgtaatggatcattacaaaataggtcacattctataacagcactattattattgggaagatcccattacaggccaagacctcatcaacatgattagttgtgataatggtatataataaaaatatcaataaagcaaccataaatctataaagcactaaaattatactttgaatcatataatgttatgaacaaaagagatctaggaattagcatggcatctctaataataatcatttagcaatcatttgttttctcttttgaacttcataaggctttggttagtatgcatgacttacctctttaaaaatggctggaaacatttgaaattctgccattttttgctcaagaaaacagagaaatgtttaaaactgtcgcttggtcttccttttagaaaataggccattcacgtttccctctggctccatgttttagggtttaaagagcataggtgatttgaatgtggttcttttgttcctcttttcttctctgccaggcttcccaccaacatcacaacaccaaaacaaaacttggagagggagggaaaaatgagttccaaaaagtgtgtgtagacaagggtaggagatgggcgagtgtgtgggcagcagggaagaggaaaaggaaaggggaagcttttaagggaagggtcaagaggcagtcactccagtggatgggatatttacagattagttatttgttagcatcataatttttttatttttagtttgtaaacaaatagaacccacttcctcctcttcctggcaccttttgtttcttgtgcccataggacagaaattggaaaattggcaaaaagacgccaaaaatgatggatgtgtgtgtgagtatgactgccactttttccagatgtcccaggacactcctgtcttcagatactttcttgagctctgtcatcaaatacatcaccatgcctctgatcaggctttatccactaaagaacgaattagcaagttttacaaagaaagcgatgccaataggtctagaagaaagcaattacatgtctccactctgcacctgagtttacttattgcatagacacaggttaatggcaagttcccagcgttaatgaggttatgatctcaggttccgtctctctgtggagaaatttcctttgaattggtacccaactgtagaccaaactcctaatgactgctgtgataacaataaactagcatttatgcccctactagatgccaaacacgttaactaaattacagctaatattcattatcaattccaattttacagaggcaagaaatggaactcagagattttaaagaactactaggaaacagagcttggatttgcacccaacgctgtctaagaacttgaatatatatttgctctaaacaaaccccccctccaaaaaaacaacactttaaaccatttcattccaggttactcttgcagatgtcggagtatagaagttattcttctgggtttgtttctactttgtaaattttgtatttaaatttgaactacacaacatttttgcctggataaattggctaactgcttaggtcattttaaatgtattttgatggaagttgtcacaatcttaaacagttgagtcatagagagttgaatcatggagccaggaatgtccttattaaggacccttagcccaacctcatgtggatggaaaacactggcacccagagaaacaacgtaacttgactactctcatagttaataagtgacacagtctgaactgaacccaggcttccaagtcccagccagagcccagttccattacataacactgcctgaaaagtgccaagtcttctaaatcttccaatgtagcctgaaatacaactagcaagtatgatatacatctgaaacccaaggtacatccagaaatgctgataagagaattccagtcgtgcaaagatatggtgggtactaggagaaacctcacttatcttcagtggtgctgagataaaatagtctttttctcttattcaaaacataacacccttctaagctgtctttgttacataaacccttccaagctgtctttcttaagtgatctgttcgatgctttttcattttgaccaaactctggcatttcattaactatgcaacttcggtgaaatatgaccttactttcctcaactgtaaaatgggaacagcatcccctcccccctcagagggttatgaggatgttataaaatcctcatgcatgtaaagcacatagtaggtgctcagtaagggttagctctcttcttagccttcctagagtatctcgaaagaaagtcttttaacatattaggcagttgtatcatttttgtctctaaatttactggagtcatttgaattctgatattttaaggaatggttataggaacctttttttcttgaacacaacaggccgagtggtctctctgggttccagtggcccagtctccattacacttgttttcttcacactctaaggttgccaaagtttacttgcattgaattattttattgccttagtttctgctgcaaacgaataccaagcttctcttgcagatttgtggctctcattttcttccagacactgttcctaagtagctaacgtgttttctacatggaactttgtatctcaaagccactatttccagccagataactaagaaatatttccagagaatattattgccagtagaaaatttttgctttcaattttgaaacatgagactttcctaccttcatttcaattcactgtagtattgagtatttgaggtatgctgctcctgttttttctttttgtcacgtgttgctgactgatatattgataggaaaagcataaacaccacaatttccccatttcatctgcagcacttgataactaccctggcctaaattacatcactgggaagtgttttgtgcactcctctccccagctgccacattttctcatgtggcacttgctgccctgctttggacttttggaaccgagtccttgccaacacatccaattcatcacatacgcggaagaaagctactgctttgatattttttttaaatacttgtacctgttcttccttttttagtaataatccaagtggcctagaatagactatattatcctggtggtgcaatttcacttttagtatttggtaaatgcatattgcaagatggatgtccttcttcaaatttagaagtagcaagtatatgtctttcccagtgctatgaagtggctgaactggggctaggtgctgagaactcaccaactgctatgttgtccttaaccttctactaatctcaaattgattatatgtaagtttttatttttaccaaggaattaattgcttttagagctgtgctcaagctttcatgtgcatacaacaaaaatgggcatcttgttaaagtgcagattatgattcagtaattctgggatggggcctgagattatgcatttctaacaagttccccattgatgccagtgctgctgttctgtggaccacactttgagtcatgaggttctaaagaatagtggttactatatcttacgctgaaattcatgcttaataggccataaccagaccgccttattttatttgcttgtttcttaaatcataatagagtcatggaatcttaaatataggagggatgtaggcggtgatgacctggtaaatcaaccagctctcctggaaaaaagtaaaatgcatgtatgtgcatacgcaaattgacataaattttaatcacataaagaatgtgtggtacacactttacaaataataataaactctataatacttgatattataaattcaatatagccagttgggtctcacagaatgcctttgttgttttttgcagaactcttctatccataggccaacctatgttgcagttgattaaggggtgcagctcccatataaatgctggcaggtattttcctttatgttaatcagtaagacaaaagtgaaacatcaaagacgtacgtcagaactctactcattcatccatgatgggaatcacttccttgctgaaccagatgataaattttaatactgaaagaatatttttcaaatgtactattcatagtgtaacacctacacatatagcacactttaaagtttaatctccattattaacactgttaaattattttcttagatctagaacaataaagcaagcactgattggtagtggctgctgatttctgtggtgtaaatattcccaccatggccaatttcaagctactgatgtggctgagcacagagttggaaagagatgatgcagtgtcacaccattatattgtactttcaccatatagataaaattggcatgaatagcctcaaaatatagttaatagtaaatagaaataaccagaaaatgatgcattttgagtacttattatctttgtttttggtataatttatttaattgtaaatttatgtaatttaatttttaatactggcactaatgggcctgcaaaattcctaaaaatttaacaactagttcttgtgggctagtaggggctggcttctgcacagatcatatagatcatctggtgtagtgattcccaaccttgctttacactgaaatacctcaaagaacttagagcccacagttttagtagatccacattagggcccaggaatctgaactaaaaacgtttttattgaagtatatcttatatttaaaaaaaaattatcagtatataacaaaaagttttcctaaattgaacacactcacataaccagcacctaaatacagaaacagaacattaccagcacccagaagcccttctcatgcccctatccagccactacccaatcaatgtaacccttatcttgacttctaataccataaattagttttgcctgcttttggactttatataaatgaaatcatatcctatgtattcttttgtgcctggcttcaatattatgtttgtgagattcatccataatgtatgcagcagtagttcattcatttttagtagtgtataatattccattgtataaatagtcctcaatttattatttttaatccattttactgttgatgggttgtttccagttgttggctgttttggatagtgctgccaagaacattcttgtacagatagcagtatgcaaaacaaaacaaatcccccagtgagtctaatgagcagccaatctcgactgccttctctatatcttcccctcctctctatgtctcatataacatgcccacggctgttgatcctttcatgtgaatgtacttttaaaacataagcaatgaagcccatgtgcttccattcattaaagtatgttctcctggctctttacaatacacgttcaccagctctccgtttcatcaagatatctgcatttgttctctctaaatagggatgagatttggcctcacttcagtaagcatgggagaataatagacacagtggacatggagccaaaggctaaatttggcagctgatcattaaggctcctggaaagaggcttcaagtaaaggaacttgtttccctttgtgtatatcaaacaaaagtcaacaatgaaccgttatatcagattctaatattctttaaactctatttatttgaagtagaccagggactctcttctgacatgactactgaaatctctcaaagtctcatgtcttgatctggaaagattagagaatgttttcccatggtcttgttcctgtacctagcattcaacaggtgtatccttgttgcattgttctatgctgaggggctatgtaggttttgtggttgggcctattgaggtattagttcctttgatataagtaaagggagctgaataaccaggaactccaagatgatatattgatgagtgggacgtctgctcaggactgaaaagaaggtttcaggagcagcaagcctgttccctaccatatgaaaggcagttcacataaagttcttaaggtacacagagagaaggtcaagagtagatgttaatttcacataatgaaggaagaatgttttctcacacacaaagatattttatttccttgttttcctacctccttgccctcttttttgtaaaatttctttatgtcacaaagaacacatgttcactatagaagagatggaatatatagatgagaaaaatgaaaaaaattaaaatgaattataatcctatcctataaaaagttgttggcattaatattttagtatatctatatctcaatctctttgtgtgtatttaggcacataagttttaaggagtggtgttattctgtaaatttttaaatctcttttaatttaaagattgttcatgaacatctcaatataacaatgagtgtactcctataacacatttttgatggacatatattagtttttttttaatccatctcctgtgtttggacttctaaagttatttttgtttccacaaatagtgatatgatgatgaacattccttttttttttcttttttgacggattctcactctcacctaggctggagtgcaatggcgtggtctcggctcactgcaacctccgcctcctgcctcagcctcccgactagcttggactacaggcacgtgccaccacacccagctaatttttatatttttagtagagactaagtttcactatgttggccaggctggtctcgaactcctgaccttgtgatctgcctgcctcagcctcccaaagtgctgggattacaggcgtgagccaccgcacccagccaatgaacattctttaaatgaaatctttttctatacatttattatttttccaggaataaaaccttaaaattggatgaaagttatgacattttaaagtcttttgccttaaaatttctagtcgcactccagactggtatcattttccacttccacaaacagtgcttcatcctgctttttaaaattgtacaatctttcatgtaataatttctacctaaagttggaaggtataggaacatgccctgaaaaatactagctagaagctattcattgttattagccaataacttcaaataaagtaagagatcttaagaagtctggttaattttccaccagcacttttgcatttatggtctaacgttgctgtgaaaacctgaaaaaagtttcttgtttgcctgaatcaaagcatagcctagtcctaacgagcatatgatagtctcataaatgtttacatacaattgcttgattgtcattgtatcagaagaccacagcaggtggtcacgctgctgcttcagaagctaactcggtaacatctttagagaatgctttcagtgagtaacttactacagaaggtagtggagacttttcttcatgaatatgggtttttaaacacccatagtctacagccttgatattagctttctcaaatgagtgcttagtatatctctatctcaatctttttgtgtgtatttaggcacataatttttaaggagtggtgttattctgtaaatttttaaatcttttttaatttaaagatgtatcatgaacatctttgccatctctaaagacttgaccaatattttgattattaattcttgacaaagcttcccgatccagcccttagatgtgccccacccccatgaggacgatagggcctccaaaatccatgtgtagggtttcttgtttctgtctttttttttttttttttttactttaagaaagtattgaagtataacacatagagaaatgtatgcagatcgcaaatgtacagcttgatgactttttgcaaactgaacatatctatgtaactggcacctagatcaagaaccagtacaccaccagtgccctacttctggtcaccaccccactccaccctcagtgtgtttgaaacacctcacattttatgtccagggtaagtccttcatttacagaattctatgtttgcctgaaccattactttatatgagctagctactgttagcttacatcaaggtgtctcccttgtcactgaaaatgtgtagacgtctgcctaagtaaagattacaatgttaaatttgggcactgagtgtacatcaatatttatgtgtttgtgatttccaggtacacaaatacatacatggcatgcataccaacaaatctggaactactttcttcttaatgaatgtaaaactgaattatgctatattgatctaagcttagaatatctttaactacaattgattgccacagaatatttcatgtgccctgtttccagttttttaaaattgctcatttcagttaccataagtattccttttgaatgctcaagatttcaaagccaagaatttttcatcttctgtttgaggtagaattgtatgtgtttgtcctgaatatccacagctgtctttttatatggttcaatttctgtgtctgatactcagaaaaacatcattttgattcctgtggggttttttttatgtgagagcttgagtcagagaaagaaacaggtttagcaggctctctatgctttatatatacatatagttttgaaaaaacaatttatgtgttatcaaaaatcatgtattattattgggttgtataagtgtactcttagaagtgaaaatcaagggttatacttaatatacccattagttttttaaaaagctaaaacgtctttctcattatagaagtaatatgtctaagaatatttttcagccataaaaagtaatggagtagtgaaaggtgctacaatatggatgaaaattgaaaatactatgctaagtgaaagaagacagacacaataggccacatattgcatgattccatttatatgaagtgtccagaataggaaaatctgtagagacagaaagtagattcgtggttgccagagctggggagaacgagaataaagaatgactgctagtgggcacaaggtttctttgggggataatggaaatattctggaattagatcgcaggaatggttgcacaaccctgttaatatcataaacaccactgaattgtatactttaaaagaatgagatgtgtagcacgtggattttatctcacatttttttaaaaaaataagacgtgcattgtagaaaatttggaatcaaaagaaaagtagaaaatggcaggaacaagttatagcctcattgtccagcaacaattactgttgctttctagtgtatttcctttcagtttgttttgtttttcatgtattgttgttgcagagggaagacttcaatattgcttcctgttacatgacagagatacagttattaaatgttaaatagtcacatattaaaatcaacccaacccccttaaaaaagggcaggtcccaagaaagattcgtttatttgtcggagggaataatggatgggaatgccaataagacaagcagagaatgatggctagccctgtaagaagggatgaagaagaacctgaagggaagagatcccaggtcctgagaggcagaaagacagatttgagcagttgccatgaaaggtgagactccagagggaaacatttcaaagagacttttttaggaggttcactgtaaggtgcataataggtgaggtaagccatgcctctctattcataagcagctacatggttcacagctttccaagaatcagtttgtgtttctttctgctatgtcactctgctaagacagtgcttcatgtgaatgcatgaggcccaattttatttgggttgcacatacttatttactgttgtttcagtcgaatgtatttcacattactattccacactttcccctcaataatagcagcatttctctggattattgcaaactcatcataagcataacttctatgacaatattaatagataagacttactgatgttctcttgataccaagcacagagattgaaatatttcacaagcattatctaatataatcttcacaacaatccgtggaaggagataattatccccagttcacagataagaatatagaggctccgacagattaatttgcctaaaatcacttagcaagtatcttaatcattccctcacttgtcataggttgttttcattttttttcttaaagatgtggtaaatatatttgcttttaaaacatttcccatttataaaattgttaccttagatggatatattagaaagtattttcttaatttccaagggttgagatttttttgttcatattatagagcttttcctttcaattgtttcatttacttctttgcagccagagaatttggttgacaacaatttacactttgggggatttggggccttatggcccagtatgtggtcagctttttaaatgtgccaagaacacttgaaagaaagctgtctttttgtaggtttaaaaaatgtgggatatttattaatttagccttagtatttgttattcagatcctccatgtgttgtttatttcactttcttaatctgacattggtttattctgattttttgttccatatatttgttattgttgtgaatttctccttatacttaaaaagttttcttcattttattatatgctttttggtctatgaaggttcatgttacttctattatgaattggccttttgtaaccttctagattatctctggcagataatttttctataccattttgtaactaaattcaaaataactatgtaggatgatcttacatttttttggctttggtttccatagttctttaaagcctgggtaccttttgtttgtttgtttttagtatttaattttcaattatctctaggtgttttcgctagtatctttgagcagtttccttaagggaacttgggtttttgacctgagtctttgatatctaagaacaactttatgttgctttcgtataaatatcaatttggcccaagtcagaaatgtattattatgtcctttttctttcaagaatctgtttttttaatttttcattttcaattattatggatgcatgttagttgtacatatttatggggtacatgtgatattttgctacaaacataaaatgtgtaataatcaaatcatggtaattgggtgatatggtttagttctgtgtccccacccaaatctcatatccaattataatccccacatgttgaaggaggggcctggtgggaggtgattgaatcatgggggcaaacttcccccttgctattctcatattggagttctcaggagatctgattgtttaaaagtgtatagcacttacccctttggtatctctctcctgctgccatgtgaagacatgcttgcttccccttcaccctccaccatgattttaagattcctgaggcctcccaagccatgcttcctgtactgcctgtagaactgtgagtcagctacacctcttttctttataaattacccattctcaattctttatagcaatgtgagaacagactactacattggggtttccataacctcaagcatttatcatttttttgtgttagaaacattccaatttcactcttagttatttttaactatacaataaattattgttaatttactatagttgccccattgtgctaccaaacactagatcttactccttctatgtaactgtattttttacccactaaccatcccctttctactcccctttccactaccctttccagcctctgctaaccaccattctattatattctctacttccatgagctcaaattttttggagctcctgtatatgagtgagaacatgaaatatttgtcttttagtgcctggtttattttatttaacataatatcctccagttccatccatgttgtttcaaacaacaggatttcttatccattcatctgctgatggacacaggtttattccatatcttggttattgtaagtagtgctgcagtaaacatgggaatgcagatatcgctttgatatactgattttctttttttttttgttttggatatatacccatcagtgggattactggctcataagatagtttgatttttagtttttgaggaacatccatatagttttccaaaatggccgtgctaatttgcattctcagcaacagcttgcaagggttcccctttctgtacatcctcaccagcaatcattattgcctttttcataaaagccattttaactgcggtgagattatatcttattgtagttttcacttgcatttctctgatgacgaatgatgttgagcattttttcatatgtgttggctatttgtacatccttttctgagaaatatctatgcagttcctttgccatttttaaattggattttttttctgttgagttgtttgagctgctcatatattctggttattaatcccttgtcagatgggtaatttgcaaatattttctcccattccgtggattgtctctttactttattgaccgtttcctttgctgtgcttgatgtaatcccatttgtccatttttgctgtgagatctcaggaaatctttgtccagcccaatgtcctagagtgtttcctcaatattttcttataatcgtttcatcgtttgaggtcttagatataagtatttaatctattttgatttaatttttgtatacagcatgagacaggtgtctagtttcattcttctgcttatggatagccagttttcccagcatcatttattgaagagactgccttttccccagtgtatgttctcagcacctttgtcaaaaataagttggctgtaaatgtgggaatttttttctgggttctctattctcttccattggtcagtgtgtctgtttttatgactgtcccatgcttttttggttactatagctttgtagtatgatttgaagtcagataatgtgatgcctccagctctattctttttgctcaggttagctgttatggttaatactgagtgtcaacttgactggattgaaggatgcaaagtgttgatcctgggtgtgtctgtaagggtgttgccaaaggagattaacacttgagtcagttgaatctgtagattgcattgggtggtatgggcattgtaacaatatcgatcttcccatctatgaacatggagtatctttccattttttgtgtccttaatgtcttatagctttcattgtaggtaactttcacttctttggttaagtttattcctaggcattttgttttatttgtagctatgataaattggattactttcttgatttctttttcatattgttcattgttggcatatagcaatgctacttattttagtatactgatttcatatcctgaaactttactatttatcagttctgatagttttttgtgggatctttagtgtctcctaaatataagatatcatctgcaaccaaggataatttgacttcttccattacaatttgaatgtcctttatttctttctcatgtccaattgctctgactagaatttctagtattatgttgaataaaagtggtaaaagtgggcatgctagtcttcttccagatcttagaaaaaaggctttcactttttcctcattcagtatgatactagctgccagtctgttgtatattgcttttattgtgttgagatatgttccttccatacccaggtttttgggaatttttatcatgaaggatgttgaattttattgaatgctgctttggcatctattgaaatgatcatattgtttttttccttcattctgttcagatgatgtgtcacatttattgatttgcatatgttgaaccatccttacatccctgggatgaatttcacttgatcatgatgaataatctttttagtgtgttgttgaatttgatttgctagcattatattgaggaattttgcatctatgtgtattagatatattggcctatagctttctttctttgttgtgtctttgtctgcttgtggtatcaggataacactggtctcatagaataagtttggaagtattccttccttcttgattttttgaaatagcttgagtaggattgctattaattcttctttaagtgtttggtagagtttagcagtgaagccatcaggtcttgtccatatttatttatttatttattttggacagagtgttgctctgttgccctggctggagtgcagttgtgcgatctcagcttactgcaacccttgcctcccaggttcaagtgagtctcctgcctcagcctcccgagtagctgagattagtagcatgtgccaccacacctggctaatatttgtatttttagtagagacgggggacggggtgcaccatgttggtccggctggtcttgagctcctgacctcaagtgatctgcccgcctcggccccacaaagtgctaggattacgggtgtgagacaccacgcccaactatgtcctggccatttatttgatgggagactttttattactgcttcaatctggttacttgctattggtctattcagattttgtatttcttcatggctctatctttgtaggctgtatatgtctaggaatttgtccatttcttctaggttttccagtttattgacatatagttatacataatggtctctaatgattctttgaatttcagcagtatcagttgtaacatctcttttttatatgtgattttatttattcgggtcttcttttttttcttagtctggctaaagatttgtccattttacttatcttgtcaaaaaaattcattttgttgattttttctatttttatctcaatttcatttatttctgctccgatctttattaattcttctactaattttgggtttagtttgctcttgcttttctagttctttacgatatattataaggttgtttatttgaggtttttctactttttcgatataggcatttattgcaataaactttcctctgagtaccatttgtgcagtgttccataggttttggaatgttgtgtttgtattttcatttatttcaataaatttttaaggtttctttttactttcttcaatgactcaacattcattcaggagcatattagtcttttcttgcattgctataaagaaatacctgagactgaataatttataaagaaaagagatttaattggctcatggttttgcagtctttacatgaagcatggtgctggcatctcctcagcttctggagagacctcaggaagcttataatcatggtggaaggtaagaggagagcaggaatgtcacatggccagaggaggagcaatagggagagagagcatggggtagggaaggagccacacagttttaaatgaccagatcttgtgtgaactgagagcaagagttcacttatcaccaagaggatggctcaagccattcatgagtgatctatccccgtcatctaaacacttgccaccaagccccaactctaacattggggattacaatttaacatgagattgggtcagggaaaagtacccaaactatatctaagagcatattgtttgatttccatgtgttcataaagtttccaaagttcctcttgttattgatttctagttttattccgttgtggtcagaaaagatactggatataattttttaaaaatttttgagacttgttttgtggcctaacatatggtctatccttgggaatgtttcatgagctaaggagaagaatatgtattctgcaactgttggatgaaatgttctgtaaatgtctgttaggtccatttggtctatagtgcagactaagtctgatgtttttttcttggttttctgtctagatgatctttccaatgctgaaggtgggatactgaagtccctggctcttactatatcagggtctctctctctctctctttagctctaataatatttgccttatatatctggatgctcgagtgttgactgctatatcctcttgcttaattgacccctttgtcattatataatgaccttctttgtctctttttacagtttttgtcttgaaatctatcttatctgatataaatataactaattctgctcttttttggcgggttttatttgcatggaatacctttttccatccttaagtctctgttacatgtttttaaaatcgtcttcaaatagtgtcttggtgaaatttatagtcattcgtatcattatttctttatggagagggtttgtgtccattagttttggaagacattttgataagatacaatgggattcttgtacaatttgtttgtcattgatatgtaaacattttactgaaaaaaaatacacagatttggagtcttccattgtttttctcctccttcttctcctccttgcttttccctgctccttcctcttttttgtagtgggaacattttgttctattaaatcacactccgctcctcagttcttcaggaacacatactatattaatccattttcacatggctgataaagatatacccaagactgggtaatttatagagaaaatgaggtttcatggactcgtgttccatgtggctgaggaggcctcacaatcatggtggaaggtgagaggcagacaaggaaaaaaatgagatccaagtgaaagcagaaactctttacaaaaacatcagatcttgatcttgtgagacttagtcactatcccgagaacagtatggagtaaaccacccccatgattcaattatttcccactgggtccctctcacaacacatgggaattaggggagctacaattcaggatgagatttggatggagacacaaccaaaccatatcgcatactattcaagagattgcattttgacagtcagtctctttattgtctttggtcaatcatgagtaaagacaaagaaagattgtctttacttctgtatttagagagaacttcttaggcttgacctgtacctcactaattaattttacaacattttcaagtctactatgtactgttgccagcacggctttcaatttggtgaccttatatttcatttgtacttggtctttatcttgtctcattaactacttataatttcatctgctattagtttataaatgtacattatcttcttttacatggttaagtacatgaatcagatgtttgaagtttttttctgctgttttatatagcatgtttatctaagtggaacacctgttttctgtgcctttaggtaattgcttgtacatgtctatgcttcaaggtttttaataggtcatatgttgaatggtctctgtttacactatccatacacaaaaggattcacaaaggccaaggattgaagtatattccaaatacttggataaccataggctctgtgaaagatcaaggtagggctctatgatagcatcccaggaagtcacccagttccagagcagacaagcaaagctactcaatataatgtgagttgagagaacctttgagggtgaattaaggacaacagtgaggaatgtgaccatggaagttatactaatgttcagtcttaagaggcagcaccccctcacctgactccttcttggattaaccccagaagatcaatcagttctatcatagggtcaaaactgaaagggtctggttgagtgggctggaggaagcaaaagcagaacagagagaatctttttccatactttgttctctctacctggtccatcctcagcaagggatggtcagcaagctcactccatgctgatagcagcaggctggtttcctattggagccactgggaaaccttcttcctccacccttctctcttcaccttggtcccaagtcagtgtggctctcattactccagattatgggcatctgtggtgaagaatgtctccctacttcctgggccaattcttttccccgtggacatggcagtctgctggtcatcagtggtgttatcatttggctccatggaagtgaatttggcggaaatccttccagtttctggtatgtggttacttttcacccttagtttctggtactgttgtagaggctccatacagactaaggctacttgcaatgagatgatggtaaaggagggttcaaggcatcagtgccttcattgccatcttgccttgaagtgcagctaattgcattttgtggtgtggctcttttgggcatagagtgaactcgtttattcaagactcactttcatattagttataaatcattatccatatgtaatgggtacgtgtgcctcccttttttcctttcttttccagcgaagtagtgactcaccaaaaagcgctgagaatcccttgaattaggatgtttaagtctaaaagtggatgagaactttatgagacccttatatataaatattattaacatttataaatcggctctagaaactagaacaaaataaacaagcactcatttgtttttctaaatccaatccaatcctatgcccctcctgcctgcaattactggggctctcctccccaccaccaccttcccatttggtgaaagggtgtggcctttggtctctggtggctcccatggttactgatgcacttcctgttagggagcaatggttggtgcaatgccatctgtcaaacactgctcttgtgatgggccacacagatgtccctcaaggtgtttctctcaccaactgcaggcttagccacacgctgctgctttcaaggccacagggcttaatgatcagtcaccagagatagctgcatgcaagttctctgccagccccaggtggaaggttttctaagaaaggtggagtggctgtatttttatattcaattcaacaaacgtttattgaaagctgcctataggccaggcactgtgacaagatttgaggatttaaagatgaataacaatttctgttgccaaaaatttataatctcagtggggtggaagtggaatgcatataaacataataatcagtattacaaatcagaatttgataaaccctcttaaagacagtgtaaaggaaggatgtttgcagtgtgtcttcttccagaatgtaacttgaatctgtacttggccgcatctctgctgattctgcctgtcagaggcaccatcctttctctcctggagaacttagggcttcctcaccattcctctgccattgcacccctgccctcatgacatgttctctgtacatacagcagtctcagtgatattggggattcctttaaagagcaaatcaggatcaggcatggtggctcatgctggtaatcccagcactttgggaggccaaggaaggaggatcacctgagatcaagagttcaagaccagcatggccaacatggtgaaactccatctctacaaaaatacaaaaattagccaggcatgatggtgggtgccagtaatcccagctactcaggaggctgaggcagagaatcacttgaacccaggaggcagaggtcgcagtgagctatcatgtgattgcactccagcttgggcaacaaggcgagacactgtctcataaaaaaaaaaaaacaaaaaaaaaacaaatcagtcctgtaatcccagcattttgggaggccaaggtgggaggatcgcttgagctcaggagttcaagaccaccctggatagcaaagtgagacccccatctttaccaaaaatacaaaaaattagccgggcatggtggcacatgcctgtagtcccagctactcaagaggctgaggtgagaggatggcctgagccgagaggtggaggtaggggttgcagtgagccgagattgtgccactgcactctagcctgggtgacagagcaagctttgactcaaaacaaaacaaaacaaaacaaaacaaaacttaaaaaaaaaaaaaaagcaaatcagaacctaccacacttctgcttaaacactgcagtggcttttcactgcatttagaataagatccaaactcctgactatggcctgaaaggctgagtatgatctatccccacctacctttctaaccttccggcttccccacttcctatccctcgggctcttcaggcctgtttcctctcccatctcttgaacgggcccttctcattctccagatggcaggaatgaggcctcttcagacaggtcacccagtctgcccttcaggcttcccatccattattttttctcgacatcctttggtttttttcaaggaccccccaaatttgtgatgatgtatttgtctacctgtttacttgtttctttccacctgactgtgaaccaccgctggcttgcttttcactgtacacctataggcctggcactcattcagtgcttagcatgtaatttttaaattaagactgccttagtgagaaaatttcagcaggtgagttaagggcacgaggaaagggcctttgtgcagaagtaatgacataggcaaattgtcaaaggagaggttccctggtgtatttgtagaagaaagtagacccatgtgtctgaacccagcacacagttcacttatggtggttttgaaatctgccctggaattttcatgcatcttttaaatttttggtttattttttcaagaaataaatgaagtctttattttttcaatgagggcaatgtttattaagaacagcacataaggtagaaaagaaggttggtttctaatcttggttcatctcccccactgatcttgagttttaaaagcatagagagcacgatcttctgtgggtctccactgtcagagagccctggtgagaatcatgagcggatgtagtaaaaagtgcttctttcatatcagcaggtggttctgtagtatttgcatccatagacttctatgcagcatcctttctgttacttactcttttcttttttaatcaaaacagtccattgaaaaaataatgttgattacaacaatgaattctgttgatttaaatggtggaaggcaatgttatcctggagatataattctgtgaagttttgattcagggaagtccagcccagcccttgcatctctttcccggctctgggtctattctttattccagctgagatgtttattttatgtatgaaacagctcccacctacctacaactgctgattaaaagctcagaataatgaaatctgcacaatcgaaacttggctgttggctatagttattatgcaacttttaacattttccttttttcctgtcaataatataaaattgtcagttttttatttcagggctaactctttgaatacactaaaatttgttgcactagtattttttaatggctgagctaaattacttcttaaagttcagattatatgcttttgggaggaataagaaaatgtagtgtccgtgcaatagcatcattcagactgtctgtgaacagctaaatggagataagactacaaaggtccctccatgggccttcaatttttgtctttaagcagactgctcaccatgccttgatagaaatagcaaatatagggccaggcatgttggctcatgcctgtaatcgcagcactttgggaggccgaggtgggtgaatcacctgaggtcaggagtttgagaccagcctgatcaacatggagaaaccccatctctactaaaaataaaaaagtagccaggcctgatggcagatgcctataatcccagctactcgggaggctgagtcaggagaattgcttgaacccaggaggtggaggtttgtggtgagccaagattgcgctattgcactccagcctggcaacaagagtgaaactccatctcaaaaaaaaaaaagaaaaagaaaagaaaagaaatgcaaatataacaagagacatagtgtaagtgataagatgcagcatattccaatggcgggatgattcacagcaattaggagacccctagtggggtttcttagacaagtgataactctcttcctacccactcatcttaatttctgaatttctaatgttagaggagtcttgcacgcttgcctgaaatcaattagtggccctacactgaagtgcgcctgtctgagcaaacaagtacatcagccacagtgccctgagttattgagttatgggggcagaactccagaggtcttctaggtgtcttgtgagtgagggagtgggcatgcgcagaacttcctgggagtctctttcataagagagggacagaacaccatgaaggtcatcaaggcaaagactgaaggttgggttggggtaccaccaaaggaagggaaatgatttgaagaggagaccaggctaactaaggtcacatttggctctgtccctatttttccaatgggttgccctcagagagagtcaccattaaattaggggacctttggaccagaggggtagtcaagaaaggctttgcagaaaaggggtgttgtataagcatatattcccagcactgtagcaaatagctatgccccacaaacacttgatgattcgttcagtgtatgaaatgggcactttgaaggtataaccacacacacatgcacacagattcacaagctaccattccatgatttgttaatataagaaaaaaatgtgtgtatggatgcgtgtacatttgtttttgtttgtaattgcttctgctagaactctttattgatacagagaaaaaagtaaattagtttatgaggtggagggttagttaggaaatctttccaggggaggtgatgtctgagtaaggttttaaggaatgactagaatttgcaagacagacaaggaatggaggagggttggtaagaaggagtggcgtgtgtataggcacagagatagtgctacagggtgaatgtctgccccctcccccaattcatatgttgaagccctaacccccaatgtgattgtattaagaggcgggctgttggagaggtaattaggtttggataaagccatgagggtggagccccatgatgagattagtgcccttttaggaagaggaagagacaccagagctttgtgtctctgcctgtcatgtgaggacaccacaagaagacagctgcctacaagccaggaagagagccctcaccagaacctagccacaccagcaccctgctgtcagacttccagcctccagaactgtgagaaatgaatttctgttggctaagccacctagtctatggtattttgttatggcagctgaagctgactaagggggtagttagaaaagctttttagaggatagttaggaaagcttttgtgacagagctgccacagtaggatatctgaataaggttttaaagaatgaatagaatttgccaggcagacaaggaatggaggagagttggcaagaaggaaaggtgtatataaaggtaacaaacaacatttagaatttgagaaagccattttgtgtggctaaagtgtgctacgttagtttcttattgctgctgtaacaaacgtcaaaacttagtagcataaaacaaagtttattttcttatagttctgaaaatcaaaggtctgacatgggtctcactgagcttgaagtgttggcaggctgtgttactttgggggccttaggggagaatctgttgccttacctcttctagcttctgtgggtcacatacattacctggcttgcagccccttccttcatcttcaaagccagcagtatagcaacttcatatttctctctgactctgacttcctgcctacctcttccgcatttaaaggaccatcgtgattgcgttgcacccacatagatagtccaggataatctgcttatattaaggtcggctgactaacaaccttaattccatctgcaaccctattccctcatgccacacaatggaacatattcacaagttccgcggattccgtggacgtattcagggaggctattattctgcataccacatatgcaatgcaagaaattgagggcgactgtaaagagaaaagttggcatgacccatcatccctaggtggaaaagatcatccattcaaaagggacctatcatctgacatttaaaaataaatagaggagtgaaggtactggagatttccctaaggtattaatgggtatgtttctgttgactattggttcataaacccaaaacttggtggcttaaaacagtaatgatttatgatttctcatgattctgagggttggctggtgattccactgctggtttcacctgggctcattcataaactacattcagctgtaggattggctgagctggaaggtccaagatggctttgcattatccagcacttggtgacagccattggcagggctgcctcagcggttttcaatgtgaattctcatccctgctgggctaggccactttcctcacatggcggatttgtggcagcattccaacaggaagaaggtggaactgcagggcctctggagacctagactctagacctcacacagcatcacctccaccacattcttttgggcgaagcagtcagaagcttagcattaattcaagaggaagggaaatagatttcacctcctgatgggagttgctgccgtggccttatttcatccagcacaggctgtaaaggtaggagttttttttctgagagtggaattttgaaatttgagatttcagaggcaaaatgtttctggatgacaacaatatccagcacgtgtccaaaaggatggatggctcaagtaaaatgtggtaaagatcactggcactgaaggagagaagaaatggtgagactaggatgtgggctgcaccatcctgtaggcccaagaacgctgtgtgggcagggagtgtggaggagtggcttgaagtccaggagatgacagcaataatagcgggcaggtataggatgatcagaccagatggggtgattctgtagaccatgaagagcatgatcacgcttttctaggtcagccttgtgagtggtggggaccagaaccactccaccatgcccttcacttccccacctgcactgtcttgtttatttaacaatttttcaaataagcttgtcccttctgacttctgaatactgtgcaagtggattcatcgggtactggtgaaaatatgaaataacgttcaagtcagttttgagtaagatgacagagctgccatagtagcagattaccagtgtccattctttcaggcttttcttttttttttctttctaccttccttgtctcctcaggtatgtatctaagtatgagagggtctccacatcgatcagcaggatttatagtgatgacatttattaatagtgttaaatgaataatacttattactctcattctacgtaaataaaaatcagaaaccagacagtcattatccagatggtcctaagagtacactcaaccatcagaatgctagatatgaataaattagagcctataacaagcggagaaggataaaattgcatatttttataattactaccataatttaatgtttctttatgtgtaacaaatgaacaaatgatttacaacaatgcaactgtagcatgagtttccatccttggctgtgatttcacattcttaaaatgctttttagagaaccacaagagaaatttctactccaaataaaagattttcagtatttgggaattcagtgaatgcttcctggaaattccacatctggagcaagtgatctgggccctgaatatttaactctgccctgccttttattttcccttacatattatcccttttgcacaagggtcagcacctttggcagtcactttggtctggagcggactgctagggattagaggacccatagatgttattctcacctttgacacagaaattcttcttaggactactcatgaaatgtgtctaaaaataagtgaagcaatgatagtttttgtaatcatagccttaatacaaaactagaagggctcctgttactctcaaagtaatcttcagtgaaagcgacacagccattccgtcagtgctgctatgattcagcttatttgggggattccttcttgggggctgctatcagggctagtttgcaagcctaccagaaaactaattctgcattattagtgtcccattctccatttttactaagtctaaacattctcccaaattttagggattggctctatatgacatttatctatcaaaaataaataaataaaaaaaattcacccttaaaagagtaaggtttcccaccactgaggacatttaaagtaatgaacctccatttccaaagttgggagactccaactagaacctgtgtttctgattcaggctactaccccatgctaatgtaaccagaaacttgtcgaagagggttaggtattactatttttattctggaattgagaaatgcctcagacaagcatttttaacccatctttccaactctattatcttctcattaactgtgacctcctccctgccccctccacacccaaaactttttctgtcttctttgcttaagatcagctacaccacatcttgtttctgtattctttaattttcagtgagttactgcttggttaattcttccaagttgtatcctttttatagatctttgtcattattaggtttatgagtttgcatctaattctggccttcctcctgactcaattttgttgtcatctgaagacattcgtcttcagcatcatgattataatttttgaaaccatcagtgtgtcagttacggcactgaggacttaattcatcagttcacgtaatcctcacaacaaccttaggagatgagtatttttatgatacccacttaacagatgaggagactgaggctcagaaagtacaaacaacttgcccaaagtccaatgactggaaaatgggggagctaggattcaaactcacatccttctaaggcagggtttcacaacctcagccctgtaacatttggggctgggtaattctttgttgtggggtgttgtcttgtgcatagcagcagtgtctctgatcttctacccactagaagcagaactccctcctcaaccccccaccaagtgacaaccagacacgtttccagacactgcagtgttccctgggatttgtttaggacctaccaatctaacaccaaattcatgcttttgctatgttatactgttagatgggtaactaagaaaaccatagaagtttaaaactgaattttcaagaaatcaattttaggagtcaccatgcctggccgatcatcagaattggagatttttaaagactctttttccccacccaggatgttcaggataagtatgtgtcaggtggacaggtatctgactgttttgagcctctccacagtgtaggaattacagatctaatcctaacctaagcacatatctgttccttgaatcactctactccattcctgccaaatcgttctccagcctcagctttaacacctcctgtgatggcgttacagtcgacagttccatacccttcacttctgagacagtccatgttccaatagtcctaactgtgaaaaagaattcttcttaatattctttctatatatccttgtcaatgcccttaatctcattatccaagttatcatttttctcaatcagatgaattaaacaaacacttgagtcccaattatgtattaggctttactctgaacagtttctttaccatagccattaaaatcattactgactccttaaaaatgaccgcccacccacttttctcagtttaacaatggacttccattgcttgtcagccttttggctaagatcaagtgtagcatctgttcttattagtttaacaatagactccctcaaaaaggcaattacaattaattaaaatcttaaaatcatacatggctggcctcctgtccagctgctactggtaagcagcctgcacccctgtttgtggagggtcctgtccctggggagaccaagctggcaggtgctttttttcttcctcttggcctctcatcagcagccctgtttaaaccttcttggatggtctcaggaagattccaaagtaactctcctggtaaaattattctttgccatatgttccagatttcttgatgaaaacacagaagataatttttttgaatcttgctttattgtgggccctcaagaatatcttttttaaggctaggcatggtggctcatgcctataattccagcactttgggaggccaaggtggggagatcacttgagataaggagtttgagaccagctggccaacatggtaaaaccccatctctactaaaaatataaaaattagccgggcatggtggtgggcacctgtaatgccagctactcaggaggctgagccaggcgaatcgcttgaacccaggaggcagaagttgcagtgagtggagattgcaccactgtgcttgtgctgtagcctgggtgacagcgtgagattccatatacatatatatatgtgtgtgtgtatatatatacacatatatatacacacacacatatatatttatgaattatgaatttgattaatacaaataaatataagttaatttgattaaatttagacttagcagtttactcttctttgacatcaggtagtctttcagcctgcacttttgattattctctaagtccccataacagttttgaacctatagaaaactgcttttcaacaacagatattggctaatgagcgatcttgtgatgaagtagatgctagcattgccaaggctacctattgcccaatgttgaagttcagccctacaggtgaccggacttgctagcaggccaacgtgagtatccagtaggctataaatgtgtgccagctgtcccgacagtggctgaatggagctccagtaggcaggttgtgtttagagaaaaccaaggagaaaataacagttaacgggaataaactgtttggggtcaaaataacagtcccatgtttttgtacttgtgtgagatataaaaagaaaacttgagtgtcaattaggcttagtacgaacttccaaacattctttcctgtgcttgtgcacctccaaggaagtggctggacgaaggcaaaactccctgaacctcttacgtctttgattgctctggaaagccttggtgtccttactgtggtgttcactctcttcttacagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtaagatgcacagagtgtcttcagcatccctagggcacatcattgctggttgccagtctgattttttctaaaggaggagcgtggataaattacacattcaaaacaaaactaacctttttagtgccacgagagaaaacaaaagcaaaatgcaaaccggagactgtggctctggtatcctgaatgagggttgagacagatgattccaggaagggaattaagacttagcttaaatcccgtcagatagaataaggaaacttaatgcaagtgaattgatggcactgagggtgctgacttgaacacgcttctcctggggaacttctgactgacaccgagcacagatgctctctctctctcctgcaggtcttggagcgttctcgggatgttgttgatgaagtgagtgtttctctcaggctttgggatacttttggtgatcatcacaaagacagacgctttgcatatggcaggtaaaccaagactagtacagcgtggttgagcttgaatgcaatttccttttcaaaaccagcagcgggtttacaaatcaacaaaaaccacatcatatggccttgaaatgtgctgggttctgcactgtgtctaagaaaaggaaaagaaaaaaaaatggtattgtttcctgatgtcaagaaaagaagcgtgccctgccaatgaggaagtactgtgttgaaaacaaccagtggtcaagctggaaggtttgctagattaggattctgtaacaccctccaactgcgggctgctttgattgctggttctctgagtaacacttcacttgccttctgttagaatgttttaagttattttggcacttggtcaccctacttcagaaagactgtttggtcttttcatgaccatattggcagagtctaatgttatttgctttggattttgtgttatctgaaaagtctattatttttattagaaggtcatttttaaaaagaaagaaaaatatctccaaagtccttcgcaagacatatttccaaaatgaacagaaacactaacgtttatttttttaaaaaggagaaaaaaatctagtaatgggaaaactcctctagaaggacattaatatgggtaggaacatggtcaaagtgccttaaaatatttagcaacctctccttgccaccataacttaacgtctctctcaatgaatgggttatagctgttaaattctgtattaatggagactttttttttaccacttaattataaatgaacacatttcattttcagtgtagaacgtagatatcatggccttgttgtctcttcttaacatcaaacatcatatcaccttacaggattttattagttaggtactccaagcacgtgaattactccttggtattgagataagcatttctgaagattcttctatttctacaagccagtagctctttgaacggacttttattgtcatttatctaagtggcctaaaataatgaataaactgctgaaagagtttgccctattcccaggaattatttcacacactgaaagaatctgtgacttagaccactttctttcaaggggactcagagagttatggaagcaaaacacgattttaatgtccccttggtaacaaggacttttgaacttagtatcctacatcatagatagttttcttttccttgaatttcctggattttttttctttctataatgttgttgattgttatcttaggtgccattttgcttttttcttttgtccaattgttctacatgtaaaaataacaattataaatgaacctgcttgtaactgctgggcagtcaggtttgtaacacctatggttttgaggaagcttgatttgatgactttaggcagtgtaaggataaatacagtagatttcaaaggacttttttatatccccacttctaaaacagtgtcatgaaaatgatgagcctgatgatgagttaatggaaatatttgggtttagaatctagagactatttcaacagctcagtggtttgttgccactagaaatttatgcatttgtcaatacctgtgaaaaaataacagaaaaaaaaagagaaaacaacaacaatgaaatgtattcatttcaaacaacgaaatttaacatgacccctcagcgtaaagctggtgtggtggtaataaaagggctgcttcattatcttgtgagattcctgcatagcatttatttaatggcacgatggccttcatagatccacactgggccccgtccagctctctgacatagctggagtcattttacaatacaacatgccatacctgcgtgtgtgttccctcccaacaaaaataagctgctctttcctgtgactccatcggttcaaagtgcattgttctgctcccttgtctgtaacatttggttctgtcaactgtaacccattatccctttgatagaaacaggaagtgctcccccaagccaagtttgattctctgagcaacattgaggggcttcaggaacactcctgtgtttctggccacgttctccttagggccttgctttgtgtgcatgtttgtaccttgtatttcctctgccttttccaattcctcacagcctccaggcgtcctgacacagaccccacctctagttaaagaataaaaaccagagctcctctctcttgcactccagcatctttctgtaaatgctaaatatgtaatatcacattgacgtaatgccaaaaagttacatttttatggaaaaaactgagagaagtaggagttttttaattcactataggtccctaaccagtacatttcccggctctgagagagctgtttaatttcttaatgacttcaagttttacctttatatcatttgtgaaggagaggaatcataattatagcttttacaaaccttttttgtttttgcaaaacttgtttggtttgcaaacctgttttgtgactgacatttttactgtacttagtgagaattacagttcagtgggatgtactcaagacataaactttgaggcatgtgaaatacattccctattcttgaaaatgtattcgaaacctttttaaaataattaatttgattcttgtggtgacagtgagagaagccagatttaaaccaacatgttttagaccttgccttcggtttcctctgcttcatagcaaaaggtagttaataagttgcccctcaaacattctttggcatggacaagctctagtttgcagagaggattctgtgggatgaggagttgtcagtggtaggcagttggccaacttgaatttgcaatgttcctgatgtggtataaccacagtgttattgctctcttatgatttaaatggaactattctacccattcttttgccaattagaataaaagctccaatttttcaaaagcctactgtgtgccagtcaacacattaggtgctttgccaacattagttaatcctttcaggaactgtaggaggcagagatgatcttggtgctaccattgagtaaaaggttgagttcttttactaccataaatttgcccaacaagtgagtctcagaggcagattcaaagccactctgcctgactcctggctctcactctttccactgtgccaagctacctcaacctactgggaccctacattggtgagctggatttctatttgctcttttggatttgtgcaaagattggaactagaagagatttcaaaaggtcatctggttgaccccatgtcttcaggaagggaaatcatccatctatccaaaaaaaagtattgataggagcccttctattccatggagatgaaggaaacagagtagcatgagtgttgtaacgctctgcactttgaaatctgtcaaccctctcttctctggggtgaataactccagctctcttatggccttttttccaccacctactttatatccacttttggatgaacttttgaagctcttttctggatcttttaaaatgtcaggaacaaaaccatacatagtaaccatgactttgatcagctgctcttttttggcaaggaaagcgcctcttcttaaagggatgtcgctcaactcaagagttgtctcctggagctcttataaaaatgaaatgtccacatttaaggacttagcactgaaaatataggcaaacaggatgggctctgcctttatcaggaatctggcccttcagtccctgtattagtctgttcttacactggtaataaagacatatttgagactaggtaatttataaagaaaaagaggtttaatggactcacagttccgtgtggctggggaggcctgacaatcatggcagaaggcaaaggaggagcaaagtcacatcttacatggtggcaggcaagagagagagcatgtgcaggggaactgccctttatgaaaccaccagatctcatgatacttattcactgtcatgagaatagcatgagaaagacctgctctcaagattcagttacctcccactgggtccctcccacgacatcacgacatgtgagaatcacgggagctacgattcgagatttgggtggggacacagccaaaccatatcagtcccttttgtctagtcacacataggtaaataattgcagattttattgttttttttttcccctataaaatttccttcattgatctgtctgcaggtcagagaaccttcagacactgaataaagcctatgttgctgacagtgataacaactacagtttaatcagggtgccccaggcaccaggcctgtgctacgtgctgcatgtgtcctgtcctgcttcactcttgtggtgagcctgcaaaataggctcatttcacggttggagaaacaggcacaaaaaagggccaaggtcagacagccaggacagagtgcagctggactttcctcttgaatctgtctgactccaaagcccatatcttccccatccaccatgctgttgtagtttgtgatgatgatggatgacaaaattacttgaaatttcctcctggtacattctgaatcttacacagtactgtgtagaccctgaagaccagcactcaccatctattacgagctctgatattccagtgttcctcttaaattctttattccacaacaaataacttaattctttatatgcatccattaagtagcggagcatgagtccttttgctttcagtaaaaatgatacatccaagcaaaccttctgagagtgaatgggaatcttggcatgttttccccaaatcatttaacaaaaacattcagaaccactgtacttgcccttatccccagcaatttctgggcttattttgagtccagttagaacccatttattatctagtttattcttagacactgatttttctcaaatgttgttggttcctatgagaagtaaagtacatgttttaaatgataacattaatcagagctatggtttctgtatgtctagtttcatgttgaagttacctgtaatcagacacgaatgaacacaccccattctcaatgcacagttgaggccctttaaaaaattcaggactgtagtgactggtgtttgtatctttgcctgggattggttgtgcttgtgttttacggcaagcaaaaaagtaaggatcagtgagtgtgtctagatacagcattttgagttagctcttaatgttcatagcacattctaaagcctgggccagaaataacattgtaatgatgatgttaggatggcaagcagcccgttgcacagtgaaacttcaagtggaccaggaggtggaccagggccaggactagggcatactgagggagtcactcgctttgggcataaaatgtaaataataataatcttaaaaagacaggatcacaattgctattttggtttttttttcccttctgcctcagacacaatatggcactgttactcatgctgactttatttaaaattttgatactttgtccaccatggatttttttgccttaatttgaattttttttttttttttttttttttttgagaaagagtctctcactattgcccaggctggtgtgcagtggcgcgatcttggcttgctgcaacctacgtctcccaggttcaagtgattctcctgcctcagcctcccaagtagctaggattacaggtgcccaccaccacacccagctaattttttgtatttttagtagagctggggtttcactatgttggccagggtggtctcgaactgctgaccttgtgatctgcccgccttggcttcccaaagtgctgggattacaggcatgagctaccatgcccagcctgaatttttttttttttttaagtattatctggatcactgaagtttttttggtaccctcttacattttgcacttgaagaagtgcttcattttcttcactcaagtactggccctaatggcagactttataaatagatagcaaagtaactaagggaagaaagttagcaatgcatgtgctttttatggaaaagtaatccaaaccacacttttaaatatatggtaccaagaggtcttggaaaattattactggttgtgtcttaaagacattcagttcagtgtgctgctgtaacaaaaagaactaaaaattgctcaggttatagaaaaaagtagaaaggcatgaaagaaaagcagcaatttgaaccaagagatagaaatagttgttccctaagaggttaggttaaaactgttagctctcctatttgaacagagcagtcattcggatgtaagagttctggaagaggtgaatcagccaattttagccagtacctagaagactctgaggcagatggtcctctggccccactttggtaaacaccgtcctggaattttctgatactcgttaccaaacctcagccagaagggaagaatttttgacgattagagagagagcttttgagtaagggacgccaagcaaaaaagagcacatactgtgtgattccatttctgtaacatcctagaaaatgcaatctaatctatagtgacggaaagtagatcactggtttcctagagaagaggatggaggggagggatggatcacaaaggaacataaggaaattttaggggtgatggaaatgtttgccattttgatcatgatgatggttcatggggaatacgtatgtcaaaattaatcaaattaaacaataaatatgcaaatttggtatatttccattatatctcaataaaaattctttaagacgagaaataggccaggtgcaatggctcatgcctataatcccagcactctgggaggctgaggcaggtggatcacttgaggccaggtgtttgagatcagcctggccaacatggtgtagccccatctctactaaaaaaatacaaaaaattagccaggtgttgtggctactcgggaggttgaggtgggagaatcacctgagtgtgggaggtggtggctgcagtgagctaggattgcacaactgtactatagcctgggaaacagagcaagaccctgtctcaaaaaaaaaagaaaagaaaagaaatatccttatggacaaagtagtctatgatatatgaagaaaggtttgtgtgttagactatatatgttttaattatttatggaactttaagttagtctcgttgaaaacgtaaatcactatgtgaacttaaaaaaatggaaccagatccttaatagctgaatataaccctgaaactaacgatgggacactgtcatactgtcacacaaaatcatgctggttcccttttctcagagatagaaccccccctgcctcagtggctcatagtctgacccaggggcccatagtctgacccaggggcctgtttctcagcctgtggttatgtttatatctttttctagcaagaaacgtttcaccagataccctgtgatagccaaatagagaacaccacgttctgtgaaaattttccgtttcttcatcaaatagtaacaattttgtcttttgtagctggttcgttctggaactggtgaacatggtggtaatctctggcagcatgcacgtgacctctgttttgtacccagtcactctgactagaaattgggtgccgagttgagtgatcaagtgggtcctctcactggggttggttactagactcatgggcatgagactccattcttatttgtttctctggattgaatcccagcctgccttcccagcctcctgtcttggtccagacataacaaagtatttgcagttctgtgccctttgtaccctccaggcccacaaacatgcattatgttagaatttaggcccctatcccacctattctcaagctagctaatcactactcatatgctaagaattagaacaagtgtcacgtactcctagaattcctctctgcactcttcccaccctctctgtcaccttcggaatccaggtgaggtgtctctccgtatgttcccataggacagctttgcaaatccctatcgtagcaataactgtattgcgggaaaattggctccttaattttctcccattccccttatcctattatcctagtatatttaggacagagattttgtctttctattttctatccccgatacgtggcctggtgtcttgtaggagcttgatcgatgttagttgaacgagttgacaaatctctcatgtgttccaggatcttctaaggcatagacaaggaaatagtcttataacaaatgccaaattattttactaagttgaattttatatatgcccttttgtaataagaataacaaatgatggatcaacctgcaggtgatgaagatggaaaatactggtgcttagcctctccttagtgaattagcaaacggaaagatcagctgcccccaggagaaaaaggagagagttacactcagccacaccctcaaatcctcccttgttttccccaagtttttggacttgtaaatttttttggtaatgccttttgtgaatgagtattcttaaacagtgaattacttgtatgaataataacgcttttccaattataggttgtttctcctctgggtatcattttcaagatctttataagaataatttttaagaataattatatagagaaacattttttaatccatttgcctaaagatgagagcattaagtagaacaattaaaggtggattattgctgttatgtgatcatccaaaacaaacagatacgtgttagactacatgcatacaaataattcaaaaaattaaatctgtgatggaagtttagggattctgtactaaagaactcaagcatagaattgcagtgaagctgaatcatctggcgcacagaagatacatgtaccattctctgtgccaccctcagcctgctgtcccacactgtccttcgcgctctgaactggtacatcttgtattctacccagaagggaaaaacagaagagctgggattcctatgcctgacccagccttgtccccaggatgaaattgtccttggaaagcggagtgccaaatgagatagcaacagggcttgattgatgcctggggctcacccatgtgccagggccaggaaggattttggctgctgcccaagcaccagtcacatggctgggttctttgtggctcagcccagaaaagcattgatgggcccaagagagtccacaggagtgcgattaatgaggccactgcaatgggcaaagagaataaggaatatatgcattgttcagtacattaatgtcttatgttctgcgttccttttactttttttctattactgcttaataacaggaagcttgacaagttggtcaaatacaactaagtatgttgacttttcatgatgaaagaagaaaagaaaacatcagtttgtgatgtgtttatactggaactttctgatgaagaaatatattccagcccatacagtttttcctttcaaagtaggtggtgaaaagaaagagactgttaaataattctgcatatcctcagtggataattctgttacctatctttcagctattccatatcaataaaggacacagctggtaatccaaaaggaaaggatctcttgatgaaagtgttctgccattcttattaaagtcaacatacaagatacactcttagtgatttttgaacccataattatatttgtctgataataattggcacttaacggttacagaacactttcactgatattttccttagtgaatcttaacaacaattctaccagtaatttctaatatttgccatgattagactttcaaaattagtccaccactttattctcccccaaaaatgcctctgccctcagcctagagagaataagtcagaaggaggaagttctgaattgcagacacagaaatcacattagtgaattcttttttcaatgtatcatcttgactatgcttttagtgatttgcttgtttgttttgtgtgttttttaaaagcaagatggtctgtgcaatagagggctttcttaagccttaattctgttgtaacttacctggaattaatcctgaaagtaacctgtccatttctttacatttcctttgcttctggagataatctaattcctggaagaaattattaatgcattattattctgatgttatgaaattatccaattacatggggtaaagagattttttagagaaattcaaataattaaaatatatagagattaaccggttaacctctgccgtataccagaggtattacatggcagtctttcagcattaacagtctgaagaactgtaatggctcacattatattttcattctttattgaagttccaagtgattctctgacttactttaagcctaaattcatctgttttagactttgagtctgcagacacatttgtatatgcaggttttactttctgatatccataaggccttttaatttaataaaaattaattgagggcctgtttccttacactgtgtgcgcacaatgagagagaaattaataggaacaggacaaaatccctgaaaatgacctcatagtacggtggaaaagacagctacataaaccattacaattcagggttaacaatgctgaactagaggtgtcagttcccggaacagggaagcagaaataaatagctcacgaaaaagcttatcattattctgaactcttttggttcacatcacacatctgatcctcaggctataccttcagtgtgtgtatacagaatgcagccacttccacctgtaggggacccctcccaggctcagcagagtcaccatcctctctctcggaattcttacctcttaattggtcctctgcttcttcctgcctttccctccctatccgctgaccctcccagtcctctcccactcttaccttgccaccaatttagtccattctcattaaagcaatggactgacactgttcaaacataaattatatcactacgttctgctcaaagacttcagtttcccctcacgactgtgctccagcagaatggcatggtcccttcctccaggagggcaccacaggcaggctcctacctcgggcctttgctctgtttcctcttctgctaggttcttcccccagatactggcatactgattccctcccttccccaagggcttctggaaatgtcaccttctcagcgaggccctccctagccacctcattttcaacagcaatttttgcttcccaatatctctgtcccctttccctgctttattttctaattggcacttagcactacctatttttaatatttttcttcttgattgtctgtcttcactagaatgtgaacataatgagatcaagtgtgacaaggacagcagtttgtgtcttttactaatcactctatccccaatgtctagaagaatgcctggtacacagtaggttctcaattactatttctgcaagaaatgattagatggttgatgaataatactggataagtgacttgaccattcctgatacctttactgattcaaagagagttgccaaggaggctgggtagagtccttttgtcatcatggtcaaatgatcgtgctggtttacccagtttggtctcagaagagtcggggaggttaatcccagagacctcccatgtagcgcggtagctgacactgaagttttcttatgcgtgcaacttgccctcagaagaaaacatgaaaagtagaggaaggaagttcctcagtcattcagcttcagggaatgccaaagaggaatatgaactccagacggagttgaaagagagtttattaccacaatttcaccttcgtctgtttagcaagccttctttacttcagtgcctcctgcattcgttgaccaggagttaagtaggactgtttaagctgtttcttttaataaattatttgtgcttcacgcaatttcacatgcattcaacttctgatgattatgtgaggtgtaagaataaactaacgggagtatgatttgccaagtatagaaaatgagattttgagtggaaaatggcctgatttcattggatgataacccacaaccttctttggcaaggccattaacccctatgatatttgtactatgatggtagaaccaaccatttctaagactcaagtattaggttggtgcaaacgtaattgcggtttttgccattgctttcaatattatctaccttagggtttggtggcattgctgggatgctgatgtgacttccctgcacttaagagcatgcattgctttggccccactttcagagggtggtggaagactggtttaaaatattgcttcctactaaacatgcagatacgggcttggaaaaaaatagttgcacaagctaatcactcacaaatctggatatatttcaggatgttttgacagttttccccacataacatctgtacttaagaagcctcacgctattggtaaagtattaacttgatttatctgctcacatccagggcactgcatggttctgccctgctatccccagatcccctgccaggcgctcccctacaggcctctccatcctccatgagtatgagcttacacggccattcatctcctggtggttatgtgcaccatcactgacaactccctctgcatctcatacacactgggctgctcccctactaaaattttccaaagccacgtgttacacattccttttctctgccatgctcccagctgttttgtgctgttttgatctgtctgtttgcatagccctgtcagactatatgcatgaaagatatgttgtcgacatgaatggttttgaaaatgtttctgtaaagaacctacctcagttaccagcagggaaaaagaagcttgaagccccaaagaaggtcagacactcctacttgaatctttgccagagggggactcatgcacagtgacaaagaaaagaagcccattaaaatgtgaccacaatgtctgtccatatactggatatggggagtctctcctaaaaaaataagtaataatagtcaatgatgacatataaagaggtgggatcctaccatggaacaaaagaatttgtacaaatgtacattgaaaggagatacttcaagcagaacttgggtaaatataattattagcggccaggcgcggtggctcatgcctgtaatcccagctctttgcaaagccgaggtgggaagatcacaaggtcaggagttcaagaccagcctggccaacatggtgaaaccccatctctactaaaaatacaaaaaattagccaggcatggtcatgcgcctgtaatcccagctactcgggaggctgaggcaggagagttgcttgaacccgggaggtggaggttgcagtgagccgagattgagccacttcactccagcctgggcaacagagcaagactccatctcaaaaaaaaaattatatgtatatgtatgtaattgttagcttattcttggtcaccaagtgttactgtatcaagagacccaaccagactcagacaaactggagaagggcatttggctgtcccactcatagctttctggagaacttggtggagtccactgtccttctcattgcccgtaaaatttacctgatctgaagcttctagataaaaagataatgtcagaattattctttcacttaaccaggtaagaaaacccaaggcccacagctcctcagctggatgatagtggcaaaataaatgatactagaaaaggaaagtcaaactaagaagacagtacttttgtgacaggaaagaatttagaagaaaattcatttaacaataaaagtttgttactgattatcaattcttttccgaccatgtcttcaaaggatgaatctggtatttcagattggaaaaaaagttgagcttctggttgcttctctgatcttttcccaccaactctgctatatttgactgtagacattataaagacagtctctgagaacatgtgtggtattttgctgttcaaagtctagctagggccaagatatgtgggtaagatgcactttttttggatttttttttctttaatcctccaacaaagattggtcccaactttgcatgtactccttatgttattcaaatatccttgccaatctttcacatgctatctttggccagtgttcccctcgaaagataactgaaaaaaaatgcttttttttgtttgtttaaaatctgaagtaaaactgatgcagctgagcttggctttatcagctcaggcatttttggatgacttggtctctctgattcactcccactcctctatgaaacaagatctccaattgtttcaacatttcgatttatttcagattgtttttgatttgactagtcaaaacattatttcatggacattatttgatgtcttagtacccagcgaaatttttatattgatattttctccttagaaagaagaagtcatttttccctaagatataaacattccgtgggcaagggcaagcaactaagaccatatatccttaagtcctttgtaattctggctttctctaataaaactgtttagcccagtgaaacataaaatatttaataaaagtaagtacaataaacattccaaactccttcctaccccttttcagtattcaggttctggagtttacaatctcatgtaccctgtactctgcctctgcattctcgaattcttatgctttttaccccaaatatctgtaggactccatttaaatcctatttgattcttttacagctgaaacaggacccctgaggtcatttctagactaaccctactgcctgatatgtgagaatgtcctcatcacactcaccactcccaattatttttaaactgactcttcaaagttaaaaaatgtaacagagccatagaaatagaaatgctagaacttgcctgtttctttttatctttcagaggaatggtattttttaaacacaagcttatgtcagacattgaacagtctccacatgggaatgaatgttttgattaaaagttatttaatatctctagttccttggcattctgcctaaagctggagatattcttagctgcaggtcttgtgccttctttgactagattaaaaaaaaatggctcaaaatctagagggaataaatggcattctgaaaatagttacttgattgtatatgtgtttatatcacagaggatactgatgtgttgagaattaggagttacaaaagaatgttggtaaggagaaatgcatcaaagctgcatctttctatagctctgtcactgcgtccattgattcctaatgcttagccttttggttaaacttggttttagggagctacgttcatatggcagaccttaagaatagaattctgtgtaatctttatgtaaagttttcttaacttgcatttgtatttagatcaacaagggttaaccacaagacatttaagcattgtgatacttaaaatatgatcttgggccgggcgcggtggcttgcgcctgtaatcccagcactttgggaggccaaggtgggtggatcacccgaggtggggagtttgagaccagcctgaccaacaaggagaaaccccgtctctactaaaaatacaaaattagccgggcatggtggcacatgcctgtaatcccagctactcaggaggctgaatcaggggaattgcttgaacccaggaggcagaggttgtggtgagctgagatcatgccagtgcactccagcctgggcaacaagagcaaaactccgtctcaaaaaataaataaataaaaaataatcttatttttaactgctttcagtgtaaaataatgagcacagattctcatagcacctaaatgtgaatatgaaaaaaaagaagaccttttttctgatatacagatagaattttgactcaataagttattttatcttcagaggtagtattgctctcagcacaacctcttttctttaactatcattattttgaggtgaaatatttacaggacattgaattatttttccagctttccaatggcatttcatgcatttagatattgatgtgacatagttagaagttgggccctcaggacctgtattgtgtgatggcattgtgctactatcatcacaagattcctttttttccaacccccaaggtcctgtctgtacttgtttacaggtcatctggatagcaactagtatgtgttcaataccatgagtgttatcatggtaaccttgacaaccaagctagctctgatttcaaaacctcacatgctgtatcataaaattagagaacagaattgacatttagctacatgtctgtcatataaattaagctctgagaatgattccccttagagccatgtgtcttaatagggaaatagaaggcaccaattagaactattttatacatattataacacatttaggtgctggatatatttcctcaattctttttgtataattttgaacctcagatattctcattctattctcactgtaccaaaattcatggtggctttattttgtgttcaggatgaagcttatagcagagtttcatcagatacctgatataaatatgattatgaataatagaaaactcagcccataaaaaatgtaaaattcaaagcattcttggctttactggatactgttatttatgctgattgtaagtaagactgagcgcagaatatttcactaagtaaatcagaatcccaaagacaagacatgtttccttttcatttatatatttatgcatatttttgctcatattatcccagcatccaaaaatcttgatatctttattcaagatgattctgaacattcagattaatacattcatctactttaagtcctaggtcctctcttataatttggaaatattttaatctcaggattttctgctctatttgttgtggtctggtgcagcttttcttggatataaatttaaagacacagcttgtgaattacatttaatgtaagcaccctgcagttttctgcattgcaagtgattatttttagaaattttatggttgcctgcatatatttgtttgtcttcattgatatgtagggggggaagctcattaatgatttaaaaggaaggtgttttgattcatcgacttgactcttctcattacataaacagtaaaggcaatggcaataaattaacatctaatgaaattgtaagagtttatttctgaatttagctacaagatagtcttgaatccttgggcgtaacttttcttattctttgtatccttttgcctcagtgttttgaaagtcatcattcagcacattttaacctagaatgatggtttataattcctatgaaagattccttttagcagctatttatcaaacaccataattggacaactgttttgtaaaatagttctttgactcctagaatggtaagttattatgtaaaaatggaagacccttatgtcaaaatttactataaagcagtttttcttttccccatatacctgctttgtatctcatgtaacatttgagaaatctgcttccaatattttctcatcttgttagtcatcaatctaattctcgcctagttatatgttaaatattaccttcttgccttacttagtaaagagtcaaaattcctgcaaattcaggatttttcttttcggaaacagataagtggctatgctgtctacatgtgtgcataagtgggaagaagggcagaaatccttctgtgtatttgctgaccctgtacagcaaatacttgttacattttcagtaatgtttaaattgtttgctttatctcattgggatgagtcatcatcacctttatgttttttaaactggtgaaaggtagtttgtattttcttttctcttgaaactatttcttgtgatgaagagaaatagttcagcatgttgtggttccaggactgagacaagtttgggtaatcatctctaccataaaataacttcatcggaaacgtcaatgcatcagcattctgcagtgcaatatggaaatgaactgttaggctgtgttggtgctggaatgtgggggcttatcaggctgtttgcatgactccaagatgttttttaatatctggtcttttttttttttaattgtgacatgagatggcattagaaggatggggtttgagaggaaccataatggtaaaagaaaaaacctgttaaaaggcaatacaagcttcttttatgatttccttttaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggtaagccaagggactcagtgtttccctgtcctgaccaagttaaaatttacaggcagcaggtgtctctgtagcctggtgttctgctcttcaacactcctggatcccatcaatcagccatgggttttaagtcagcccataaatcatgaggagtgtgccctgagcccttctaacaggcaccatcatctctggtgtcagaactcatttttgtcaaatgattggacagcacttgaagtaaattctctaattatgaaagtgtgtgattaaaagcactttgaaaagtataaagtattagacaaaatgttggttactcataataatgtcatccttgaaattataattattacaataaaattagttaacacttagaggtatctgggccccagagaacatcagattcatacaaacacacatattgaagggtttttcatcttccttatattcctcagtccaacctgttacagtatttcattctcaagatgacagtgtccactttttgaaaatcattcggacctatagttgcaaaacaaacagttactactttttaaatgtctctagtggttacatttttaagtgtcacaaatgtaaaatacaacttgaaggagaatttgtttcactatatataaaatgtcgatattgattttggtggggtgtattagtccattctcatgctgctaataaagagataattgagactgatttatgaaggaaagaggtttaattgactcacagtttagcatggctgcggaggcctcaggaaatttgcaatcatggcagaggggaagaaaacacatccttcttcgtatggcggcaggagagagaagaatgagaaccgagcaaaggcggatgccctttataaaaccaccagatctcatgagaacttcctcactattatgagaatagcatgggggaaccgcccccacgattcagttacctttcaccaggtccctcccgtgacacatggggattatgggaactataattcaagatgagatttgagtggggacatagccaaaccatgtggagggaaatacgtttcttttaaaatgtcagttccctcaaatcccctttataaaaaaacaactttttatgtttttttaatgttgaactttttggctggagagcactccttttcaaaaaattttgatattaataccctcctctaggctgggcacagtggctcatgcctgtaaacccaacatttcaggaggccaaggtgggaggatcgcttgaggccaggattttgaaaccagcctgggcaacatagtgagaccacgtctctagaaaaataaaaataaaaataaatcagccaggactggtggtgcacacctgtggtttcagctacttgagaggctgaggtgggaggatcacctgaacctgggaggacaaggctgcagtgggccatgattgcaccacttcactccagcctaggtgacagagcaagaccctgtctcaaaaaaaaaaaaaaaaaaaaaaaagcaaacagcaacaacaacaaaaatcccttattttgacatttacctaataggcttattacaaaattttatattgacacaactttttatgctctccaagcaatagtaaatggtactttctttagacaatttctgatgttctaggtatgttttgcattaaatttctaaaaacactttatattcagttttcacaatccttctgttcttcagtgcatggactaggaattgaatattaggggccatgtagaggttaagaagtccacagtaaatgagagactgtcctggcctcagcaactttctgtataaaaataggttatgataatcagtcctcacaatcatggactggaggagagttgcagagctatagagaacagtggaggggacagtgccttctacagagcaattctaagaagattttgtgaaggagtttgtatttgagctaagccttgaagagtttcatcagttggtaaatttcaagtcagtcttaagaacaaggaacacaatgctctcaggagcgaacttttgagttaaaccttcttccctgaacttcccttccacctttgtcaacaccctataattttccctccttttcatctaagtcgtcaaatccaaattctatccagtattatctttttcctcctaagaccagtgtctgtcctatatattacctttggtgttaaaggccaaatatttatataagaaggtaagttcctaagggtgtgtgttagaatcaatactttgtgatgtgtgtcacaataaagcacttcctgcctgtgttctggaacccatctatgcctttgccatggttatgccataaccccagcactgtactgcatctactgtttccaaagatttgtcctcccagggtttgattaggttgtaaatgggccttgtgtgccagcctaaagggtatggactttattccaggggctttgtgacatcagaggaagttaaaacagaactgccgccaggtcatagttgtgttatgtaaagacttttcttgcagcagtgaggactgtggactaaaatgtgaggagtgggtgtgaagaaagattagttaaggggctaatgcaccagtccaagcaaaagaaggcttgaagaagggattggaggaaaaaagaaggcaaagatttgaaagagaattcacaaatccaacagagaagagctgtaggaagtggatcatttaactagaagtgggaaagtcttgactctaattgcttaatagaggtctctcagcagcctgaaaatgtgacttcagacaaaccctttaacctttctgcctcagtttcctcagaatgtagaacagaaataatacctcacagggctattgtgaggcttacatgaaaaatgtatatgaatggattttaaagttataaagtaaaattcaagtatgagatgctgttgataaaggtgaaggtgatgaagagagtagtgataatgatgataacagctaacatttatcaggcacttactgtcgacaaaatactatgcttagcattgccatgctaataatttaaacatttcaatagtccttcaagatataattactcattgttattattattcctgtcttacagatggaaaaactaatgtttaatgaggttaagtaacttacccaagattaaatagctagtaaagtgatgatccttcagttactgtggttacggctgacagcatttttttttaaagaagtaaaacactctctatttaggcacatggtcatgtaaatgaaaagttctaaggaatctacaaaaaaagctatcagaattaacctattaatttagcaaaataataggataaaaggtcaatacacaaaaatcaattttatttatataaactaagaaatgaacaattggaaaataaaatttaaaaaacaatgccatttataataacataaaaacatggaatatttatggataagcttcacaaattatgtgcattgaaactctgaaatatttgaaagcattattttttccttcaatcataactcctttatagttcaaagacttgaggtggtggcagatttttccagagactaaaagcctgactggagttttcagtgtatagttccattaggtgcttagataggcccttgttactgtttttttcctaaaacaaggctgattataatttttaaaatgttctatttcaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcgggtgagtgggccgcggggcagagccattaatacctttgattgtgtttcattgaacgttagccagacatgagcaggagaaagaagaacgatagctaacatttatacgtacttattttttcccatgtacctttctaagctacaggcattaacttctttaatcctcatcagacttaaaggttaaatatgattgtctccattttgcaggtggagaaaccaagggacagagaggttaggtaatctgcccatggtcacaccagcaataaatggtagagccaggatttgaacccatgctcttgtgggtatcaaaacctgttccataaaccaccatggtaccacactgctcctcaagagtggatcagggaccccaagcctatctccagtgggcttgttgcatacaattccccttcagaatctattctctgaccaattctattctccattgacccttcagcactgacccatgacaaaaatcagtgatctcaagtcctgaggccactaaagtccttgaggcaattttggtggccctccatcttcctacaaggggtgtctcatctgtttccatcccctctccttttccgtcctcatgctccttggccctgcacttctgtagttttcctgcacctcctttgcctttgataactatgccatatgctgcccgcagcaccctttcataattgttaagcatgctggtggcccgcatccaatatgggttattgacccatgcttgtactgtcttacacttggactatttttgttctgaaattgttctctgggctggtgtgtgggtgtgtgtaatttcatcgtaaaatgttgacttcctgacttctatttatatggatacctctacctttgtctttatcttttataatccctgccagggcattacacatttagtaagtggttcctaaagactcagttcattcattttaaagcttatgagtagtatttacttcaaacactggccattgtgttacagaaacagtcttgaaaattaatgaaaagaatatgttacaaacctacagtaacttaaacagtgagctttaggtagagttgattaaatcacctcctccttactggagaggcataataatcaaatacaatgtgggagtctcaattggattctgtttttttttttttaaagctatgaaatacgatttagggataattggagaaatttgaatatgaacaatatagtggatgataatagggaattatttttaattttcttaggtgtaatcatagtatggttatttaggagactgttgttattttgggaaaacttgtgataaggtagttaggagtgaagtgccatgctatctgtaaaaaaaaaaaagtctatacacatacacaaaattatacaaaaatacacatatagccaggcatggtggctaatttgcccacagtcccagctacttcagagactgagacagtaggattgctggaacccggcagtttaaatccagcctggacaacatagccagacccacccccccccacatctcttaaaaaaaacagtaattcggttacattttggtatagcatacgagtagagcatattataaatgtaaggtttaattgagtattaataagtaaaatggtgtaaattaaaaatatacgtaaaacaaacatgccaaaatgttaacaaggataaatgagtggtcatcatactgttcgttccactgttttatatgcttgaagttttgcatagcaaggaggaaaaaatattccctcctttctattactttctggttcagagagtttgtgccgtgactttatgtgtgatgatgtcaaatacagcatgctgccttaggtgggagctgggtgtgtcaaagctcaaagatggggattgacataaaatcagtaagtaaagacatgcaagagagagtaagggagtcgcagtttggtggctatgggagcagaagccttggttgaagctctcagcaaagttggctcatggttgtgtttcctcaatcccttggcagacgtgacatttaaattggacgatggagccatcagtgcccacaagccgctgctgatctgtagctgtgagtggatggcagccatgttcggggggtcatttgtggaaagtgccaacagtgaggtacgtgccttcctaaaagcatagtggtgtctttatgaatgtatgtgtgcctgtgtatttatataaagtgggtaaacagccagatgactttaatccttaaactggctccatgagtggtcatcatactgttagtcataatcataaggagctattgctccttagtagtgcttgagggtttggtcacctttttcttagatctgcagttttgaggagctattgtttattggtcactggtgtgggggcacctgggtgctttacatgccatatatcttttcatcctcagagccgtcctcatccatgaagacaagatcagctgtacctcttggcaaatgtcaccaggcatggtactatcaaaaccaagtacaagaggagcatgtctcccagtagttcagaaagggaaaagagttcttcagccacctaagtcctgggcttagctatgcccctaaccagacaggggaccttgagaagccgcattcctgtgcctcaacctcctcatctgcaagctgagggatgcactagattgtccttcaggttaccatgtgctacaatactgtctaaggctctgccctgactctgcctgtgttgaggggatatgagggtttgttaactttagggcaacagtaatggagcaaatgtttactcccctgaacacacctctcaaggtacttaggtctagcggaagcagctacatcacttgtcagcccctggctctatctctagaagagacatatgcttagagaagagcaaacagcatcttggataccctgtgtctttgtctttcttgttgttttacttttaactgacaaataataattattatacatagttatggggtacatgatgtttcaatatacatatactgtggaatgatcaaatcgggttaattagcctatccatcacctcagatgtttaccatttctttgtgatgagaacatttaaaatcgtcttttagctattttgaaatatacgatacattattgtccaccatagtcaccatactgtgcaatagaacaccacaaaaaagttacaggtgcattagactatatgcaactgtggtcctaggtacttgggagactgaagtgagaggaacacttgagcccaggagttcaaagctacagtgagctatgattgtgccactgtactccaccccaggagacagagtgagaacctgtctctaaaaaaaaaaggacaaaaaaaatgtacactagaatttattcctcccatctaagtgaaactttgtatatttgacagatggctttcctttccccattcaccccctaatcccagcctctggtaatcactcttctactctctactttggagttcaacgtttttagattccacatataagtgcaatactgtgatatttgtctctctgtacctggcttatttcacttaacataatatcctttaggttcatgcatgttgtcttgaatgacagaattttcctcttttttagggctatatagtatcccattgtgtataagtaccacattttcttattcatccatctgttgatggacagttaggcagactccatatcttggctattgtgaatagtgctacagttaacatgggagtacagcctctttgtctttttacaaactgttggaaaagaaaaaaattcaattcaagcacttctaactttaggagtgagcaagcatttttgtggagttttgcaagtatttttaacatcttttttaaaaaagtagaaatgaaaacatgggtacacccacccagtttattgtcctaagaggcttgttttacttgtctcagcatctttccaaacttttcaaagaaatgcaaaaaacaatagctaacttttcacatgaggcactagcacaagaaattcgagcactcccattgtgacccaggagcctgcatttgcatccccaagtagggaaatagaatcctagaatcacaagccttggatagcaggggctgagaagatcactaggccactctcatgcacccataacaaactgcagctgctcctaaaccaaccccccagcaaaaggctatctgcttttcagggaaaaaatattagagttatcctgatggcctcttatggtgtctaacagcctttctaaaccaggagactctcacctgtgactaatgaaaatctctcctgagcttgggtcaaaggtgttttggagcatcattactgagacaactgcagcacatggaatctgcacagttacaggactgtgggactcaaatctcaactcctccacttacaagtgacttgggcaagtgacttaacctttcttggctctagtatcctgatctggaaaacacagttataacccatactgtggttgtggggtgtaagagtcattacttgcaaagcagttcagaagcattcaataaatagtagctgccgctggacttattctgatgttgttggtagtgatggtattctttacctcttgtatccagaaaaaagctagggtagccaccaatttgtaaaacctcatccagttggtatttgactgacttcagcaatctctggagataaagagctgggaggattgctccccttctttgtccagctcactgaagtgcatgctgattgtgcagcagaggacctgctattcacagagtagggagaagttgatcgaggtcaggaacgcaggcacaaagggacactgtcagagctgacctcacgaatgctaatctcctttatcccttccaagaatggactgtaatcgtctccagattaaaatgtgcagtagaggtgaccaaaacaaaaacttggcagcgaatgtgaatgcacatgtatatggttgtttgatggcctctcctggaggaggccacctgtttagcacaccctgctggagagatgaggtccctcaccacttagaactggagttgaggctaataggtttgtatacattcagaccagctcaaaagacaaagaccacggaaccaagccactgaagacctgtgccacaattcctttagccagtatattgaaaatgcaatgagctgtcgacattctcgccccttcccgtcccttcactttatttcctgtgtaaactataatatactctcagcttgacgttggggaagtggctcactctaaacctgtttcctcatctgtaaaatggggataacaagaaaacctttgtcaaagggcagagaaggcatgagaggacatgtgtaaagcattgaatttgatgcctagaacatacaaatgttcaataaatgttagcgactattatgctagagttttcttgttaaattctttccatacggggttaagggtatttgtccccggaaagctctaagttaaaaagcccccagttccctttctgaactaggaaagtacaatacaggtggttatagttgtaggggaaaggcactcagttaatgctccatgattaacataggtccatgttcacacttgggatttggctgttgtaggccaccttttaactttctattatcttgagaaaatctgaaaatctgatgccagccaccctcccaccccccacaccatgaaaatcagccttttttggagaattaatagaattaatgtgcatatccagaaaagagtgaaatatgcctatgtccaatgattttaatttaacttttttgtcatttaatattcaggaaaacattgtatcttacttatattttttctcattacttttaatgtagcagtaagcataattctctccccagaggtactcagcaagtggttcattaaaaatgcatgcctgggttgtagtaagcaatgctttggatctaggatactttctcattctctatgagactgcctctaattataagcctaatagtctcagctaatcttcacaattaaaattttacaccaactaaactgcaagatagaacattgtttagggtagcattatattctctttgatcactctttttttttttttaagaaaaaagaaactatatccagcaggtaggatagaaattttttgattccattatttatgaagctttgcttatattatttttaaagtgctataaataaaggtctttctgttgtcatgcagttaattataaatgttgaaatcacagaaacgggcttttttaaaaaatcagccatgaggggaaaaaatgcatgttccaaaagtgttcttagtttattctaatttaatgtttttttctaaaggtccctaatgttgtttgccaaaaagagccatcacttcaaaaaatgttaacgttatattcagcaaaaagaagatagcaggtcataggtgattacaaacatcagaacactttgagggcattgagggtgtttgggcagggctgctcactggaatctgtcatctgctgcagccggaaatagtttctttttatttaggatgttcattttgctatttcttctttaagcaatgacttagaacacactcttgccaaaaaacgctaaggtaatctgaagattttcaaaacccagagtttccgtgaagaagaaaaagcttttaatagcatctattccaaattcctcccatgtaacggatgaagagactgagggtgagagagggtgagagatgtatcaaaggtcacacagcattttagtgatatatccctgggcctgccccaggctcttgcgctatcacgagaggcattgttttcagaaacaccagacatccccatctctgagagagcaggtattaacaggaagctctgggacttggtatattaacaattactaacatcttagagcacttagcgctttgtaaaatgtggatactttcactattaaaatggttcaaattttaaagtttcacaacttaaccttcaattatttaaaaaactatactaattgtattagtccattttcatgctgctaatgaagacataccagagatagggtaatttataaagaaaaaggtttaatggactcacagttccacatggcttgggaggcctcacaatcatggtggaagacaaaaggcacatcttacatggcagcaggcaagagagagagaaccaagtgaaaaggggaaaccccttataaaatcatcagatctcatgagacttattcactatcactagaatagtctggggggaaccacccccatgaatatctcccatcaggtctctcccacaacacgtgggaattatgggagctataattcaagatgggatttgagtggggcacagccaaaccatatcactaatccaaacattatttcatcaaagaaatgaaatgttacatgttcctacacacagaaacaaatttgtatggatacctgtaaataaatccattatttgtgtaagataaatgcatatgtatgtaaacatatatgtatgcgagcatacacgcagtgtaactggtgctagatttagttgaataattaattattcatatgtacatacagctggttgaagggaagaataatgttccaacatctgtgtattgcagatgatctagcatgcacaacagctactttatttcaaaataatcccagtaatagtttcaactcattgagttctatttgttgtcgaggttgtgctggaaacctaaaatgatcatgcttgtcaaatcgtttatggtaatgacttatgtaacttatttatggaatcataattgtcgttttcaccaaccatgtctgaaagtgggggataaatttcttattatttctaggaatttttctaaaccttccctatgatacgttaagggatgggtctacctatctgaaaggatattccctctctgaggtgtctggtggctgcataggagaataacaaagaaagtttctatagcttaaagagctctggagccacactgccagagtgcataagccataagcaccttgtagaatgtggggccattatacatacatacactctctctctctctctctctgtctctcactctctctcactctgtctctctctctctctctctctctctctctctctctctcacacacacacacacacacacacacagtcatccctcagtatctgtgagggactggttccaggaccacccccccaactcagacagccaaatccatgagtgctcaaattcctcatataaaatggcatcgtatttgcatagatctgtgcacatcctcctgtatactttaacttatctgtagagtgtttctggtacctaatacaatgcaaatgctgtgtaagtagttgtttactgtttagggaataatgacaagaaaaaagtctgtacatgttcagaacggaagcagtcatgcctttatttttcaaatatttttgatctacagttggttgaatccacagatgtggaacccacagatagagatggctggctccatgcatgtgtgtgcctgagtgtgtgtgtgtgtttgtgtgcaagtgcatgtgtatggagagagaggtgcaatcatacaaaatatatagatgtaaccatgttataaagatgtaatcatacataatatatagatatatatctttatatgttgtatagatgtttattaagtaccagaattaagaagttcataaccggccagtcacagtggctcatgcctgtaatcccagcactttgggaagccaaggcaggaggatcacttgaggccaggagtttgagaccagcctaggcagcatagcaagcccgccatttctacaaaaaaaaaaaattaataaaataaattagccgggcgtggtggcactgcctgtagtcccagctactagggaggtggaggtgggaggattgcttgagcccaggcctaagctatcatcaagccactgcagtccagcctgggcaacagagttagaccctgtctcaaaaaaactaaaataaaaaagaaagaaaaagaagctcataattgttcatccttttgaagtagaattcttacaaaccattaataaaatatgatgctttattgttctgtaactcaaacctttgtttccttggcattaaacatttccagcaccgcagagaaattctgaacatacactttcgcatcatactccctgggtttaaatcccagtcactacttcctagctctgtgaccttggacacaagatttaaattaacctccttgaacctccatttccttttctgtaaaatggcaaaagtaagtcccttctctctagggcagatataagcatcaaattaaagaatatgtgtggaaatcttagtgcagtgcctggtgcataggatgccttcaattacgattaatgtttataattgtcaatgttccaaaaatccaagtggtaccattctgaactactccagggcctgtctcatggagttacagacctaaaataaagagtagctgctacgcagtgtacatctccattaatccatgcccacctctacagctctccacctcccaggcagtgcctggctctctggcgaactccagcatgcatttatatggacaactacaggcactcaggaaggagactgtgggaatcctacaagggacagttcacctgtacccagtcatactcccctggaagtcccaagcaaggagtcctttggattctccgaatctactgataactgataacgttccagtagttctgaatccatgtggttgtagtaaaaaataatgaagtgtatacgttgtgtagtacattgtaatatattgtgcatatactgacagaatttcgaaatcaagctggtcactgtggcagctagggtggttgctcatcctctcttttgacatcttggagaactaggctccatcatgtcagcaacagtgtggtttgcagctccgcccaacacctgtcatgttgctaggagatttctttccccacagtagagtattataaggtgcttggcatgagggcccctaatgtcatcatacatttccagtccatttgtctgatttagaagtccaaatagtcatttaaaaattccacatcaggctgtgtcaggcagctccactcttttgtcaactacaaatcaaaccattatgtttaaagtcataaatactgaaggattcctatgcacagcctcaaagcaggtgtccaacactcaccaatatcaagtcacacaggatatttataagcagcatagcctgaaaatgtgcccactccctgctttctgcagcagaatttagctttttgtataacatttcaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcaggtaaggatgatgactcagggccatgcagtgtctgtcatatttgtcaaaatcacatttaaataaaaatattcttacagagaataaaaattgattttttatcacccaaaataggactgtcttgtgtagaatgatatgaattaatcaaattgcatcagacagcccaattcaattcaacatatatttcttaagcacccactctgtggtgggccctgttaggtgatacagctatgaaggtgagtaatgcatgacccctgcccttgaggcacacgctgtatgcatgctgaatcatttgtgcaccccagagtttgaaataaaactattttgtcaacattatctccataataagtgcacagacacagtctttaagaaggcagtagatgcactgtttaggaaaacagatgacagagccagattgcctaagatcaaaccctgactccaccatttactgaccaggtgactttgtcctgtaaccttagctctgtgtctcagctttctcgctctttaaaatggggctaatattattcagccatagagctgttatggagattaagtgagttaaaatataaagtccttagaacagcgtctggcacatagtaagcattatgtaagtggttttcttaaagctattttagaaaatgttctgacattgtcaagttcattttgggagaaagagaaaaaagggaaacttggcttaacttcacaaaatcttatgtatcatttctagatttgttcagttgggaagctgaagcaggtctgcataggatatatgaacttaaatgcctttctctggaattcagatcttcagcctcattcactttacaccagaggagttaagttgcaagctgggtgtttatcacaatgtttagttgattcctgttaaccaccaaagtagagataaacagtgcctgtcttgttcactggcctttcttctgagtgcctgagcatattagctttcgataaatatttgttgaacaattgaatgaatgaagatgaatgtatgaacaaaccaaccagtcctatctgcacttgactttctggcaatgtctttagaaaaaataaaagattaatttctctgtcctccagatttctactacacacaaccacctggagatcaaagtcctctctttgtcctacttcctccccagttagatagaaagagcgagttgaggcatcaatattagatttatttttaaaaactgtttttaaccaatatacttaatagatccaaatgagtgcactagttttttaaaatactcactctgggaggcttccatgggcaattacttttttcagaaacatgagttccaagccatctaactatccacaggttttataaattattcctgaggatacatttttatttatttttgaaactgtcaaatgtaatttggagccaaatctgcccaacaaggtttgtgatcaatctcagactagtaccagttttgcttaaatattaagtctggcaatgaaaacatgggattgatttctccatgaaagtttttttttaactgacccaagtaaagctttttgtgtgaactctagacttctatgaacacttagtttagttattaaatgctattattactgttatgattatttaatatacagcttcccaagatgattcctttaatcctttatagtatttgctttgtactgtctagtgtagagtgtttagaacatggtgtttaaaaatcagtttctacagtgacaatgctttgtgagccagtgttaaataaatgtcaggaaatgttgcagttacttaaaacggcaaagcccagatgacttctctgggaaatttagttccaaatagttcaatctagttgaggaggtttgtgccaaagaaatcattccattcccgatactgtattgaccagatataggcatactgaccaataagcatgcagagctggagcagaaagtaagcatgatttggacaatgtgctggattagaagaacaaatgcaatgctacagatgacatcaatgtcaaagacctagaaatgctgagccaaggctgtaccctcacacgtcagtctcagaggcaggtgacagcccttacaaaggcaagagatggcctagcttcagaccagaacgtaaattcagcttggaagccttggactcaagctcccaagcaaaaatggctcttcctactgcatttttgttacttctaactgcaggtctccccagtctttagaatccaagaggctgaacaatatgttatccatctgtagctgttgagacagacgtacgcaatcacatttttaattcctcaaatagactcattcctctgtcactcaacctcttcaccatcagggatattaaggattgcagtgatgtgagtggggaaactgtcaaacaggaacgtgtctaaagtctagaggactctaggaaggtgctagactgtttagagccactccatccagtagaactttctgcagtgatggaaacatttcatatctggatggtccaaacagcggccacatgtggctgttgagcacttactgtggctagcgtgaatgaggagctgaacttttaatttcatttaattttaagtaatttaagtttaaatagtctcgtgtggccaggagttatcatcctgcacagaacattgcaggactggaggattctggctatttcagagccatgaactagagtccccagaggtgtgggtgaagtggctggcagcagaaccccaagtagtgaaagaccacacatcagagcagcttctggatttaattcagatgcctgcccagagctgtgtcccacatttcctcccttcttaagtcgtcccagaccaaccctccaggcaagctacctggctcgcagggcgtggtttaatgttctcctgccccctctctcttccccagaacagcatgccgttcaggagttgaccaaagccgccacgagtggcgtgggcattgacggagaagtgctctcttacttggaattggctcaggtttgtaacagtttgctttttaccttttaagtgtgttcaatcagttcatttaatgctgataaaacattccattgttgcatctgtctaaatgaagatgtcaccactgagtcacagagtccccctgtgtacactaagaagatctgagagttttaccttttatgtaccattcagcctgctgggcttcatttgaataaacaaaacggtccccacccccatgccagtcccattgtcccctaaggcaccagcttcatatgtaggaaaatcacttgggggaggttttgtctctcctccttctttgaattcttggacatgtatttggccaagaagagacagtttctagaattccatgaagccccgtagtgcctcccctgttaatgaacatctcattgcagctgttctggagttttctaaagtcagaagttgctaatattgagattgtaataacataatcccaatacagacttgccctcttcttccagagaaggtccaagattcagctttagcttcaccatggagtaacttccccaaagcacaagctaaactctgcctcactttcctcatccacaggaaatgggatgacagtttgcatcctaccaaccttacagattattctgagaatgaagtgggagagaatgttcaagagcgagcactgaagagtgtaagccctcttacaatgccaggcacatctgcagaattatctagtccctggcacaggctgattaacaatgaatttacactctgaggaaactaagaataaattcctcagtcttttcttcggcctgttgggtttggcttcctgtgctccctctttctgttaagacaatgacttactaagtcttaggtcagtccatttaaatcaatatttctcaatcaaaggaaaggaggtggtttcagggagaggaggtggcatccagcaggtgctgctcaggcccttcctactgtggccagaggagattgctctggtgcaaaagggggaaaaggcggaattgaactttacagcgacctattcattatgacttagcattcaacaagtatttgttatttttctccccaaataccaggcaccgccctaggcaaaggccgtgtacatataaatggtagatcctctgccccagggcaatcataggcaagtaagggaaacagacacaaacacaaattattaaaatccaattagggattacagtgaaactgagaatagacatctaatgcagtcgaatcagcaagcccccatcaaaactggttgttcacacttggaatttggggtcttttgaaacagttccaggggatggtttataacctgtactctctccagcaagtattcctcctagagaaaaatgtaatgatccagaatttcatattgggaccattcacttgagggaatgatttgcagttgtgtctgtttgttgcactgtgttcccaccttacccccatacacacccactacaaggaaataatatgattattgctaagccctgacaagccttggcaggaagagcttaggatggattctcccatgctcattcattagaccctaacctagtgatgtgctggtaagtgtttaacagtcagcttgagggcaagtgggaccccaatctgttgcgtttgccaatttctatgatataaatactcccatcatggctgatgataacatatgaagtcactaaactcaaagtagggaagaaatgcacacaattggttctctcaagctggaacaaacccacctggcagaacactgccccagccttgttttcagagagaaatctaacagcaagagaagttggaagcaccagctaaaactgtctctgatgtttgggttgtgattttcagtgagtctcttgagtgggtttctgaggtctctggcttttctattggcctcacagtggagatatggggccacagaggaagcatgctgtaggttctagggatccacctgaccaaagaaacatcaagagcgacagacaacagaagggaagtcagagaagggcacagacagaaagtgagggatcgcagcaggcccaccaggtctggggagggaatgggggagtagatagttgatttttgaggatctagtcttttttaatcatagccacctcagctgccaccttcctgagcattgcttagaatggaagggtggagtatctggatctctccaccctgcccataccgcctgctcttcttatgtaaccaaaggagaggtataggacagtcacacattctgcagtctcctctttcggatcttggccccagcaagctgagctctgacatgcgacacgaagtattccattgcggaggcttccttaaacagagatgacatcgctgctttctgctgtgggctggtgccttccagaggccacggttgtttagcactagagggccaggtggcaggggagggcgggagggcgaggcatactttaagctcgtgattcgatattaattatttttgtgcacctatgacagcagggaaaggaggggtgtgcccagcactacattggctggcattggagccatggccaaagtcaaaacattgaggtcaaaacaagaggtttaccgaattagttatataagcccttcatttcttttcacccttaaaatggcttccccaatttctttgtagcccctctttagaaaatagtcttaccctccttttgctcacttttctgcagtttcacaatgcccaccagttggccgcctggtgtttgcaccacatctgcaccaactacaacagtgtatgctccaagttccgtaaggaaatcaaatcaaaatctgcaggtgagactgtgtgaggcccccattcatccagctctcctcacctctcatggaagcttttatcttctatgtccctggaaaggaacatggtcagcaggcagctcatggatgattcctcgagactggctggtggtcacatattaatgtgagatgacataaggaattgaaggctgggaattgtctttggagaacttgatgatgaggggagttgggtgggctagagtccagggtgccctgttgcagagagtgcagaggtggtggccttccccttgtttagggagacaagcttaggagcaggcttagactctgaaatcaggtggtcctgggttcaggttctctgtgcccagctgcatgactacaggtaagagattcttcctctcagaacgttagtgtcaccttttgcaaatggccctaatcacagtctctgccgcatcacgtttttgagaggatatttgagaagctttaagctcaaggcctagcacataaaaggcatcaatgaaccgcaggtcttatggtctgcatctttccttcaccagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctat

SEQ ID NO: 37758 - DNA, 73564 bp, Homo sapiens; identical to SEQ ID NO: 36739

SEQ ID NO: 37759 - DNA, 340499 bp, Homo sapiens
ggcggcgacggaggagcggctatgagaagggaacggggccagactcagcccgacagcgggattagaggtgtgaggagggggcgggagtggacgagcggcggggccggggctcggggtccgggctggggtcttctggtatcgcctgggtgacagggaccgcggacgagccaccgcctgtctccgctggggggcaggggtctgggctccgtgcgtgaggagactgggctccggcggactgtttccctgaggatgggggagggaggcaccgcaccctgcacagtccacttgccccgctggtcattgcttcacccccaggcaggagtttccatttccctccggttggcagcgaaggagcccaagtggcctggagccgggacattgccctctctctgcctggagatttccctccactcctcgttccccatccatttcctccctccgactgaaaaatagcattcctcctggctccctaatttgttccaagcacatattgtcggacttgaggctattaattatcgactgaaaaacaaagtttattaaaaaatactccacttctccctctttctggcggtggacattaaacagcatccctagactttcccgctctgctcgcccttcagtgatgctaacagggggaggtagggccccgagttaccgtctctctggattgttgttggtgctgactacctgatgtgtcgctccacgtcttcggtgtgaattgtaatttcttccttggtgtcttgcatccttgatgttactggcttttgaggtcagtgttttgtttcattgtttaaaagacatgcagagaactgggatggtcttttgcagcgttatttaacatgggtggttagtcatttctcatgattctctcctcatattctttctctttttgtctttgttttgcttttcagccctccagaatacccatcatatagcccctgaggtggcatggtgatgtctccatgagggaaccccttcccactcatcctgtcacgtatatcatagtgttcttgactgggccattcatctaagatgggatttaccctgtgaaacagggagaagacttatggaccccaagcatcatttcgagttgtagttgagtttttaaaagacatacatgcaaagttcctttgctttggaccctctgcattattaaagctgctgtattgctaacccagaactgctccagtgtcttgactgatcatcatggcttcagtttggaagagactgcagcgtgtgggaaaacatgcatccaagttccagtttgtggcctcctaccaggagctcatggttgagtgtacgaagaaatggtaagatgtacctggaggtagattttgctgtgctgtggcctaagcatactgtggcctaaactctgggtcttctgatagtatatttacctttctatagtgcactagtgtgtagaagctgggtggggcgcagataactctaacaagtactgtgctgtgcactgttgctgctagtaccatccctgtggattttaattactgcgcttcagtatggctcagaggactgtaactgtgagagcacactaaatacaatagatttggttttgaggttattcatcattagtgttaaaataactttgatttttgtaattttaaggagacaaagaatggctactgaaatattgtgagcattaatccgtatattttaatataacaggcatatgatttaatagagttttaatatagaagtctatattcttgtggggtgatggtaatctattttatttttgttttttcatttttccttgcttaggataaagaatttttcattatttgattaatggaatgccatccacaaaaccttagaaattcttttgttaaatgcttactcaggcaactgtattttattttaattgcctaatgggatacatttcttggccagatttaaggaagcaattagtagtgctggtctgtgattggcttttttccacttgagaagagtaaatatagggctttctttccattgccctgaatgataaacaacaaaaattttttatttagtgagagaaaaaagttaattttaagcaaatggtcgtttgggtcttgatttactgcagtgattaagcagtaatggacttattgcaaaataagtccatttctttgtccagaaggactgtaattcaggtctgtaataatttttctttttaacatccattttattagattaaaaaaatagcttgctttattctagaactcttatatttgaatatttatttggaactagtttctgaatgcttttctcttcaacttattaggaatattattttaaaatcagtttgagaaatgcatgcactcattacctactttataccaggtactgtggatttagagtagaatacaacataatccctgtcctcaaggagtgtgcagtccagtataaggagagtcacatgaataaattcaccgtgagagatgcaataatataaatatgtatgacataaggattttaatctgtctcgatacagttgagtatctttgaggacgggttatttaacttctccgtgattcaagtttccatatccataaaggtcataatggtgccacttcatggggagggtaattgtgaagattaaatgagttaatacatttaaaatgcttggaacagtgtcagggacatagtgcctaatagatgccattattatgtacagaggtcgcagagggaaaaacaattctttaagggtagaggatgagttgttgggatggcttcctgggatctgagctgggttttgaaagattcatagttgttgtccaggaagccaagggagaagacgtaaaagacattctagactgaagcaacaacctatgcagaaacatgggaggcttacctagcatgggatgtgctggaaattcaagtagtatagtttgatattaatggggtttaaagtgtaggattggggggcatgcagtgagatatgaggtttgagagtcaggcaggactgaaagcatgttaagttatgtgctgttaataaatgatttggggattattctgtaggtgataggaacatagtaaaagattatgagcagaagagacattaggtttgctattggaaaatcaccaggacaacagtgtagactgaggatcatagtaaaaaggtgactggaagcagcaatattagggtagctgttttaataaataaggggagacaaaaggttaggactaggcagtggcaaagggaatggagagaattaactggaggaacactcagaacacaaaatgggtaggatttggtggtcatttcagttggggatctgagcaagatggggatgagggagaagaaaagggctagattgacatccaagcttttgtgttggaaatttggatgtatttgaccaagctggagaaggtcgtgattataggtgtttcttaacttggcagtatactgggagcatcaacgttaagatggttaaattttaatctttttcttaagggaaatagaacattatcaggtgattcctcagttagaaaatcagtttcttcctcacagtttgcagccttcctggaattttatttccctagagcttttaagttattaatttttaaataacaatttaagttattgctaatgtgtctaaaggtaaaagctacagcgaaaatttagcttgattgcagttgaataaatggcttgattacttttagggatggccattatggtgtccctattaaatcaggtcttatgataggatctggacttaataccagaaggatttggatgttctcctagaagtattgggggtacttaatacttagtacccccaatacttcttgtattgtctagtggttctagaacttacatctagaacttaataccagaattatttataccagttctagaaccactagaacttagatcaggaacaaaaacgagaatgtctttttttcatttgagagagggacagtataccagggagggcctattcatcatcattccttgattgccacatgaaggggctttagcaaatttggagatgataggggtttataccccctactcttcttgttgtccttatgtcatttaattattaaatgatgtagctgttggcaagtagtaagactggcctctggagatgagtttgaaagagactgtactgtcatttctcagtttactttctgttctgttcttttatcatctgtaggcttttagatttctgagagaaatctttactatatgagttctcaaaggctttacaggtgtttaagtaaactgtatgaaagttggcaagttggggttatgatgataatttaactatgttgcaaattaaattctggtaaaagctctctaatatatgacatgaatcattatgtatgaatacgtattatattttgtatgtatatatatgaacatattttatatttgtatttatatttcttccatctaattcttagttgtggtgggaggactaaaaatattcagagtgctgtaaacttttcccaaaaagtcatgtatttattttagtttcttatttttctatgtcatataagaattccttttccttattttaaaatataattttaattataatttatatattaaataggcagtacaatcacatggttcaaaactctagaggtacaaaaaggtgaagatacatccctgaaagtaactcttctttttgttcattatttcacacatctttgccaaccttgtgaccccaggatttgaaaggtaaaaaaaaagtagtttttcttagtgtttaagtttgtgacattgacctgttagataaaatataaactctttaatctgatgttccaggctatgtgtaactgatcccagcttagtcttccaattagacattaagaagactacatgcactttcagtgttaagttgaatttatgaagaccaaattacattaagaagtattaatttcagatccacttctttgggtggcttaagcaagcatttctctgttgaccatggagtgatatagagatacatgagccttgatgtaaataacctacttttgaaataaattttacaaagaacagaaaaaagcattaattagaaacaaacttggtgtgttttgtgggatatggactgtcatgagtaaaagtggaagcagggataccagctaataggctgttgcagtaattcaaacagcagagtagtaggtggtgagaaatggtcagacatatgtaacacacacataccctcacacacactcagcaccaccacactttattgaggtataatttacacttgcatatagtaaaatgcatccattttaagtgtacagttcagtgagttttgacaattttatgtacccatgtagctggataataaatttttttaaagatatagttagcaggacttactgatggattagatatgatgtaaagtaagagacaatcaataatgactataggtttttggcctgagcaaccaggtgaatgtaatattaattgaagggataggggaacacttggggaggaaaaggtttggtgtgagggagaaatcaagaattctgtttgcttttcgtttgggacatccagatggagatcttagttaagcagttaattataaaagtctcaaactcagaggctggatcatcttagtatgtaagtagtagttataatcatggggcgatagaaaatttcctatgcattaatacagattgagaagaggattgaagactgagccttgaggcacttcagcatatagaggtgaggaaggagaggaggagccaacaaaggagacaggaaacaagcagtagtgagataggaaaattgggagagcgtgttttctaagaaaccaactgcaaaaagtgtattaagggagtatttggctgtgtcaaatactgttgagaggttgagcaaggtgaccgttggatttggcaagatggaaagaactaatgattttgaggaatggttcaatggagtggtggagatgaagacttgattaagttggcttagaggaaaggaagtgattacagtgagtatgatgatttttttggagtattttgctacaaagcagagaactaggtaatacttggagagagacaagggttcaaggtacattttttgcttggcagatattgcaacatgtgtaaatgctggtggaaatgattggtagagaaggaaaaatggatgatgtggtgggagaggaggtaaccttaggacagaaaagtctttgagtgagagaaagagaaaaggatccagaacacaagtggaaacgttgaacttaggtagaagcagggaccattcattgttacaaggggagaagcagggtacatgggtagagaagcagataggttggtagatttggttgggaaggatgtggacattctgttttctcagggaaatgatataagaaatcatctgctgggagggaggtgacagttgttgaagaactgaggagatgaggtatgaagttgtcaaagtgagaatgaattgactagggaaatgtagggggattgctgggtagtagtgatgaccttcttaactttgtgattataaattttaagtgaatgcaaccagcaagtttgcatattttaatccaactgtgttcagtgctttggtgcaggcatggaatagatagagttggatttgaccaggattggattttgtcaggaatgtataactgaggggaagagagacagggaaattgagagcaaatgtgcaggagtggttttagtgatgaaccatggaatataagctggaaaaggagaaggtaagtacgtgaaagatgggatagtcagtgaaagcatgaaaaggataatgattgaaagattttaaagaggttgaagaattgttggggttgggagctggaaagatgggaggtggaagagtgtgagatgcttgattttgaggatgtggttaatgttaatgacaagatactggtggtgtccttggatcacatgtgcatatctgtttacaaaaatgagcacatatcccaatatatttttaatatactgcatacatgaaatatgagtatactttaatttcctttaataaaataaatacctttaaaataaataaatttaagtagaatttcttgctgtgtttgagtagataatcttttgcaccttccaggtattcctattccttgttagagactatagctattagtatataaccatgagagttggtggctgaggtgaaatggagtaaaagattttttgggtatgaagagggtggtcaaggaatttagaggccaatgtgtggacagattatttgtgtggctcttgaagttgccaagaataatgggaggagaaacatttaagacagggagtcaggtgctaaactctttttttttttttttttgagacagagtcacactctgttgcccagggtggagtgcagtggctcattgcaacctctgcctcctgggttcaagtgattctcatgcctcagcctcctaagtagctgggattaccggcatgtaccaccatgtctggctagtttttttgtatttttagtagagacagggttttgctatgttggccaggctggtctcgaactcctgtcctcaaatgatctgcccacctcagcctcccaaagtactgggattacaggtctgagccacggcacctggcctggtgctaaaatctttaatgtatgaggggagagatggggcagaaggttagatgactgcaaaaggaagaggcaaggtaagaaaggtattgttccctagtttctaggcttgcttctagagaggttagtttgcagtactttctatgttgcaagttatgtgaatcttgaacatcttattccttgaaacaaaatagcgcagtcttttctatattgtaagttgtcaaaggcatatgattttagcaaatgctaaattgatgttacttgtttgtaatttcatgatagtatcttataaactgattttttttaaattgtaattgttacatattgtgttttttccagattttaagtctttattctatgtgaagaacagttttacaaaattcaattgtggtgggttctttaaggaatatagtggagccacttaatgccataattggatattgatgtgcttacatcatgattatgtctacacatgactcaaaatatgcctctagatcaagagttggcaggcaaactctggcctgatccaaactggctcttttgttctctaaaaaaatagagaacaaatttttttctgtaaatattcacactttgggaggggctgaggtggcaggatcccatgaactcaggagttcagtagttcaagaccagcctgggtaacatggtgagaccctatctcttaaaaagaaaaaaagaaagaaagaaaaagtttgctgacttctgctttaagtcgtgggagttacttgcagctagtgtttagggaatacagagtctagcacctttctgtgttctctgtgctcaggctctaaactattagtttagtcttattccactcaaactacataagtaacagagaagagaccattgtgccagttttccagccttatagaaagaaactttagaacagcttctgaaaacattgaggtctgtgtctgtgtaaaatacatattttctggctgtgtgaccttggatgaattatctcttggtacttcttcagtagtggagatgataataacactacttccagcatagagttgttttgaagattaagtaagataatacctgtaataaaggggttagaacagtgtctgacagagtaagcacccagaaaattttacccattgttgttattattttttatctgataaataagcaatgagtgatgaagagaactatctagagagaaaggttagagtaggtgggaagaagactgtaaatataacctgaacttttaagagtgttagagaaagatgaactagcataggttggagtgaccagggaggtaggagtaaccagggaatgtgcctgcagaagtacagtgctgaaatgagctaagttttgacaatactttgacttttggggagaggaactacatatttttgcttctgaagcaaaatcaattcctatggttttataactttatttcctttttataataatttcaagcaaatgttgggctaagaaaactaacttaatttctccaaagtagaattaatttgccagcatttgtgtatgcatgtctgtgtgttcgtatgtgtcctgtagcgatgttttatgatatttatgatgtatttcttttctttttttcttttgagacagagtcttgctctgtcacccaggctggagtgcagtggcacaatcttggctcactgcagcctccacctcccgggttcaagcaattcttctgcctcggcctcccgagtagctgggactataggtgcatgccaccatgcccagctaattttttgtatttttaacagggatggggtttcaccgtgttagccaggatggtctcgatctcctgacctcgtgatccgcctgcttcggcctcccaaagtgctgggattacagatgtgagccaccgtgcccagccgagtcaccgtgccaagccattttatgatgtatttcttttcttttttttttttggtattttaaaaatatattatttctgaattttaaagagtcatatggctacccagaataaagattatattttccagatttccttgcacttggtgtggccatgtgattaaattctagtcaatgtaatatgaggggaattgatgtgtacaacttccaattagagtctttgaaaggaatggacctgacttcctcttatcttgacccattcttgataactgaggtatggacccagaaggaatgacgattttcaactatgtgaatgagatcaacaactgggggatgatgggtaacaagactgaagaaagtcagggtcccaatatcatcaggttgcttccagccatactacttctgagctgcctacttagactttttttgagagaaacgttttctatcttattcagctactgtatctttggatgtctttgctacaacaaactaatctttaccctagctaatacatgttatgcttaattaaccctattatcgctaagataacgtcaaaatttcacatcttggagtaagagaacatcttgctctacaccctattttatcactctagcttctcctcattctcttactcctactctttcattctgaattaccctgaattcatcataaatgcatggtttctttcagatcttgacctttcaatgtcccacccatttcttgccccacccattcctatctcctctacttccagaattttctgccccgcaaccccccaccacgccccaacccgggaacttcccaggcttcttcccaaagcatttctgagaggaggtgttactgattttggacaattctaaggcttcaatccccttttcctatgcaactcccccacccaacagaatccatgactccctgctaatcttaggacctatgaagcaggcaaagtctattttgtagattctaagagctggataattttttaaggtgtagagaagcatcttttgctagaggttcttctttgtgtcttttatggtcatcttcattccaaagctgtgctactgagtccacattcctttgagggcagattggctttccaaatagattggtatcatgtgaactgtttttttctcagtgaataatggcaatacacatgtgtctcaagcaggtacttagtttgcaaagaaaaataaattcatttatactttaccatcatcttcagctataaagtgtattgtcaataaatttcattgccacggagttgatgcagttgtcttccattggttcagcagccatctttattcctgcgacaaatagtctcttgtgagaggaagcaatctggaaggtctgaggtccctttcctcttcccgaggccctttgctcccctggcaactgcctgaatagtcagcaaggagttgtttcccagtgctttttgcattcctggctgccaactctggctgctaaagtgtctgccacctgctacaatttatgatgtttctctacgtgatgactgttcatttcttttttcattatcttttgtagcaacaggggtctcactgtgttgtccaggctggtcttgaacttctggcctcaagcgaccctctgccttggcccctcaaaagtgctgggattacaggtgtaaggaccatgcccagggccagtttttacttaaaaatttttttcctgtcatgattttaaagaaatgaacctaggatcttttcgtagtgtgtaattttcatacattattttgttatcaaatcttgatttacatactttaaaagttgatttctaaaatgaaattttaagggattatgtgaggaggttctgttcttatgatttagtttagtttcaaatgagttttgcaattaaaatgcccagggaacttaaaattaggcatttctagaaatgtgctattgatgcatcaaatgtgtttgttctgattttttaggaaatttcaacaaaagagccactgaacttgttcactgcatgatataaaaatagttcaggaaaaattgcacaaagcattttgaatactcaatagggatgttcatattctacattaggacttttgcacatttgttaaaaggagtggaactgagtttgaaacagaggcagtgaaattactgcaggatgtaattgtacctggtatttgtcttatgtatcactgttatagtgatattttttggcagctttgctaaaaggtacctgctgattttctttagtaagtttggtttattaaaacattttctggttttattaatccgggtattgttatttcgaaaatagttttaataaagttttttttttaaaaaaaacctataaaatttaactttaattataacaaacactttaaaatttgataacctgcctatgtctgaaagagtttgtcagcctaagaatttaaaataataccatgttgactaatttagggatataaatagaatgatggtcttacaggagcagagagagcacgtattactaggcacttgagaggagttagtttgctgctattggagactggattttgttctgagtttattggcggccaaggcaaaaagggatgcacattggctctttaatagtcctcctggctaaagaaagtatataaatttgtttgcagacttttcttagaccttaatccaaagaggatttttattatgaaaataaaatatgacattagataaaatctccaactacaaaagactcagaaccactgttaaataagataatgtttatgttgaccattcatgaagactttttatgagagaatatggctgagaaacctagttttctgatcatgtaatttaaaccaagagtaccacttgggaaatttagaagaatggaaattttacataaatcatttagttttgtgctgtctagtacagagggaactaactatatgtgctatttacatctaaatttaaatcaatttaaattaaatgtaaaattcagttcttcagttacagtagccacatttcaaatgctcactagccacatgtggctagcggccaccatcttggatagtgcaaatatggaacatgttcatcaccacaaaaagttttacaggacagtgctgatttagccagtgcttcccaaactgactatctttagaattgctggggtgctttgcaaatatggagatttccatatcccctaggaggtcctgattctgtaggtctgtgatagtgatggcaaatctgtcattttagaagttacgcaattgctgaagagtatcaaattaggtcttagaactaccatatttgattctttcttaagaatccatctgaaacaaagctttagcaggtgctggatgacagttctattggtactccagaaagtgtttattgacttgaaattttgagttgaattttcttacagtggttcagctgttttgtgattttctttctgattaaaagtgagagcaatgtgttttagctgtgccattttagctgccaaaattaacaaatatttaaacaggttcattggttcatttaaagacaagactggtttgttctcttccatataagcaaagagtgttgagagatagctattctgaatgttgaggtagaatttttttttttttttttttgagctagggtctcactcccatcactcaggctggagtgtagtggtgcagtctcggttcctgggctcaagtgatgtccctcatctcagcctcctgagtagctggtactacagatgtgtgtcaccacgcccggctaattttttgtattttttgtagaggcaaagttttgccatgttgcccaggctggtcttgaacacgggtctgaagtgatccacctgctttggcctcccaaagtgctaggattgcaggcatgagccactgtgccgaccagaataattttttttttaagaaaagttttgaaacttcttaagtacttgcattataattgtacttctagacaacatcactagtagatctgctcatttttttttctctgaagcatgtcttaattctcacgttgatttttctattccattgccttgtttccatcctttgctgtcttttgccaagggccatgattcacaaactgtgccaaggagcccaggggcactgcagagaactcacaagggagcaagagatgtttaacaattttgaaggaaacgtagcagcatctgttggaaaccacacaaagtatagttggtcctctctgtatctatgggttctgcatctatggattcaaccaactgtggattgaaaatatttgaaaaacaaaattgtatcaaacatgtacagatttgttttggtcattattctctaaaaaatacagtataaaacaatatttacatagcatttacattgtattagatattataagtaatttagagatgactttaaagtatacaggaggatgtccataggttatatgcaaatactatgccattttatgtcagggacttgagcatcctcagattttggtatcctcaggaggtcctggaaccaatcctccactgatactaatggaagactgtactagcttgaggtagttcagtttcaaaattagattgctactttcttttcaatgataccacatttttgcaaagctggggttttggcagttgctatgacaaaaagcagacatcacatgaaaatctgtgtggtacaggaaactagggaggcagtgtccaatctaattctcaagtttgagaattagattgtcaagtgtctaaaacaggtgctaagtttttaggacatacatccttcttaagttgtttggacctgactacttaataaacaaaatggttaggtatttcttttggcttgggggtgagggagtctgaaaaaaattacacattaagggccttgtaaacccagaaagtttgggaacctctagtgtaggcttttgtgatggcacttaatgctttcctggcccctctggtctcccctttgcctatattactgccatagttgtccttctaaaattagccttcctttaaatatgtccttattctgttttactagtcttcttccaaccatttcccttaagattctgaaatcttgtttttactacatgcaaatagtttctctcaaattttatcttttattcttctctttccctctccaaaatcattaaatgcagaaagctgtatagtaaaaccctgtctcaaagtaacttaattgaaactggatttattcatgcaataagtgggtctagatatcaagtttaatggttcagctttaatttgaagagtactctaatttgcaaaattacttttaaaaattggttaattcatttattttgaaactttttatggaattaattttaggcttacagaagagttgcaaagatagtacagagcaggggtgtccaatcttttggtttccctgggtcacactggaagaagaattgtcttgggccatgtaaaatacactaacactaatgacagttgatgagctttaaaaaaaactccctgcataaatctcataatgctttaagaaagtttgtgattttgtgttgggccgcagtttggacaagcttgatatagagagttcttacatatcacatcacccagctttttttgggtaaaatttgaataaataaatttaccattgtcatttatcaaaactaagattaatattattaggcaagctacaggactttattagattttaccagttttctcactaatatcctttttctgtccaaggatgtagtccaggttaccacattgcatttagttgtcatatctcctctaatctgtaatagtttttagtctttttttgtttttgtttttcatgaccttgttaggtttgccaagtgctggttaggttattttgtagaatgtccctcaaattgggtttgtttgatgtttttttagtcattagactgaggtgatggaattttgataagataccacagaggtaaagtgcctctagcccctgtcacataatatgatataccacatgatatcaacgtgacttatcactggtaatattcaccttgatcacttagtctatggagtttctccactgtaaagttactattttaccctttcatattttatgcattagaaaccagtttctaaatctaatttctcagggaggagaattaagtttcatctcctggaaggagaagtatcaaagaatttgaacatatgttacaactaccacagaactaataaatactggggggaagatgctttgaagttatgtaagtgtcctatttttctttaaagttttggtcaccaatttaaaaattcatcagtagattttgcttgtagcgatcactactgtgtcctaatgataattttctgtttcctttattccttctacatttatttttggaattttcctgtaagcaagatttgtcctttattcctcatttatttattcagttatttattcatatcagtgtgtacttaatggttatttataaaataaccttttgatatcattactgccttttgtacagaggttctgacaaggaggtacattgttttttaaaaataaccctatttttaaaaagaacctttattttgaaataatttcagacttatagaaaagttgcaaacacaatacaaataattcacatatacatttcccctcaattccccaagtggcaacattttaccatatttgctttatcaatctctcttaagctattttgtatgtaatttttttcttaacatttaagagtaagttgtaccatagtgcccccttacccataaacactagagtatgtatttcttaaaaataggaattttgtttttttttttgagacagagtctcactctattgcccatgctggagtgcagtggcgtgtgatcttggctcactgcaacctctgcctcctgggttcaggcgattctcctgcctcggcctcccgagtagctggaactataggtgcataccaccacaccaggctaattttttgtatttttagtagagatggggttttactgtgttagccaggttggtctcgatctcgtgatccacctgccttggcctcccaaaatggtgggattacaggcatgagccaccatgccctgccaaaaatagggatttttttttttttaaacataaccacagtttaatttgtcaaaatcaggaaatttacatttgtatgtaatgttattacttaatctataagcctaattcagatttctccaattatcccaagaattccattgataccaaaagaagaattttttcctccctagaccaggatctaatccaggaccatatgttacatttagttgtcacacctctttaatctcctttaatctggtagaattcctcagtctttgttttgacacttgacacttcttaagtgtcaattcaccttgacacttttgaagagtgttcctcaatttgtgtttgtctgatatttactcatgattaggttcaggttattaatactttgcagtaataccaaagtgaagctgtgtattctctgcatcaggagtcacatgatattgattgtgctgtggttcaagagagctgttgttatgatttcagttcttttgctccttggctgaggtattttatgtccaattatgtggttgattttagagtatgtgccaagtggagatgagaagaatgtatattctgttgtttttggatggagagttctgtagatgtctatgaggtccatttgatccagtgctgggttcaggtcctcaatatctttgttcaaagtttctgccttagtgatctaatactgtcagtgaggtgttgaagtcttccacaagtctctttgaaggtctcgaagaaattgctttatgaattggggtgctcctgtcttggatgcacacatatttaggataatcaggtcttcttgttgaaccctttaccattatgtaatgcccttctttgtcttttttaatctttgtgatttaaggtctattttgtctgaaattaggattgcaacttttgattttttttctgttttctattagccctgtaggtttttctccatccctttattttgagcctatgggtgtcattgcatgtgaggtgggtctcttgaagacagcataccaataagtcttggttctttatgcagctttccactctgtgccttttaattggggtgtttagcccatttacatttaaggttaatattgatatgtttggatttgatcctgtcatcgtgatgttagctggttattatgcagacttgtgtggttgctttatagtgtcactggcctgtgtacttaagtgtgtttttgtagtggctggaaacagtctttcctttccatatatagtgtttcctttaggagctcttgtaaggcagatctggtgataattaatttcctcagcatttccttatgtggaaaggattttatttctccttcgcttatgaagcttagtttggtgagacatgaaattctgggttggaatttcttttctttaagaatgttgaatataggctcccagtctcttctggcttttaaggtttcttctgctgagaggtccactgttagtctgatgggcttctctttgtagatgacctgacctttctctctagcattttttctttcatttcaaccttggggaatctgattattatgtgtcttgaggatgatcttcttgtgaagtatcttactagggttctctgcatttcctgaatttgaatgttggcctctctagctaggttggggaagttctcatggatggtatcctgaaatacgttttccgagttgcttacactctccccatctctttcagggataccagtgagtcatagatttggtctcttcacataatcccatatttctcagaggttttatttgttccttttcattcttttttgtctattcttgtctgactgtcttatttcagaaagcagtcttcaagctctgaaattctttcctccacttggtctgttctgctgttagttcttgtgattgcattatgaaattcttgtagtgtgtaaccaattctgtcagattggttacattcttttctatactggttattttgtcttgtcagctcctgcattgttttattgtgattcttagcttccttggattgggttttagtgtactgcgtctcagtgattcttgttcctgtccatatactgaattctatttctgtcacttcagccatctcggcttaattcagaaagcttgcaggggaggtgttgcagttgtttggaggaaggaaggcactttggctttttgaattgtcagagttcttttgttggtcctttttcatctttatgggctgatgtttcttcaatctttgaagttgctcacctttggatagtttttttttttttcttttatcctatttgatggcctagaggaggggttcccaacccctgggccatggactagtaccagtctatggcctgttgggaactgggctgcacagcaggaggtgagtagtgggcaggcaggcgagtgagcattactacctgaaatccgcctcctgtcagatcagtggtggcattagattctcacaggagcacaaatgctattgtgtactgctcatgcaagggatgtaacttgtatgctccttatgagaatctaatgccttctctcaacttgtgtagaaaaattgtcttccatgaaattggttcctggtgccataaagattggggactgctgacctagaggacttgattgtggtataaggtggattcagccaactgacttcatttctggaagattttagggggccagtgctcagctcccaactcctggactgtgtgctctaactctggaggacttttatcagccctgactttgttctctggctcctcggggataggaatccactgtgctgtggcggtgggggcgctccaaggtgctgggtggtgttggccaaagtgttttgtagtgtggtgacagtgatatccatcctcatttgcttgtgccttatttgcatgtgcctcatttgcatatgccagcagcagcggctgtggcagtgtggtggagtgtatgctcattggttgcggcagtgtgctagtgggtcccggggtgcctgcctccaagccagtgttcacctcagtggcagaggcaacccattcgtggggatgcgggggccccctgctggcaactgtgcatgccgtcatgctggtggtggtgttggcacaggggtggggcactggcaggcacaagtctgtgtgcactgtgtgcactgccatcaggggtggttactcagggcagcagggagtctgctgttttctgcctggtttcactcccacagcagtgttggtacaaaggcagggtgctggtgggggtggagttggatggctctgtgcctgccgaggctcccattgaaatatggttggtggaggatgggggatggactgcactttggaggcagcagtggctgggtagggtgcatgcacatgggcagctgatggagcaaggaagccaaaacttgcccatgcacacactgccagcaaagcgatgtggggggttgtcatgattggaggtggtgtgtgggagctacagtgtggggaggaagcaggtaggctggtgcgtggctatgagagctgccctgctggagctctccaccagtcaagcactgttgctagcataggagctaagttgtgggcccctagggcgctcaaggcttctgtgcaagcagaagtggccaggctaggacccagggagaggccagcagaccaagggacacaggggttgggctggccttgtctgatgggcaagactgccctgcagagttgaggtccaacagtacctctagggctaaaatctcctatgggagcaagtcaagcctagggggatgggcaaccctggctgtgccctattacagatgctccttcaccaaaccctctgagctccacatcagctggcttactgcccctaccacttctctaagcagctctccctgccaactcgagtgtccattgtggtggaggagtctcctcttgccaggattccagaggtcagtggtgagagtgggtgggtttctccttgccagttcaactcacccagtctcctggaatccttggaggcctggaatgattactggtgtgcggtaggtagccccgtgctgggtttccagcttcctccaccttcatcccagcttctgtgtcttccctctttctgctctcagtacttttcctctgaagatctgttaggcatgtgccagtcatttcaatcccttcgtggcatctgttctatctggctgctctagtcggccatcttgccctctctcttatcctattcctaatcaaactcttacccattagtgttagtattcagtatggttttgtttttattttttattttagacttgttaagtgcactattgagaaagggggaaagaatagaactaggagttcaatctgttactgactgtgaacaatcgattgagataactcactaccagcctggttttgttttttatttgaagcatagatagattcgtttgtatttatatttcacactataaaatcctcccatcctgttgaattaattaattaattaaatgttaatgttgttccccatgtgagaactattttttttttttcgagacggagtcttgctctgtcatccaggctggagtgcagtggtgcgatctcggctcactgcgacttccacctcccaggttcaagcaattctcctgcctcagcctcctgagtagctggaattacaggcacatgccaccacgcccgactaatttttgtatttttggtagacacgtggtttcaccatgttggtcaggctggtctcaaactcctgaccttgtgatccgcccgccttggcctcccaaagtgctgggattacaggcgtgagccactgcgcccggcctacaagaactatttttaaaattatgtcttccccatcctgattatcctattcccaactctgtcctttccaccttgttccacccaactcctgaatgtaaccagttttgttattctggatttcttcttcttcctttttttttttttaaacagatttattgaggtataactcatgtactaaacagtttgcccttttaaagtgtacaattcagtggtttttaatgtatttctagagttgtgcaaccatagtcactatctaattttggaacatttttgtgaaaaaatcccgtacctgttagcagtcactccgtattcctctggaactcccctccccactcaacccccaggtaaccactaatctaatttctgttctctctagatttgcctattccagatactatatggtcttttgtgactggcttctttcacttagcattatggtttcaaggttcatccatgtgtaacaaatgtcaatacttcattcctttttattgctgaataatctattatatggatatgttacattttacccattcatcagttgatgaacatttgggctgtttccacttttctgctattatgaataatgctgctatgaacatttgtgtcttgggtatgttacagatcacaggctctttggctccctgtataataaaaattaacatagggccaagtagatatcccagacaaggctgttattttggggcttgcacttgagcgcaagggagacagcagaggtgcaaggactctttagctgagtctgtgaaacagctggtagggaattttttgttagacaaagtgcacgattgacatcaggggtgagacatgcagactgggctgggaaaagcctgtgaagggtagggtatgagggtcagcatatctggttgtgatatttatcttaaatattggacaccctagtagtctggccagaggcaacaaggctataagttaattgttaagcattctttcctgaagtgggacactccacaacctcggtttgatatttagatttcctaaggccagttcctggaattctttaagtaaaaggcatggtttaaacattacgaagaaggagctgtgtcccattcctattctatctcaggtacatacctggaagtggaatgctggaccatgtaggaactaactttttgaagaactgtcaaactgtttaccaaagtggccgcatcatttcacattcccaccagcaatgtatgaaggttccagtttcttcatttcctcaccaacacatctgattgtcttttttattttagccatttaagtacatgtaaagtgttatatcattgtggtttttgacttgcgtttctctaattgctgaaccatgttgagccacaatattttcatatgcttatagaccatttacatgtcttttttggagaaatgtgtattgtaatcatttgcccatttttaattggatcgtttccttttagtgttgtaagaattctttatatattttggatataagacacttatcaggtatgtgatttgcaaatagtttctctcatgttgtaagctatttactttcttggtggtgtttttaaaaaagggcttaattttcataaaatgtagtgtgtctattaatacattaataatatgtctattttttattttgttacttgtacttttggtgttgtgccttcttagactttgcctaacccaaagtcacaaagatttactacttctattttttataagagttttataattttaactcttacatatagtaagagtaagtctataatctattttgagttaatttttgtgtatggtgtaaggaaggtgtctacttttattcttttgtatgtgagtatttacttctagcaccatttgtctagtctggttattttcttcctttgtttctttttgcatgaacgtgcagatatatgcacttctaaaaaatttatttattttacctgtgcagaagacgtaagacaatacaatcagtactttcactttactttttcacttaatatattctggaaatcattccatatcagttcatagagtttgtccttattctttttttttttcctcaacagctacaaagtactatctttgtgatacactatagtttatccaactattctcttatatgtggtcatttagattttgcacatataatattttataatataatataatatttataatataatataatatatataatatatataataataaatataatataatataataataaatatcatatttattatatataataaatataataataataatataatataataataataaatataataataaatatataatatataaatatataaaaatatatataaatatataaatatataataaatataataaaataaataaatataatatatataatatatattatatataatatataatataatataataaataaatataataataatatatataataataaatataataataaataaaataaaataaaataaaataatataatataatataatattttgcacctataatactttaatgaatagcctttatgtttgggagtaaagtcctagaaatggaattgctgtgtcaaaaggtaaacacatatgtggtcttgttagatattgccaaattcctctccataagggttttaccaatttaccttcccaccagaaatatatgagagtgcctgtttccccacagcctcgagtaccaaatttgttgtcctgaggtttttgccaaagtgagaggtgagaaatggtatcttggggtagttttaatatgtacagacatacctcagagatattgtgatcttagttccaaaccactgtaataaagcaaatattgctatagagagagtcacacaaattctttgttttcttagtgcatataaaagttgtgttatttattgactactgttctatctagtttttggtctttctcctttaactttaaaacaattaatagactttatggttttgagcagttatgaatttacagaaaaattaagtagagtacagacaattttcatatacccctcatctgcccctatttccccccacttattgatatcttacattaataatgacatgattccaccgttatagtatcatacagaatattttcatggctctgaaaatcctctgaaatctctccctcactccccctctccctcccactgaatttctggcaactactaatctttttactgtcaccatagttttgccttttccagaatgttatgttgttggaatcatacattaggtagactttttagattggcttctttcagtcatcaatatgcattgaagtttcctccatgtcttgtggcttgatagcttatttcttttccatgagtaaataatattccattgtctggatgtgccacagtttatccatttacctgttgaaggacatcttagttgcttctaagttttgacaattatgaataaagctgctctaaacatctttttctttttttttagagagagagagagagacagagacagagagagatagacaaagatacacaaagagagaaggacagagagagacagacagacagacagagatacacaaagacaagatacacaaagatacacaaagagagaaagaaagagagagacagacaaagagacagacagagaaagacagagatggacagagacagagagaaaaagaaagagagaaacagagagacggagagagagagacagacaggcagacaggcaggcagagaaagagtaagacagaagacagacacagtgagagagacaggtagagagagagacagagatagaaagacagagagaaagatacttgtggggagtttgattgatactgcattgagtctatagatcaaattgggaagaactgcatcttggtaatattgagtctttccatccatgtacagatatctctcaatttatttggatcttcttggatttttgtaatttttttcccatagatcttgtatatatttattggatttatacctaagtatttcatttttttggtgctaatataaatggtattcctgtttttaaattccaattccaattggtaaattccaattgttcattgctgatgtataaaaggaattgacttttatatattaaccttgtatcctgcaatcttgctatgattgcttatgtattttaggagttttgttgattttttgggactttctgcatagacaatcctatcacacgcaaacaaatacagttttatttcttcctttccaacctatataccttttctttttcttgtcttattgcattagctaggacttccagaatgatttgactaggagtggtgagagcagacatccttgccttattccttggcaggaaggcatctagtttttcactgttaagtataacgttatccttaggttttttggtagacgttctttatcaagttgaggaagttcccccttttttcctagttgtctgagagtttttatcatgaatggcattggattttgtcaaatactccatctaatgatataatcatatagcttttcttctttagcctgttgatatgatggattacaatgatttttataataattggtttttacagtaattggtttttaaatgtcgaaccaaccttgcatacatagaatccaatttgatcatgttgtataattctttttaaccattgttggatttgatttgctatgttgatctgactttctgactatataattttccttcttttgaataattttttacaaaacagttgtcataagggaagtctattggtgataaatttttttaacttttgtttgagaaagtctgtttctcacttaagaaggacagtttcactggatacagaattctaggttggtacatttccactcccattattattttatttcactctcttcctgcttacaagtgtggggaccccacacttttgtgagttttacctaatttacatgatatttgaaaagactgatgttattgttgctttataggtacggtgttttttcctctggcttctttcaatattttcctttgtgtttgattttctgtagtgtgactatgatatgcctacatgtagatttttttgtatctatcctgcttagtgttctctgagtttcctagatctgtggtttggtgtctattaatttttgggaattctcagacactgttgcactgttgcttcaaatatttcttctatgcctttctctttttctttttcttttggtattcccattatgtgtatttatgtctgatacggtttggatctgtgtccccacccaaatctcgtgttcagttgtaatccccaatttggaggtggggcctgataggaggtgattgaattgtggggacaatttctaatggtttagcaccatccctctagtgctgttctcgtgataagagttctcatgagatctagttgtttaaaatgtgtaacaccttcccttgctctctcttccttctcctctggccatgtaaaacgtgccagcttccccctcaccttttgccatgaattaaagtttcctgaggcctccccgaaagctgtcatgcttcctgtaaagcctgtggaaccatgcgccaattaaacctcttttctttataaattacccagtttcaaatatttatagcagtagggaacagactaattcaatactttttgtaattgtctcacagtttttggatattctgttctttttctttttttcccaattcttctatttccacttcagttttggaattttctactgacattttctcaagttaacttatttccttgactatcatcagtctgttgatgagcctatcaaaggcattcatcatttctattagtgtttttgatttcttgcgtttccttttgattttttaagagttttcatttctctgcttccagtaacacccttagcatatcaatcatagttgttctaaatttcagttctgatcatttcattatctctgctctgagtttgattatgatgcttgttctgtctcttaaaatgatttgtcttttgctctaccttgtaattttttgttgaaagctggaaatgatgtactgggtatgtgaaattgagataaaatagccctttttagtaaaaggttttctctttatctggataggagttgggctctgtttactgtttaccgcagctatagctataggtgtcagaggctaaaatattctctgtacctttttttgttttttaaatctcctctgttgtcttgtagtttctctagagatttcttcctaactgaggtctgagttggatagttctttcagttgtatttccctgttattatatgggagccctactgatatggtggtaaggtgtggaggaatgggaagtattctatagtcctataatcaggcttttagtgattgtgttttttggctttaccctccccagtgctcctcaattttttcccctttaggtgagaaaggaagtctagagggtactggagttggttatttcacttctctcagttcatttagtttctagtaaaatagtttctcttgagggtaggccttattaagaggcttgggaaagtatttcaaagtggctactttttctcttctttgccggagggcatttttatccagtctgcactgtgagagaacctggtagggctcctggaggtaaaactcacaaaaatgtgtggcctcccaagactgatcttcctgggagtttttaactctcagacttgtccacatccaacctctagtaattggtcaattacaatttaggctttcttactctggtactgtggagcatactggttcctggactgcttctcctgtaagttgtgattctctttgtctgcctttcactccagttttgggggtagtgatttgccctgtgacctcaattctctgaggaatctaagaagagttgattttcagtttgtttgtttttttatgttgtggggctatatagaagtgacagcttccaggctcctgacatgcttgactggaaagtagaagtctttttgtctttcctgtaccagtgtcttatattgcaaatagtttttcccattttcttaatgtataactttgtttatgttgtttttcagtatgcctttttttttgaatatagtttatcaatattacatcttgattttgagacatagtgaaagtatttctctatccaggcttatagaaattcactcatgttttcttctagtacttatatggtttccttttttaaaaaaaacattttaacatttccatcttggatccattttgagtttattcttatgtaaggtgtgtggcatgtgtcttttttttttttttgagatgtttcaaatatatatatataattcattgtagattgtttcacaagcatgtaagcaaccaaatcttttgattagtattagcatggtatatttgtctacatctacttacttttaatctatacttgtctttatatttaaagtaggtttcttatggaaaacatacaattgggtcttgttttttgaacctctgacaatcttttaattggtgcatttagaccactgacattcaaagtggttattggtgtagttaatgtctaccttatttgttactgttctctatttgttgcctttgttctttgtaccttttttccactctttttctgtcttttgtgtatgtgtgcgtgcatgtgtgtgttttaatagagacagggtctcgttatgttgccaaggctggtcttgaactcctgggtttaaacgatcctcccaccttggcttccaaaagtgctgcgcttacaggcgtgagccactgtgcatggcccttccatgggtttctgttttttttgagatggaggtctcactctgtcacccaggctggagtgcagtggcgcgatcacggcacactgcagcctcaaccacctgggctcaagcagtcgtcccacctcagcctctcaagtagctggaaccacaggcatgcaccaccatgcctggcttaaattatttgtagagacgagggctcactgtgttgctcaggctggcctcaaacccctgggatcaagtgatcctcctgcttccaccttctaaagtgctgggattacaggagtgaaccaccattcctggccccttttgtggttttaattgagcattttatatgattccattttctctcctttcttggcttatcagttatacttccatttttttttttaactttttttttgtggttgcgttagagtttacaatatacatttaaaactaatccaggtccactttcaagtaacactgtacctttctacaggttgtgtgagtattttataataacaaaataatcctaattcttctctcctgtcacttgtatcattgctgtcattcatttcacttatatataagcatatatgtatatatacacactatgtatattaacaaaggatatataatcaaatacattgttgctatttattattttaaataaactgttatctgttagatcaattaggtatgagacaaatacaagttttccttttaccttcatttatttatcctttggtactcttccttatgtagattcgagtttctgacctatgttactttccttctgtctaaagagctctttttaacatttctggcagggcatacctactggcaacaaaatccaatttttgtttgtctgagaaagtctttatttttctttgacttttgaaggataatttcaaagggtacagaattctaggttggtgggttttttttctctcaacactaaagattttactccactctcttcttgtttgcatggtttctgagaagttggaagtaattattgtttctctataggtaaggtatttatttcctctggcttttttcaggatttttttatctttgattttctgtagtttgaaatggatatgcctaagtgtaggttttttggcctttatcctgcttggtgttctctgaggttcctagatctgtggtttggtgtctgactttaatttggagaaattctcagtcattattgtttcaaatatttcttctgttcccttttctttttcctctgcttctggtatttctattatgtgtagtgacatcttttgtagttgttccgcagtctttggatattctattctgttttttttttcagtctttgttctctttgccttttttttttttttttttttgagacagagtcttgttctgttgcccaggctggagtacagtggtgcgttcttggctcactgcaacttctgcctcctgggttcaaggaattctgcctcagcctcctgagtagctgggattagaggtgtgcaccaccatacccggctaatttttgtgtttttagtagagatggggttttgccatgttggccaggctggtctcgaactcctgacctcaagtgatccacctgccttggcctcgcaaagcgctgggattataggcatgagccactgtgcccagcccctctttgatttttaattttggaaatttctattgtgatatacccaagctcagagatttttcttcctcagctatttacagtctaccaataaacctatcaagatcattcttcatttccatcgtagtgtttttgatctctagcattttattttgttttattttggttggttctttcttagtatttccatctctctgcttactttgcccatctgttcttgcatgccatatactttatccattagagcccttagtatattaattatagctgtttaaattactggtctaagtattccagtatccctgccatatctgaatgtggttttgatgcttgctctgtctcttcaaactctgttttttgccttttattatgccttgtaatatttttcttgatagccagatgtaatgtactgggtaaaaggaactgctgtagtaggcctttagtgattcagtaaggactgggtttgggggaacattctatagtcctatgattaagtctcagtcttttagcgagcctgtgcctctggactgtgaactgtagaagtgctttgtttagcgcttaggtggggcaggatggctagaatgggctggagttggatattttccttttcccaggtcagttaggctctgacaaaaccccagcaggctaggttctagttaaacagtttctcttgtcttaatgagtcaggcctcgttaagaaaagaatgctctgggataattcaaaatggtttatttccccctttccttgttgggatcatgaggggatttttctctgttgttcactgtgagaatgtggtaaagctacaggaggtaaaactcccaaaaatgtgcttcccctttcccccgcgactgggtccccctggagtttttatctctcagacttgtccatactgagccttcagtagttgatcaattacagttcagctttccctacccaagtactggttcccacagaggtttcagctctggtaagttgtgattctttgtattcacctgctaatctctctaaatttgggggcagtggtttgccctgcgacctcatttctgttatggatctaagaagagttgttgatatttcagcttgttcagctttttacttgttaggatggagcggcaaactggaagactgtgtttaacttttgaggaactgccagactatttttcgtagcagtcccaccagcaatgtatgagggttccagtttcatcatatccttgtcagcccttgttattgtctgtctttaaaaaaaaagagtttttttttagaggcagggtcttgctttgtcagccaggctagagtgcagtggtgtgatcatagcccactgtaaccttaaactcctgggcttaaatgattcttccctcttagcctcccaagtagctaggactacagggtcatgccatcatgtccggctaattttttaatttttttgtagagacaaggtctcactatgttgtccaagctggtcttgaactcatggcttcaagtgatcttcgtgccttgccctctcaagttgttgggattataggcacgagccactgtgcctggcctttgtcttttttttagtagccttcctaatgggtatgaagtggtattttattgttcagcaacatactttcaactgttcttttactattttgattgtagactgtatctcctagcttgttgatttggtaggtgaggatttagccctcctatcatatcctccctgaagcatacttacccttctcttttcctattccctcacttcccagtcaggtctatcagagttaggtcagaattcattgtgacttagtaaacatagttagcagctgagccctatagtattatcacattaacattttttaaaaatttccttgtgttaataattactaattttgttttgtccttcccgcaccttcccttatgaccctgcagtgtgtgtatcattattattcttaaacttacctgttacctctcaaaatccccctcaaacagttaaacacattggtaattcatcagttcctttcctcacctggaggccacaagtgtcctgctccactttggaaaggtctgtctcaaagcatccagcataaatgacatcttaggaccttttttcactgctgtactggggatagtcagatatttagccttctggatttatctaaatttcctgtatttctctcttttaaaataaccgttattttattctagttctggaagatttcctcaaatttatattccaactctgcattttttgctcacctaatgaaaaataatgacataattttcagaacgctttcttatgtattaaatattcctttggtatttttcatgagtgtaatgtctttaatacctctgagcatactggtgatattgtctcggcttccttcaagttctttttcttctttttagcctgttttctgtcatattggaggctttcattagatgatctttggttgcctgttcgcatttaagagggagactgtacaaagctatttggaagctctatgcatacacatggacaggttgctaatgtttttggagaagttactgaaagcaaagcactccactaagcacttcatatatcttaactattcgttacattggtcctgtattcttatttcacagatgaggaacatcttgaggcttagatgatgcaaccagaaaaaagttgtcttcatgtgattcttttatctatcatactgtttttctgccctgttctcagtaaatgctttttgaataccaggaaatctcttgagacccttaaggtcagaaacaagacagacaaatctagtcatccaaaacacacaattgcagtaattatagaagtgtgttgagatgaaattgtgaatatgattgtttggactgaggaatggtcagattgatagattcttttttttttttttctgctatcttgaattccagggaaccgggtatataacctgggcatacaaatatttgttttagtgacatgtgaggcttcttccaataggtctagaagaaaagagtaaataatatgctaaattaaaggaatcattatgggtgatactgtaaaacaataaagtatgaagtattatttgagaagaccaatattgcacacatatacagcagtgattcattatagtgttgtttgtcttacaaatatccttatattagaaaaattaggccttgtgtggtagtgcatgcctgtgattccaacactttgggaggctgaggcaggaggatcacttgaagcctggagttggagaccagcctgggcaacatagcaatctctacaaaaaaaatttaaaattagctgttgtggtggcatgtgcctgtagtcctagctactcaggaggctgaagcaggaggattgcttgagtccaggagtctgaggctgcagtgggctatgatcactcccttgtactccagcctgggctagagtgagagcctgtctcagaaaaaaaaaaaaaaaaaagaaaaattataaattctttatactgttgttagtaagatatttatttatttatttattttggtggcccatctgaaagtacactctgctgtaatatgccaaacttcaaactatgtttcctcactttaaggtgctgtttctaaatactggcatatagatattagaaatacctgtcagaacagttcatttgcattatcagttatttttaaccaaaagtaatcactctgttaaaatatttttaaacaatagaatgacacaaaaatataagtaaaaaaacaaagtatttttatttaactgacaaagatgttttgcatcttttattattagaattgtcctttatttttacagaaaagaaatatatcctatgtatgtactttgtcttgtatttgtacaatttttttccctattgaataattactgcagcttgcaaaataactcttgtgagtaagcataaaggagtataattaactggaactgtagcagtggtagtttaataggaggcagatgtacctactgaaggataaaaataattacttgagaaaaagtaaagttagagtatttctgtgataagacaatctcccccttttttgtttaaatattcacagcatcctaccatgaaatgttcgtttatggctaagagtccttttccctaaaagaaataaccttattagtgaagtgcctattcagttaagtttggtattaatgttttgagctctttttttcttattttaagcatatcctggattctgtggtgagacaaatgtgttgtactttttgtgttccaaagacttacagttccttatttttaatttaggaaaagcttggaggctttccaagttttgaggtacagctatcttttatttttttgacatagtgatttcctacaaatgaaaactgataggacataaaaaggataaatttggtctcagcactttgaaatgtaagcttttacaagacagcaactattattgttatgtgttttttttaatttactgagttttctagaacattgaggggttactgtagcagatacacccagaaatccaagttggtgaacctaacaaaagtttattttttgctcacttctcaatgtagagagggtgttccaggtcaactggccttctgtgtggtcactcaggggcccaggctactcttgtcttatgactatgccctcctctctgttctagaatcctgtccatttagatagtgtggggaaatatactagtttattattcatttactccagaagtgacatagaccccttctcatgttctagaggtgagaagtatgatgtgaccccatcttaatgccagcatggtggtggtggttggaaaggtctgggagtagggtgcttcttgtaacgcctctcgtgattaacactgcgctttgaacagggagcataaatctgatagtcagtttactgttctgctaaaagttattacttcccctttcataatattgttcaaaggtggtaatattagctacttctagattgtgaatagacaggagacaaatgtccttgcctcatattctttaccctatttctgaatttttcattttgcttttaaactaccaaatatttaaccaattagtgtcagcgtttttgttgttgtttctttgtttgttttttaactgttgagattttagtgcagtcccttcatttgataaattagggaataggctcagagaaagtaagagatatttctaaggtcacttagtatgagagctaattcccggtctagaattctcttctgcatacagtctgccctccttatccgcaggttctgaatctgtggattcagctaactgtgacttgaaaatattcagggaaaaaaaccaatagaaataacaatataataacaaaaaataatataaacaatacagcataacaactatatagtatttacattgttgtattaggtatagtaatctagagatgatttaaacttagtcacacactgcagaagaatgttttggtcaacaacagaccacatacatgaaggtggtcccatgagattataatactgtattttttactgcaccttttctatgtttatatatgtttagatacacaaatacttaaccattatgttaaaattacctacagtattcaatacagtaacatgctgtacaggtttctagcctaggagtgataggctctaccatatagtctaggtatgtagtaggttgtactgtctaggtttgtgtaagtacactccatgatgtttgcacagaattgcctaatgatgcattttctcagactatatctctatctatcgttaagcagagtgtgactgtatacaagaggatgtgtataggttatatgcaaatactgcatcattttatataagggacttgaacatccttagattttggtatctgttggggctcctggaaccaatcccccacagatatggagagacaactgtactatgtcatctttgaaaggtctacttttataaattcatatctcctgaattaatacaagttttgtcccccagattcctttcctcttaataacctcctaagatacttaccctggagaaatgggaattttaattgatgtagaaaaaaatgagtggtctgaaaagcatttgtcatattattgtttgggtctggccagcccatactggaatgtcatattgactttgaatgcctgagaaagaatggcccaggaattgaaggagctaccaaaaaaggaggggaggttgccagagtcaagtggggcctatttaaaaaattttgctcagatcttaggggaacatttatgttaacttaagacaaagaacactactcccctacttctgttgacttggaaaacaaattaatttagttgtttgagggctttgtgatttctctgaaatttaaacaaaataatttatttaattctgtctgttcataattaattccaaacttaaaagtgctgatttgtatgtatttatttattctgcttcttaataagtgtgcaactgatttgtttttaatagctcactccccacatttaaatacctcccaccagcataaagtaatataaattcatggtagaaaatacagaaaagcataatgacatgtaattttacttcccagtaataaacacagatagcattttgaggtatttcctcttggttcttctcttattatatcgtatagaaatattaaaatctatatgaaataaactgaccatgatatcctaagcattgtcctatgtttgcaaatgttcttagaaaatatttttaatgcctgtgtgattttctagtaaatagacatactgtaattagtccctcatctttttttgggctttacattgaaagtgtcattgtaaattacagtttttacaaattttaaatttagtaatctctgtggttgggcaggttctttctgtcactgttcatgttttttcctgagatatttataaatagtttctttaagctaaggtcttttcatcttctctatgttctccaaggttgtgcctggactagggtagttggtttaatggtctgtctccccactagattgtgaacttccagtggatctttctttcatccttgtatctccattgctcagcatggtgtcaggaacatagtaggcattcagtaaaatatttgtcgaatgcttattatgattatggaaagtgatgggactgattttcatgtgatagtttcgggtttttctcatggcttttaaagtttcacctcacacatgtgtcataatcagagagtggaaaagagtaaaggagttaaaatttaagccagaaatgtttttctttaaacttagttttcatacacagtagctcacttagtggtgaagaggagggcatgccttagttgcatgccagggaaagctcaagctaattgctttataatctgaatattgtagctctccttttagcttctcctctcttctccacttcagtcctctgtgctcttcctcactgctgtctcctgtcctttttcctagcctctttcttcctttccagaatttgacgtcaggagcacaatatgagacaaagcatgccgtcttcagatttaagatgttcctttttaatggctttggagataggatagaaggtgttaaatctttatttttaaatgcacaatttccttccttgaacaagccaaccaaaaggcctcaaattttccaatggagccctttagacagatttcacaggaagtgtgactgtgcatacattttatgtgtatgtccataaaatgtttacatgtaatatataaaaatgtgtatcatatatagggttacctactaactaaactgaagtgatgggatagagatgttaaatatgtagttgttgaattctctctgaaaccctgtctatcaggttttcttgactttttttataggaagttgtataattgtaggtttattggtagttggagaaaacgctcataactgtcctgtctgtggtctcttgggagtatataagtaaatatttaatggttcttttctagtgtagcatgaatgcttaaaatattaattgtggacagccagtgatgtggttcttggtgcccttctattgagaagaataacccacagcagttctttattttagaacactgcctcagtttgttcccgataattaaatagtcgactgatttctagtgaagatatttaaaatgttaacatgacttaaaatcacaaaaatgtttagccatctttgggggcattcataaataagtgacttttgatctatttacattcttggaacatcaggcatatatacagcttaggagaccgcccttcttgcttttttatgctaaaaagctttcattttctgaagcactgagatgcgttaagtggcaggagggtgctaagcattagaatgaggcaacagttcaggtggcactaggaggatgttgtgtaggggacacactctcattgccatcacaggtaatgcctcactagactttcaagtcaaacagtggttgtcagccttggctgcacattagagtcacctgtgaaatttaaaaaactgcacaccagaccaattaaatcagattatccagggctggaacctaggtatcagtatttagaaacgcttccctagagtttttattttaatgtgcagcaagaataaggatccctgcaaagcttggatgagttgcagagatgatgtattatatagctactggcttcagttggacctcatcaattataattaaccaattgggagttcctggatgaaacttaaggtttattcagtgccgcatattcattgaacctcaaccttgtactagattattagttggtaggattacaaagataaataagacgtggttgataaaatagtgcagtctagtgtgagagacagaaataataaatacttacaatgcaaggtgtatagagtattaaaatagaaaataggtgtgtctaggttgttattgggaacacaggtgtaattaactctgaggcttagaatatggaatgggtgggaggggatggggcaggagatgacatgagaaatggtcagggttacacagagaaagtgataaattaggggtttactaggtagaaaaatggaagaggaagtttttttgtgtgtgtgtttttttaaacattgtaacattgcaaagatgtgaagaaatgaagaaatatgtgttcaggggttggttatagagcaagatgcctatgagatatttgcaggttatacagctagagagatagatcagagtcaagtggtgagtgaaatgccttacaagccgtgttgagaaacaagggtgtcacagggccaaatgcacatagggtctagatagatcattttaaggagtgaagctggtcaggtgtgaagcagttggtagtgttggaggctctcctaatctggacagcataggccttgtttaaaggcatttaaataagaactttttaaaagagtttaagtttaaaataaaatagaatactctttcagtcaagtaaacctgtaaaattcaacctgcaagggccagttggtggtaccttcaatttaagagcccagcataggatgataaacaaggaaaaactgtaagatagcatttctataaaagtactgtcgaaatataatttcagagttgaaattgtgctggagctgtggagatgagagcataagtgaagaggttagtgcagtaatctaggtaaaatgttctggcaagccatcaatgttttcaaatgaggtagcttacatttgttggctactgttctcctcttgttaacttgccatcatagatcataccttcttcccaaccccatctatcatgttgttataccgcactccattcttactcactggaattgtcctagtgcaggtttctgtgttgaacaaggtgttttttttgtttttcttttaacggttgtttgtttttccattggtataactctctctagatagcagtataggtttgtaggtggatcgctgagtgaggagtttaaggctggaggcctcttatgtgtgtgtatatatatatatgtatttaattaaatgaaataggaggaaaggttatctgctgaaagcacgggattccagtgtaaaatgaacaggacatagaaagtggtgaaggtcaacaagatgagtatgactttcatttcttggttaagaagcttttatctaagattttttaaaatgaaaatttaagtaaaataagtgataatcataatcttgatgtttttcataagaacaaaagagaacttagttatattaggttgatgcagaagtaattgcggttttagtcgttaaaaggaatgggaaaaaccacagttacttttgcacgaacctaattttacctgaaaatgtattatttttgtttgactttatattagtggaagatagagaagagaaatctgagattagaagacctgtatttcagtcttggttctgccagagcttttgattatttaacttaatagtcttttaagcttaactaaaatagggataatagtatataccttgcctattttttcagtaccgtattgtttttaatgaagattgagatgattggctataataatgttttaaaaaccacaagcattgttcatgagatacagagatgcaaaagtagtgaattcatagatttaaattattttgcaagtgccctttttatgcttgtttacttcacattaaagggaataatgtgttagaagtatggtgttaatttatggagaagatatgtgtgtgctttttttctttttaaaatagaccagttctaaatattttattttacttggtttgtccctgtgatttaacttgctaaagtattgttggaaaaggacatggaggaaatattagttatgcaaattaggtcacatctgtagttaacatctactatatttgatagagctttattgtaacagtagctgctttatgtagcctaaagcagatgacatttttgcccttttaaaggcgctaaaatgaaactttatttatttaagataaattatgtttaactttttttttgtttggcaggcaaccagataaactggtggtagtttggaccagaagaagccgaaggaagtcttctaaggttagtgtattttctaaatttcttacctaattgttgaatacaaattagcaaactgctctggttccagtgtagaatattttaaaatattacttgatgttttgtttttttttcttgattgtctactgaaaatggattgatcagatgctataatcttttaactgcttgttctcaaaacgggagccagatacctgagttttggtcttggatttggtaattactatggtttgaaaaaaatcaggtgttgccaatgtaatagaataggttggtgcaaaagtaattgcggttttgccttaaaagtaatagcaaaaactgcagttacttttgcaccaacctaatataaggaggtggggggcctttaagaagtgattagggtaaggacttctcccttgtgaattcaattaggcatccttataaaaggacttgatagagggagtttgtttcctttttgccctctgccttctgccacatgaggatgcactaagaaggccctcaccagatgccgatgccttgatcttgaacttctagcccttagaactgtgagaaaatagatttctgctctttatttattactcagtctgcggcatgttgttacaccaacacaaatggactgagacagtagccttgaataacataatagttaagttacttctctgtactacagtgttaagaattaatgattaaacaggtaccacttacaaaattgtacctaagattaatttatttagattacaagatgacgaagttagggcacacttaagaagttacgagttatctgagtctgttgctggggtgcagaagaggagttggatttttcaaagattttaatttcttttggtactgataattttgtttgtggggagtggaaccgaattttataatattcaataacagttctacagatatttaaaaaattctatcctggccagattctatccttacgcctgtaatcctggcactttgggaggccaaggcaggaggatcgcttgaggctaggaatttaagaccagcctgggaaacatagtgagaccccatatctacaaaaacaaaaacaaaaacaaaattagccaagtgtggtgatgcacctgtagtcccagctactgaagaggttgagatgagaggattgcttgagcccaggagtttgaagctttattgagctaagattgtgccactgccctccagcctgggtgacagagtgagactgtctctaaaaacaaaattctgttctaaaataaatgtgactatattttttattagtatacaatgaccacaagaatgtttattgaatgttggtttttctacaagtagacctgtataaagaaaactttattagttttaattgaaatcctacaattttctgtatttaaaattttttatttagggcctcttttcaagtcttttatttttattgagctaaaacttacatatgtgtaatacacagatcttaattttataattcagtaagatttgatcaatatgtatacttgtataattaccacttctgtaaagatacagactgttttaatcacttttttcttttttattttattatacttttaagttctagggtacatgtgcacaacgtgcaggtttgttacatatgtatacatgtgccatgttggtgtgctgcacccattaactcgtcatttatattaggtatatctcctaatgctatcccttccccatccccccaccccacaacaggccccctgtgtgtgatgttccccttcctgtgtccaagtgttctcattgttcaattcccacttatgagtgagaacatgcagtgtttggttttttgtccttaagatagtttgctgagagtgatggtttccagcttcatccatgtcccttcaaaggacatgaactcatccttttttatggccgcatagtattccatggtgtctatgtgccacattttcttaatccagtctatcattaatggacatttgggttggttccaagtctttgctattgtgaatagtgctgcagtaaacatacatgtgcatgtgtctttatagcagcatgatttataatgctttgggtatatacccagtaatgggatggctgggtcaaatggtatttctagttctagatccttgaggaatcgccacactgacttccacaatggttgaactagtttacagtcctaccaacagtgtaaaagtgttcctatttctccacatcctctccagcacctgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccacttgttgatggagttgtttgttttattcttgtaaatttgtttgagttctttgtagattctggatattagccttttgtcagataagtaggttgcaaaaattttcttccattctgtaggttgtctgttcactctcatggtggtttcttttgctgtgcagaagctctttagtttaattaagtaccatttgtcaattttgtcttttgttgccattgcttttggtgttttagacatgaagtccttgcccatgcctgtgtcttgaatggtattgcctgggttttcttctagggtttttatggttttaggtctaacatttaagtctttaatccatcttgaattaatttttatataaggtgtaaggaagggatccagtttcagctttctacctatggctagccacttttcccagcaccaattattaaatagggagtcctttccccatttcttgtttttgttaggtttgtcgaagatcttatggttgtagatgtgtggtattatttctgagggctctgttctgttctattgatctatatctctgttttggtaccagtaccatgctgttttggttactgtagccttgtagtatagtttgaagtcaggtagcatgatgcctccagctttgttcttttggcttaggattgtcttggcaatgcaggctcttttttggttccatatgaactttaaagtagttttttccaattctgtgaagaaagtcattggtagcttgatgggatggcattgaatctataaattaccttgggcagtatggccattttcatgatattcattattcctatccatgagcgtggaatgttcttgcatttgtttgtgtcctcttttatttcgctgagcagtggtttgtagttctccttgaagaagtccttcacatcccttgtaagttggattcctaggtgttttattctctttgaagcaattgtgaatgggagttccctcatgatttggctctctgtttgtctgttattggtgtataagaatgcttgtgatttttgcgcattgattttgtgtcctgagactttgctgaagttgcttattagcttaaggagattttgggctgagacaaatggggttttctaaatatacaatcatgtcatctgcaaacagggacaattttacttcctcttttcctaatcgaatacctttatttctttctcttgcctgattgccctagccagaacttccaacactatgttgaataggagtggtgagagagggcatccctgtcttgtgtgaattttgaaagggaatgcttccagtttttgcccattcagtatgatattggctgtgggtttgtcataaatagcttttattattttgagatacgtcccatcaataccgaatttattgagagtttttagcatgaagggctgttgaattttgtcgaaggccttttctgcatctattgagataatcatgtggtttttgtctttggttctgtttatatgctggattacatttattgattttcgtatgttgaaacagccttgcattccagggatgaagcccacttgatcatggtggataagctttttgatgtgctgctggatttggtttgccagtattttattgaggatttttgcatggatgttcatcagggatattggtccaaaattctctttttttgctgtgtctgtgccaggctttggtatcaggatgatgctggcctcataaagtgagttagggaggatttcctctttttctattgattggaatagtttcagaaggaatagtaccagctcctccttgtacctccggtagaattcggctgtgaatccatctggtcctcgactttttttggttggtaagctattaattattgcctcaatttcagagcctgttattggtctattcagagattcagcttcttcctggtttaggcttcggagggtgtatgtgtccaggaatttatgcatttcttctagattttctagtttatttgtgtagaggtgtttatagtattctctgatggtagtttgtatttttatgggatcggtggtgatatcccctttatcatttgtattgtgtctgtttcattcttctctcttttcttctttattagtcttgctagcggtctatcaattttgttgatcttttcaaaaaaccagctcctggattcattttttttttgaagggttttttgtgtctctatctccttcagttcttctctgatcttagttatttcttgccttctgctagcttttgaatgtgtttgctcttgcttctctagttcttttaattgtgatgttagggtgtcagttttagatctttcctgctttctcttgtggtatttagtgctagaaatttccctctacacactgctttgaatgtgtcccagagattctggtatgttatgtgtttgttctcattggtttcaaagaacatctttatttctgccttcatttcgttacgtacccagtagccattcaggagcaggttgttcagtttccatgtagttgagcggttttgagtgaggttcttaatcctgagttctagtttgattgcactgtggtctgagagactgttttaatttctgttcttttacatttgctgaggagtgctttacttccaactgtgtggttaattttggagtaagtgtggtgtggtgctgagaagaatgtatattctgttgatctggggtggagagttctatagatgtctattaggtctgcttggtgcagagctgagttcagttcctggatatccttgttaactttctgtctcgttgatctgtctaatgttgacagtggggtgttgaagtctcccattattattgtgtgggagtctaagtctctttgtaggtctctaaggacttgctttatgaatccgggtgctcctgtactgggtgcatatatatttaagatagttagctcttcttgttgaattgatccctttaccattatgtaatggccttctttgtctcttttggtctttgtttaaagtgtgttttatcacactttgtttaaagtgtgttttatcagagacctggattgcaacccttgcctttttttattttccatttgcttggtagatcttcctccatccctttattttgagcctatgtgtgtctctgcacgtgagatgggtttcctgaatacagcgcactgatgggtcttgactctttatccaaattgccagtttgtttctttcaattgaagtatttagcccatttacatttaaggttaatattgttatgtgtgaatttgatcctgtcattatgatgttagctggttattttgctcgttagttgatgcagtttcttcctagcatcgatggtctttacaatttggcatgtttttacagtggctggtactggttgttcctttgtatgtttagtgcttccttcatgagctcttgtagggcaggcctgatggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatctgctattagtctgatgggcttccctttgtgggtaacccgacctttctctgtggctgcccttaacattttttcctttatttcaactttggtgagtctgacaattatatgtcttggagttgctcttcttgaggagtgtctttgtggcgttctctgtatttcctgaatttgaatgttggcctgccttgctaggttggggcagttctcctggttaatatcctggagagtgttttccaacttggttccattctccctgtcactctcaggtacaccaatcagacgtagatttggtcttttcacatagtcccgtatttgttggaggctttgtttctttttgttcttttttctctaaacttctcacttcatttcattcaattgacctgcaatcactgataccctttcttccagttgattgaatcggctactgaagcttgtgcatttgtcacgtagttctcatgccatggttttcagctccatctggtcatttaaagagtcctctacactggttattctagttagacattcgtctaatctttcttcaaagtttttagctcctttgcgatgggttcgaacttcctcctttagcttggagaagtttgatcgtctgaagccttcttctctcaacttgtcaatgtcatgatccgtccaggtttgtttcgttgctggcgaggagctccgttcctttggagggggagaggtgctctgatttttagaattttcagctcttctgctctgttttttccccatctttgtggttttatctaccttcggtctttgatgatggtgacatacagatggggttttgttgtggatgtcctttctgtttgttagtttcccatctaacagtcaggaccctcagctgtaggtctgttggagtttgctggaggtccactccagaccctgttgcctgggtatcaccagtgaaggctgcagaacagcaaatgttgctgaacagcaaatgttgctgcctgatctttcctctggaagcctcatctcagaggggtacctggccgtgtgaggtttcagtctgcctctactggggggtgcctcccagttaggctactcggggtttagggacccacttgaggaggcagtctgtctgttctcagatctcaaactccctgctaggagaaccactactctcttcaaagctgtcagacagggacatttaagtctgcagaggtttctgctgccttttgttcagctatgccctgcctccagaggtggagtctacagaggcaggcaggcctccttgagctgcggtgggctccacccagttcgagcttcctgactgctctgtctactcaagcctcagcaatggtgggtgcccctcccgcagccttgctgctgccttgcagttcaatctccgactgctgtactagcaatgggcagggctctgtgggcgtgggaccctccgagccaggagcgggatataatctcctggtgtgccgtttgctaagattgttgggaaagcgcagtatgagggtgggagtgacccgattttccaggtgctgtctgtcacagctttccttggctaggaaagggaattccctgacaccttgcacttcccgggtgaggcaatgccttgccctgcttcggctcatgctcgatgggctgcacccactgtcctgcacccactgtccgacaagccccagtaagatgaacccggtacctcagttggaaatgcagaaatcacctgtcttctgcatcgctcaacgctgggagctgtagactggagctgttcctatttggccatcttgtaaccacccccacttttttcttttgttcctcttctaggcagttcccaaccctcagaggtgaacactgttttgattttctgttaccataagactagtgttgcttgttcttgagtttcatgtaaaatagtacagtagtacagtcaggcttgtttcgcttgacataacgtttttgagatttgttcatggtgttttgtgttttggtagtttatttgtttattgctaagtagtattcctccatgcaaatatactacaatatgattatctcttcctgtgttgatgaacatttgttttttttttccagttttttactcttgtgaataaagctgctatagacattattgtacaagtgtctttggggaaaagtatttttttatcttgggcatatcccaaggaaaggcataaccaggtaatagggtaggttcatttttaacttgtaagaaattgccacgcactctcaccagcaatattgaagagtttcagtggcctcacatcctgagcagcagcatctttaaagcatatgtttatagtttgagagcattataatttgaatgccttcttaccattaacatatgagaaggggttttaaaaagaaacataacatttgttggtcaatataagcttttgtgggaaggaccaatataagtttatccactaagtataataggtgaatatgactagacctataaattttagaaatagcctctaaatgtttttagttatcaacaaaaaacaatttatctcttttaataattagcttgaatgccacattcagggcttgaaaaaaaattagatagcaattattgtctaagagaaaatgagaaacataaggaaatgcgttagattataggtcaattaagaataccctggctggttgtggtgcttcacgcctgtaaccctagcactttggaaggctgaggcagatggattactggagtccaagagtttgagaccggcatgggcgacatggtgaaaccccctctctacaaaaaaaaaaaaaaagaatacctatatttgatgtttgatattcttttttatttcattgcatttacattgaaaagattgaaaagttagtcaaataatttctctgtgaggtccagattctttttcatattgtatcaaacattgtttgaatccagaatgcaaacatatgaggctacaggttgattttcatagaatatagtattttgtagaagaaattacttattgttggatgaattttccgtttgtaatgctcttaacattttaaaatctttcctgaatacgttagaatcattgtgatttctcttgaaacacagatgtacttcttgtgaaaagttagtatgatgcagtatgttcatgtatttatgaaaatgctgttttaggctgcgcgtgttggctcatgcctgtaatcccagcactttgggagtccgaggcaagtggatcacctgagggtcaggagttctagaccagcctgaccaacatggtgaaacctcatctctactaaaaatacaaaatgagctggaagtggtggcacatgcttgtaatcccagctacgcgggcgctgaggcaggagaatagcttgaacccgggtggtggaggttgcaatgagctgagatcgtgccattgcactccagcctgggcagcaaaagtagaactctatctcaaaaaaaaaaaaaaaaaaaaagacagaaaatgctgttttataaattgtacataataagctaaatagggaaataaaaataagttccagaaactatgaaggaaatgattatattattataaaagttaagcaactgaaaaagaaatcttgagagtgagatccatgacatttcagaatgattgaaaaacatttgtttccagctgctaagttaggtatcagttacgttaaatctaaagactagaaccactttttattgtgaaagacctttctgttttctgatgcttttcctttaaaatatacgttacttgctgctaagtaccactgaactcacataggaggaacaaatctctgcaactgttggtcagaaaatatatatatattttaagacaggatcttacttgttgcccaggctagagtgcagtggtatgatcacagcactgcagccttgacatccctgggctcaggtgatcctctgacctcagcctcccaggcagctggagaggcgtgcaccaccatgctgggctaattttttgtttttttgtagagatgggatttaccatgttgcgcagctagcagaatatattctagtttttactttgtactatgttttagaaagagtttgaactacatgataatcatttctttctttcttttttttttctttttttttttttttttttgaggcagagtcttgctcttgctctgtcgcccaggctggagtgcagtgggatgatctcggcgcactgcaacctccgcttcctgggttcatgcaattctcctgccttagtctcccgagtagctgggattacagacatacgccacaattcccggcaaatttttgtgtttttagtagagacgggctttcaccatgttgttcaggctggtctcaaactcctgacctcgagtgatccacctgccttggccttccaaagtgctgggattacagacataagccaccatgcccagctacaataatcatttctttttggcatctgtgtagcttactatttttctttactgattctcagtatattatctatttttatttttaaaaatttagaattgacacccagataggtcagttcattacctgattagacaataaaataataggacgccttctgtagtccctgctactcgggaggttgaggcaggagaatggcgtgaacccaggaggcggagcttgcagtgagcccagatagcgccactgcgctctggcctgggcgaaagagcgagactctgtctcaaaaaaaaaaaaaaaaaatttacttctcagtttattgctcactcttttttgaggtacgtgtttgaatttggagctaaatatactaggagctcattatagaatctttgttttgtttttgagacagtcttactctgttgcccaggctggagtgcagtggtgtgatctcggttctctgcaacctccacctttcaggttcaagcaattctcatgcctcagcctcctgaatagctgggattacagtcatgcaccaccacacctggctaagttttgtatttttagtagagatagcatttcaccatgctggtcaggctggtctcaaactcctgacctcagatgagccgcccgcctcagcctcccaaagtgtgggattacaagcctgatccaccacatctgatcctagaataatttttgattgagagaataattaccctgagtagttaacacaatatgcagcttcccttcctcttctctttaagtcatggcttttataacaaagatttttgtcaggctgcaattgatttgtatatgcttaaataaattatgtttcagtacaatatgtgacagtattggaatcagggcagttaggatagaccagaaaaattatggcagagtagttatgttgccctaaatcctgttatcttattagaaatttaggctcacagagaggttggagaattccaaaaagaaaccataactttaaaatcctcaccaattttttttcatggcattaccacctttacttccttgctctgtggttgtgctacagcctttgcaatgtgctaccatttcaagaaggagagtacagctagctgcagagctttgcctaatgacagttatgttgacaactctaagatgactttatatatgacatcttatgtggatatatgcagttttaaaaattgaaaattgtcagtttaaaaactatatggcatttgtaaattttcactgaaatatttcaattttacaggaatcagaaataacgaatgattgctaactctgtacttagttctgtactaggtacacgttttttaggtaagaatatgacatgaaataattagcgaatgagacagtttatagagtcacccaaaattgagaagtgttgcctttttccaagttggtttttggcagatgtcaaaggatctttgatgtgacttgaaatgtgaggaaaattgtagaaggggaccaggataatgtatcctaactttttctgccattagctgtactaggatattggcaaatgattaaataatctgcctttcctaactatactaaggagccaaatggctgtatgtgtgttcctgtgcctacttattttatagggaaatcctttctattactcagaatgaaaaatgatcagggctctcatagtgctgatgtttgccaatatggtgtgctttttcttttgtttttttgagatggagtctcgctctgtcatctaggctggagtgcagtggcgtgatcttggctcactgtagcctccacctccctggttcaagcgattcgcctgcctcagcctcccaagtagctgggattacagacgcccaccactatgccggctaatttttgtattttcagtagagacagggtttcaccatgttcaccagactggtctcaaactcctgacctcaagtgatcacctgcctcagcctctcaaagtgctggaattataggcatgagccaccgtgcccagccagtggtgtgctttttcctatatcaacctcttaaaaacctaaattagtgtctctgtgggttagtacaattagatatttattaccataactctttctagttacctgtattaaacttgtcattctttttctaggttcagattaccactgtttgaggtaaaagttgtagtaaattcttagaaaacagtaacactatttttttttggtcagattttccactttgaatgtccttggtttcttctctggtgaaacttactgatcctctgctttctactagtacagttgtccctaggtatatacgggggattggttccaggacccctgtgtatactgaaatctgcacataaagtcctgaagatggccctgtggaacttgcatatgtgaaaagtcagccctccacatatgcaggttttgcatcttgtgcacactgattttggtctgcttttggttgaaaaaaaatctgcatgtaagtggaactgtgcagttcatacctgtgttgttcaaggccaactgtaaataataattagctaaacgatagaaagctggccctgactgtactcattgtcagctatttagctagactaattgatactattacagtgtcttaactcagccaggttgtacagccccagaaggaatatcaaaaagccagaactcggttagacctttttgttgggagagagttcctggatagaatggtaagaaagaagcagtgtactagcaacttaggaactagcatactaatgtctccttttattaatcataataaaaagattttagtttgttaagcagattgtatttttgtttgttcagcagtctaattactattccctgatccaggactgaggatttagaggaccaagctttaggatacctgaggaaattatctgaagctatcatctcctaactctgcccagttgttagacggtctccgtattccctgcttttcccacttttgatcactgtgtcatacactgaaatattaagtcctaagggatagaagactattttcttgactaccatgcaaatcagagatagagcagggcatgatatgggtttggtgagtcatggagtctgggctctcctcctggttgctagtatgagttcatgcaaaccatttactctttgcttgcttcaatttccttatccagatctgaattagatctaaagatattttcaggtctaaaaatctctgatgggtatttttcattgagaatttaataggtagccttgtcttttctgctggggatgattagaaagattcagtgattacactctttttctaacatttttattgcatggaacaactatgaaaatttaattgtgggaagcttgaagagaccagaaaaacagcttgattaaccataagagttaaggttgttataagttttcagaattaagtatgtggagttttaattgagtattaagagtggagttttgattgattatctagggtgcacagaaatttacttttcaaaatggagattgtttactttgtggagtttttgttttagggctgtcaacagacatggaaataggggactagagaaatctctggagagatgttttttaatcaagaaaactctgttctgtacctttcactatggtatgctaagtctcgtgatgagcctctgtttccatctctgtacctgaagttttgtgacagggtggcaatagaaagagaatagagggagaattattgacaattcataagttggatttggtgtacactgttaaacctgtatcttcttttggcattttaactagtaagatgtgataagatttgcatggacctaagtttacctaatcttgatcccttctcggttccttggcccaggttcaaatcaaattctgctacttactttctgtgtgatcttgggcaagtttgtccctcagtttttcaatctgttaaatctgctgcctgacttgcatctgcactcatatactgtaacttctttttctattattatggaagaatggtctgtgcttccaggaaggatcaatctgtcttattgtatactgttaaggacattagcaattctcccttctctcttctgcatcattagattttccctctcaactgaatatttcccatcagcataaaatatttttctcttcttaaaattctcttctgcaacgattttctccactagcgccaacctgtttcttttcctttcagcaaaacaccccagaggagttgagtatatttgctctcttcaatttgtttcttcccattctttcttaaattcattccagtcaggtctttgttctcgtcactttactgaaactgctcttgtaaagttattaatgccttctcaaactcatactcctgggctcaagctatcctcccacctcagcctcccaagtagctgggattccaggcatcagccactgtacctggccttattaatggcttctgctttgttaaacccagtgaccgtttttcaggcctcatcctatttgacttgtcatcaacatttggcacaggtgattgttctcttcttgaaacactcttaccactagactttcaggatgccacacttttgcttcaactgatgggcctttgctggcttcttcattttcttgacctgtttaatgtttttctccgagacttagtctttggagctttatattctttatctgtactcactcccttggtattatctgtattcttaaactttaaatattacctgtatgctgacagttcccaaatttgcagctccagacacgtaatccagctgcttatttgaacatccacccttgaatatctaagaggcaactcatatttaatgtgtgtgaaatggagcttctgaacttatttcccaaatctgtcctttctatagtcttgcctcctatctgttaatagcaattcctttcttctataaggtagaagccttagaatcagccttggctactttctttgtctcttataatcaggcagcacatcttgtggactctacctagaaaatataaaaagatacccagaatctggctcctttgtaccacttttctaccaccccaagccaagtaaccatcacatctcccttggattattgcagtcgctttttaattgatctccctgtttctctcttatgtttggaacctgttctcaaaacattagccaatataagcctgttgaaatatattagattgtcattcctctccttgaaaccctccagtggcttcccatttcactcaaaatataagtcaatatctttgcaatgacctaccagggccttatatgattggaccctcctttatttctctggccttgtgtcttactgctatcctcttgaccactctgttccagccacattgccctctttattatataagagcctcagcacctttccagttgctggtttttctccctagatacctcttttcatgcatttacatgtgtgattcctttaccttgttttgtttttggccttctctcaagtgtcatcttctcaatgaagtcttctctaagcaccctattgaaaaatattaccttttcttacccccagttcttcttccctacttttttttcactacagcacttacctctacctaacatattatatatttttcttaattgttctgtttgtgttctcttcctactgtattgtaaactcccccaaggcagattgtttttcactcctccagggcctagaacagtgcttggcagatagtatcaattaagcaaatgagtgaatgaatgaatgaataatagaagaacatcataaggttcttatgtagattaaatgagtttaacataagtaaattcttaagacatggaccggcacatagaaagtactctgtaagtgttagcttttattataattttcatagcatgtccatggacagtcctgtagccaatagaggtgaagacttagttgagttgagatgtcttggcatgccatcttccattagctcaactttgactagaagttccacaaaggaagaactatggtggttacccccaaattttggagtgtggaggttccttagggaaccttgataatcaagatttacaaggaaaaaaatacctataattatcagtaactaggaatattacctggagaaactgatgctgttctttatctgccccaaataaacattacagtttagtgggaaatgaacttaaatgcaaagttatacagttagttttttcttttaaagtatgaatttgtcttaaagttcctagtccacaaaaataatttttaaaatatctcttctaataaaatactttaaacagatagtagcttttgaaaacatgagacatcatgttttcatcatttttgcatgttcttctgtgtgtatgaggggataaagatttgtttacagatagtaatctgtagctgtcatatgatataactatcttggcccaagcttaatgcttgaaaagttttatttgattaagcatttttgtttcagggatactacatagggtcaatataccattgtaaattactaacattgcatttcctgtacttcatattgaaggtatcattttattctggtaaattactaacattgcatttcccatacttcatattgaaggtatcatttttattctggtaggcacatagctggcaacctggaataaaaaatccctatcgtggtgttgttgtgtggcctgttcctgaaaacattgaaatcactgtaacactttttaaggtaagttccatttttataggctatagaatttattatataaccagggtaccaaatgacagaatatttcagtgttcattgttctatacatttgtgtccagtctggtacctactgtgcattatttttagggacatagcaatttataacaatgcaaaggaatcacagtatttcatggtttataaagtcggggatcttcttgaacttattacaattcagatcagctgacatagttcttttaccacttcctacactctacccacagaaaactgtaaaatgccttccctgtggaaagctgaggagtgtggaattctgagtcttgaccttcattttgttagccttgtttgataaaagaatgctttaaaattagtatattataaatatcttattaatgttaatgtaacaagatgtgttttaaattgatatttgataaatattttattgatattagtatttataagtgttgctgcttaaaggcaaaatgctggttgtaaattcaaagcacctcatagaggaggtgctttttaagaaagttatcagtatgtttaatttttctgtgatttaaccaaaaattaatttctttagcctgcttttgagatttgagttaaattgaaaatagctgtttccagtaaatttttttttaaaaagacctttaggattttgagaaggacaatggctcttcaagctatttttaatttttctctttagtgcagtgctaagaaaggagacagtagagggagagtaggatataaaaaaaggcttaattgaattacgctagaagcaattctcattacaaatgtttttgtctgctcagtaatatggttaattatgtagagataccatttttaagtgccttggaaatgaacatcattgctgcttattttacatctttttactgacttggccctataagatgtgcctcttggtctcattaaaattattctttggtaaaaattattttagggataatacattatctgtgctttaaaacgtatttcattgctttaagagttaatatatgtcatatgtatatggtgctgttaaatatttattaatttataagatatatattcattacttcattaatccaatattcttgagagccttgctatgtgccaggtacttttctagatcctgggggcacagtgcctacactgaattaacaaagtgggtaaaagtcagacagacctggaacagcaacatagcttaaacactagttgtgcattgtgggaagctgcatctcttaggtttcatttttctgctctgttaaatgggagtgaagatagtacctatctcataggttgctatgatgagtaaaacacttagcacaagaactgggacatggtgttgctcagtaaatattttatattattattttgatactaactgtgctggagctgtgctgcattcctcaaaatacaaaatgagaggggagggataggcagggagaatggtatgatgtctcccctgcattgcatcacactgtattacttgctttctaaagtagtactctctgtgtcctaagtgcatcatggaaaagctctttcaacctttatatacaattctttttctccttaaaaccagtttattggcagagccagctgaggaagcaaatattaagtatattttttccacttcccttttctttctaccctttccctgttcaccaccaccaaagaaacttattttggcaggtttttatcctacctatgtgaatttactcataaaaatagttgcttcaatacagctcaaactcagccagctgccatgctattatactagaaaatgagtaaacagacataagaagtaactaaggagtttggaatttatctcataagttgtaggggttgttaaagaaatctgagttggtactcatatggtcagaactgtggtttgggagaattaatctgtgtacaagattgaatggagatcagagagaccgagagaatgctgcagtcacgttcatcttgaaatagcctaggtacgatctcaactatggcaatagaaatagaagatcattagtagaccaaagtggaatcaatcataaataagatgtttctctttgagaaacatgggacctgagagacccagtagggaaatatcagagtccatctcccatccgtgtatgctcaatcttagagtgcaatgttgagccaaaagcatactttatcgagataatctctcattctcttgatacctccattcctacctcacttctgatacatggagtggacttgagtaagttaaatgggcatgtaatgtgaccccactacttttctctgtttcttgtactttgttgccttttgcctttacttactctaaaatctgtggaaatcttatataatcccacccagcccagatgttttctctttcatgaagtttttcttgttcattcttgtaagaagtagtatgtcattttctaatctctggtaaaatcatttatttcattcatcatacatttatttggatttagaactactgtgtttgtctttgaaggcaaggacaactgtctttgaatccatgtaacatctctacaatcccttatatactaagtcccccataaatatttctcaaataaatgcttgcaaaagtgtgcttcattaaaaaaaaaaaaaaaaaaaaaaggttgcatttggttgtaagatccattaccctttctcaggtttctaaggtatttctggggttaatgagggagaggtaagaggaagggcatcagtagccccgctgatttgccattttgtctagattatcaagtcccttttagtgctttgaaattccagctgtttatttaacctctgcactgaagaaaacgttgccgctagcggtacttttaagatacatacaggtataaaaatgaaggcagggctttatgttagcatttaatatcttaataagctgcttcttaatagtacatttactggtttatctgtctctgatcaggtagagttagtgatggaagatagtgatatgcatcaacaaaaataaaatagaggatttcttaatattaaataatgattataatttagataaattatggaagtattataaaagtagggtatgaccaggcacagtgggtcatgtctgtaatcccgacactttgggaggctgaggtgggtgatcgcttgagccaaggagttcaagacaagcctgggcaacatggtgaaaccccatctctacaaaaaatacaaaaaaaacggaccaggtgcagtggctcactcctgtaatcccagcactgtgggaggttgaggcaaggagatcgtttgagctcaggagttcaagaccatcctgggcaacatggcaaaaccctgtctcttttgaaaatacaaaaaattagctgggtgcagtggtgtgtgcctgtagtcccagctactcaggaggttgaggtgggaggatcgcttgagcccaggaggtgaaggttgcagtgaaccaagatcatgcccctgcactgcagcctggacagcagagcaagactctgtcaaaaaaaaaaaaaaaaaaaagtcaagactaagaaaatcactcaaaaccatgcatttacatggaaattaaacatcatgctctggaattactttggggtaaataatgaaattaaggcagatatcaagaagttatttgaagctaatgagaacaacgatgcaacagaccagaatcactgggacacagctaaggcagtgttaagagggaaattcaaagcactaaatacccatatcaagagttagaaaaatctcaaattaacaacctaacatcacaactgaaagaattagagaagcaaggacaaatcaactccaaagctggcagaagacaagcagtaacgaaaatcagagctgaactgagggaaatagaaaatgaaaactcattcaaaagatcaacaaatacagaagttggttttttgaaaaaattaagattgataagctgctagctagactaataagaaaagagagaagagccaaataaacacaattagaaatgatgaagaggctgttaccactgacctcagataagtgaaaataaccatcagaaactactatgaacacctctttgcacacaaactagaaaacctagaagagatggatacattcctggacacatgtaccctcccaagagtgaaccaggaagaaattgattccctgaaagggaccaataacgagcttcaaaattgaatcagtaataaatggcctaccaaccaaaaaaagcccaggaccagatgagttcacagccaaattctaccagatatacaaagaatagctggtactgttcctaccaaaactattctaaaaaattgaggaggagaaactccttcccaactcattctatgaggtcagcatcatcctaataacaaaacctggcagagacacaacaaaagaaaacttcaggccaatatccttgatgaacatcgatgcaagaatcctcagtaaaatactggcaaactgatactagcagcacatcaaaaagctaatctaccacgatcaagtcagcttagtcctcggaatgcaaagttgattcaacatatgcaagtcaataaatgtgattcattacataaatagaactaaagataaaaaccacatgattatctcaatagatgcagaaaaggcttttgataaaattcaacatccctttgtgttaaagactctcaaaactaggtattgaaggaacatatatcaaaataatagctatcgatgacaaaccacagccaacatcatatcgaatgggcaaaagctggaagcattccctttgaaaaccggcacaagacaaggatgccctttctcaccactcctatttaacttagtgttggaagtcctggccagagcaatcaggcaagagaaagaaataaagcgcatccaaataggaagagaggaagtcagtttatccctgtttgtagacgacatgatcctaatctaaaataccccatagtctcagcccaaaagctcctgcagctgataaataacttcagcaaagttttaggatacaaaatcaatgtgtaaaaatcactaacattcctatacaccaacaaaagccaatccgagagccaaatgaggaacacaatcccatttataattgccccaaaaataataaaatacctaggaatacagctaaccagggaggtgaaagatctatatgatgaaaactgcaaaacactgctcaaagaaatcagagatgacacaaacaagtggagaaacattccagtgcttgtgaataggaaaaacaaatatcattaaaatgccatactgcccaaagcaatttacagattcagtgctattcctatcaaaccaccaatgacattcttcacagaacttgaaaaaactttttaaaaattcatatgaaaccaaaaagtctgaatagccaaggcaatcctaagccaaaagaacaaagctggaagcatcatgctacctgactccaagctatactgcagggctataataaccaaaacagcatggtactggtaaaaaaaaaaaaaaaaaaaaagcaggcatgtagactaatggaacagaatagataacccagaaacaaggccacacacctgcaactatctcatctttggcaaaactgaccaaaaaaagcgatgaggaagactccctattcaataaatggtgctggaataactggctagccatatgcagaagactgaagctggacccctttcttacaccatatacaaaaatcaactcaagatgagttgaagacttaaatgtaaaactcaaaactatagaaaccctgaaggacaacataggcaataccttcctgaacataggaactggcaaagatttcatgacaaagccaccaaaagcaattacaacaaaagcaaaagttgacaaatgagatctaattaaacaagagcttctgcacagcaaaaggaactatcaacagagtaaacagacagcctacagaatgggagaaaatatttgcaaactgtgcatctgacaaaggtctaatatccagcatctctaaggaacttaaatttacaagaaaaaaacaaaacaaccccattaaaaagtgggcaaaggacacgaacaggcacatttcaaaaaacatacatgtagccaacaagcatatgaaaaaaagttcaacatcagtgatcattagaggaatgcaaatcaaaatcacaagatagcatctcacaccagtcagagtggctattattaaaaagtcaaaaaataacatgctggcaaggttgtggagaaaagggaacacttatacactggtggtaggaatgtaaattagttcaacctttgtgaaaagcagtatggcaattcctcaaagagctagtggcagaaggaccattcaacccagcaatcccattaccgggtatatacccagaggactataaatcattctgccataaagaaacatgcatgtgtaaattcattgcagcactattcacagtagcaaagacatggaatcaacctaaatgcccatcagtgacagactaaataaaatgttgtatatgtatacagtggaatactatgcggccataaaaaggaatgagatcatgcttttttctggaacatggatggagctggaggctattatccttcacatactgttgcggggacaggaaatcaaatactgcatgttctcatttataagtgggagctaagtgatgaaaactcatgaacatgaagaagggaacaacagacactgcggcctatgggaagttgaagggtgaagggtgggaggagggagaggagcaggaagaataactattgggtactagaattcgtacctgggtgagaaaataatctgtacaacaaactcctgtgccatgagtttacctatgtaacaaacctgcacatataccccaaacctaaaatataagttagaaaaattataataaaaataatgcaaaagaaaagagtaggctattctgcctctccatttttaaaagctagtaaaagctaaaaacaaggctatatgtattttcttaattgggtttattggactaaagacatgtatttcaattccatttcatattttgcttttgttacaggatcctcatgcggaagaatttgaagacaaagagtggacatttgtcatagaaaatgtaagctaatggcaaattccttcacctttcacattttcaactttatatatgcattattaaggtacattggcattttggtggtaggaaaaatgttgccttaagaaaattaaatagtgatttgtagcttttagaatgtttttaatgaaatgatagccagtaacaaaattatttgtaagaaatgcttttattaacactgtaagtcttcaatactaaattgtatgtatgtttgtatgtatgcgtgtgtatatgtgtattatatatataaaaaatatatatatatattctgtttggggtttaagggcaagcccatgtcttactcatctttttatctgtcagcatctagcatagtgcttatcacatagcagatactcatctaaacatgtgttggatggaaccatgaatgacctttgaaatctttaaaaataaagtatgtgggctgggtgtggtggctcatgcctgtatcccagcactttgggaggctgaggtaggcagatcacctgagatcaggagtttgtgaccggcctggccaaagtggtgaaaccctgtctctactaaaaatacagaaaatagctgggcgtcatggcgggcatctgtagtcccagctacttgggaggctgaggcaggagaatcgctggaacccgggaggcagaggttgcagtgagccgagattgtgccatttcactccagcctgggtgacaagagtgaaactccatcaagaaagaaagagagcaagagagagaaagaaggaaagaaaaagagagaaagagagaaagggaggaagggggaaaggaggaagggagggagggagggaggaagaaagagagaaggagagaaagagaaggaaggaaggaagggcggggctttaactgtttatttgggttgagagatcctagattggtaccttaataatcatcttaagttaatttacatgttgtggaatcccaagtgactagaaggcatatagtaggtattcaataaatgttcatttactgggaattaaagaagacagcccatccaaatatagtgattaataatgtaggcttggaattcttggaaaatctgtcaaataagggagtggacataggatgaaatggaaaatatgttaacattccttctctccaaacatttattaatatattagattcacagaaatctaatgaaaataatacagatgacaggagtcaggtaaacctgatttcaagtcctgtctcttctacttacaagctctgtgatcactgggaaatttcttaaattctcagtcatacaattatagggttgcttgaagattaaataattttcagtgaatattagcttttaccattgccatcatcatcatgactgttcatcgtgataattgttaaagttctaaaatgtctttataacaggcttatcacatgctttgtgtaatattcttcctttctatgcctgactttggtatgtatctcagtgacaaaaggaattttttgtttattccctggcagtaactgggccatgtttaggactaaagagctgagaagtttggtagtgagatcaggtccattatagatttactttcatattatgaagttatgagatttcagaaggattgtgaaattgctatattcttaatgcatgggaaagagcacagatgtacatgttatgaccaaagcatttgaaatacattaactcaagagaatacactaatttatatactctaaattagggcaactgtcataaattatgaactatatcaaaaggatgagtttatgtaattaaaccgaaacgagacaaacaaaacaaaggaagtgctatattctcacctggaagatagacgagaatggggtagatctccctcttcagttttcaggaggacattaatttctttctgccaatatcaactcctgtatagtgagatttgagaataatttttttttctctgtctaggtgtattaactctttttacctgctctggaaaatctaggccagttttctgagatgtgtacaggacccctacttgcataagtagatttaacgagggaaaagttttatttcattcatctctgtatctaccacaatttttttttcaaaccatactacctttggggtagtagcttctcaataaatatttattgaaggagtgagtgaatgaatggtatagttaaactctgtgaactgttataaatcctgtaaggattattctttttaagagaaaaatacctgtaatcccagcactttgagaggccaaggcaggcagattgcctgaggtcgggagttcgagcccagtctggccaacatggtgaaaccccatctttactaaaaatacaaaacaattagttgggcttggtggcgtgcgcctgtaatcccagctactcgggagactgaggcaggagaattgcttgaaccagggagatggaggttgcagtgagccgagatcgcgccactgcactccaacctaggtgatacagcaagactccatctcaaaaaaaaaaaaaaaaaaaaaaaaaaaaaaaaaaagagagagagaagaataacgtgagtaacatccatcaactatacagaagaaaatttgaaaagtagaccctagaggcagtaaaacagcatgtgaaggatccatatgctgttacagtaggagctcttctgatcaactttattgaacttgcataagccaatctcatgagatttgtctgtattaccatctgtgggattaaatattcttaggctgggcatagtctctcacacctgtaatcccagcactttgggaggccaaggcgggtggatcacttgaggtcaggagttggagaccattctggccaacatggtgaaacagcgtctctactaaaaatacaaaaattagccaggtatggtggtgcatgactgtaatcccagctactcaggaggctgaggctgaaaaatcacttaaacctgggaggcagaggttgcagtgagccaagatcgtgctactgcactccagcctgagcgacagagcaagactctgtctcaaaaagaaaaaaaaaaaaaagagagaaaagaaaggaagaaagaaatgttcttagacattttctttaaaccaaaatttgatataagtagacgttgcatttttcaagtattagcagtttgctttacttgacataatctaatgagagatttttaaccttttaaatagatgattcagtattcattcattcagcacttaagtattcattgagcgtgtattatgtgctagatactgttctaggcattggaaatggtggtgtataaaacatatgattcaagaccagcctgggcaacacaaaggagactcagtctacaaaaaaataaaaaaaattaactggacgtggtggcatatgcttgtggtcctgactgttcaggaggctgaggtgggaggattgcttgagcccagaaggtcaaggctgcagtgagctgtgatcgtgacactgcactccagcctggatgactaagtgaaaccctgtctcaaacaaaacaaaacaaaaaaaaccagataacaagttaacaaatctcatcgctgtgtagtttacactcatatgtgtgtgtgtgagagagaggataaaaattactgtatgaaagatttagtatgttagataaaataaatacataatgtatgctaaatatatatagtaggttacataaatgctctatggagaaaaaaggaagagggataaggatcccccgtctttatgattacatagttataatgagccaccttattatttctaaagtctccaaaagagaattggggtatgcttgtcaaatttatttaaaatatattttaataagagagttgatgaaatgaatattgtaaggtatgggaaagttttaaaataaccttggcattctatatataaacctctcctaggttatagctcccctcagtggtgaatgatgaaattgacttttgctgatcattatgtagcaataacatgttacaatgttatactttcccttacattttaatgtgctttcacatttcatgcaaaagaattagtgaatttcaaagagctaaagttcttctctttgtcttgtaaaacctcggttttgttagaaattctgttggtatattgtcctgacactgaaaaggtatgctctttgaatggaattgtaatacctttcttttctttgcacattgtgttacaaccccacagttaataaagaaatgttgagactttaaccgtaatgtccagtagtagcattagtaacaaagagtgaagttatatttaatataaaatatcccaataaaacagaagtctccaaatatatatcactgtaacaaatttattggacccttactatgtaccaggtactatgtataatagaatgctttatacacattatctcatttgctcattataataactctggtgtgagtcagatataaccctattttacaggtaaagaaagtgaggtttagagaggttaagtaacttgcccacagttatatagctaacaggttgggattttatccagtcttgtctttctccagggcctttgcccttaacccctactgcaataactagctaccttaataagaaagatgaaaagagatcatttgaaattgtagaatcatagggaagcttttaatcagtcttctgtagtggtaagtctgtgaagaatatatgtatcagattagtgaaggtagtctttaattattgtttatatacagtttagaagttatttgggttaattatttcactactgttagacattataaaatggaattctagaatttatcagtcactagaattcttaatattttttctcaaggcaaccttactgcttctttgtgcaaattgacataatgctattttcattttattggttctcttgtttctgatttctccgttttgtctgagctttcttctttggaccagaaactttagagttgaaattttagaggtggttctgccacttactggctatgcaaccttagataagtcatttaatatttcacagcttccatgtagtcatgtataaaatgatggtattaatatctactccacaggttattgaagattggaaataatgtatgtaaagcatctagcttggtaaggagtagctatttttataatgttcctttctagaggacacagaagaatataaaggaaagaaaactagatttctaaattttattgttgcaggattttagtttttccattcctttctaccacttacacctctcaatgatttctagactttactgttatctcaaagcaatgacaaggcaacttgtaacatctcacttggactaaacttaaaatatttttctttttatcttttgatttaggatatcttccccttataaatttaatctaggattaacaacaagtatttcttttggatcatttacaatccatttacttattagtgtagataagaatggatactataaaacactatgtttcatttttatctactgtaatagaataacatctgttcatccagacagttgacattgtagggttttttaaaaatatgaagccacaacagttatatttaggaaacaaaattttttttctcttcctggtgttttagattacccaattaaatccagaaccattacatttgtaaattatatccataggttttagtttcttgtttttacatttgagacaaggtcttgctctgtcacccaggctagagtgcagtgttgtgatcatggctcactgcaaccttgaactcctgggctcaagcgatcgtcctgcctcagcctccccagtagctgagactacaggtgcacaccattataccttgctaattttctattttgtagagacggagtctccctttgttgactaggctgttttgaaccgctgagctcaagcagtactcccacctcggcctcccagagtgttgagattacaggcatgagctaccacacccagctggtgttggtttttaaaatctaaaaaaatttatttttctgattccactgttttattttaatacattaaaagcatattgatgaaaggcaccaatcagattgaatccattcattaatttattcaaccattctgcaatattttaatatggattttctatatgcccagacatttggtggttattgaagatacaaagtcagttaagacatgcagaattttgattctgagattcatggttttttctcccacatttttttctgtgaaattgggatcatcttatatctaggatgtcccacagttataactggtagttttttgtttgtttgtttgttttgctttcttactgctatataaaataatgactgctatataaaataatctttaaaccaatgataacttatatttgatgacataagataacctgtcctcaagaagcttataaagtagtgaagtgtcagagaggtaaagaactgcaaggaaaaacataaaaatgttcgtagggtactacaggacagtaatggagggcagagttggaataattcctggaggaagtggctacagagtttagtcttgaaggaaaaaggaagttaggcaaaaaaggcattctaagtagcggaaagaaatagcaaaagtaactgaaagaggaaaaacaaaaccaacagaaaacatgagctcccccattaaagattaatagacatctgctttttgttttgtaactgttaacccaatgaatgtaataataggcataagattaacttggttcttcgtcctccgtgaagatcagtggggtatcaaaatgtgttttcttggtgctacctattcactatgcagtctttcccactatttctgactgtgacccatgagataggaagttcggctcctccagggctccactagtcccttttttattgctgtttgtttgatgttacctccggaagacttttaagtgaatggcgatgggctaaattaattatgttaattccaaggcagatggctggacctggtagcacacgcctgaatcttaacactttgggagcccgaggtggaagtattgcttgagctcaggagttcaagaccaccatgggcaatataatatagtgagaccttttctctacaaaatgtcaaaaaatagctgggctatggtgatgcatgcttgtagacccaactacttgggaggctgaggcaagaggattggttgagcctgggaggttgagactgtaatgagctctcattgcgccactgtactccagcctgggcgacagagtgagaccctgtcaaaaaaaaaaaaaaaaaaatccaaggcagtagtgtaaatgcttctctgctttgtttcttttgttggattatgttgaacaggattacttgcccaaccaaactcacctgacaagattataccaagaacagagatgatataatagctcaaataatacaatgtaaacaatataaaatcacaatgtttctgaccttattaaatttaagtttaaatccttctccaaaatgaagtcaatctcttgatctcgcaaaataacaattctgataaattacttctactttttctttcagagaaaaaaagtatataaatgctgcttctctcctttagttgtttttttttctgtgtcacctcaatcaaggcatctcacttcaatgtctggggaaagactggatatctttttcagaaactgtagcttgcactttctcctgtagctccaaactgggattatcttttcagccccaagcatttcaagaatacatttccaaaggtctaaagagtgtctagtgcatatgagaataccacatcgcaaacattagcagtacccctcttccaccatggagtcagtttataatctaactatcagtagagatggctcagcctttttagggtacggcagcatttaccttagtatagtcctgtttatagcattccatttaatgttccaccccctctggaaatgtggcccagttaacttacttgaacctaatcaaatttccactaggcagcatactccactttttgttcttctattaatccaataattaagaatggtttagtcagtaatgcccatttatctgtatttgttagtattatatactatttatatatacagtaaacttttatttttcctgtagttcattcaactttgtgtggagggaaaccagtcctttccttaccctattgactgcagtttcgtcaaggaagaaagtgaattctctcactcttgctgaatggcaagaaaattcatgtgcttatggctacttgctcagagagtattgttctacacagcactaaccagaatacatttgaatgataaatcaaagatccctgtattgttagatctcttttaggccattcttttggtataaacttctcaaccatgttcttttcttacagtcccagagtcttaaacccttttggatttctaaatatttcggaaatttgaaagcaatgtatagaggacccctgctcatcttgtctttcatacaaatgtagcaatttggataaatctaatcaagatccagtgttttatttttagtttcaacttaacttttttggttatttttcaaatatgcacaaaaatagaagaaataatatactaaacctctaagtacacgtctcccggctcaataatcttcagtatttttttcaaacttatttcatcaattcttctacttttctgttgtttgctttaccagatttaaagtacatttcagatattatatcatttcttctataaataatgaagtccacttgaacatcatcagcttaagaacgtggttaagagttactggcatgtcagaaaaggtgacctaccagcaaataatttttttttaacttaactgccttttagatgatctctctgacctgttaggctgcacattcaatattatcttgattcttaaaaagtgatattattcttgtttctacaaagaaaaaaaaattgactatataagaagcaacaaagcttctcttataaccccctcagaattaaactcctgaattaacaggaggaagctcatggttcagacaggcttttttagtcttttaattatcctgtcaactttctgttgtatatgattatgggaatgatgactggctgtctgtaaattaggcggggtataatagatatgactaggagctaaatgaaaaatttttagctaactaaatcttactttggttgcatttcagagaaatttcatatatatatatctctcctccttagtttcccttaatgttaagtatttaatgtgctgttctaattcagaaatttttcagattgtgcttctagaggaaaaatcccatctcctttattctcaaatgatcctttaactttaaataaaataatggagaaacttttgttgcacttaaaaaaagaggtatgcctaagaatgatcatgcatgctttgagcctgtcaactatactgtatttatctttgtgtaatgcaagaaactctatgttaaaatagtgaataaaaattacatgccagataatttatttcacatagcagtttaatttgtgaaatgtcctagctaacacattttaagggaaagttccattttttagcaacagagtactgttttcatactattacagtgttcttgttttctggttctgtttttctgagttttgtccctgttcagtatttggagattattcgtctttattgacattgatcatacattacagatcaagtactgcaatagtataaaaattcacatgattacttattactcataattgcttatttatccaaccagtatttaataaatagatatcatgtgacagatacttgctacatactgagagtgtaatggtgaaaaaggtgtggtctctgacttccagtatcctacagtctggagtggggaaacaggcaaccactatgaagattaagtttaggatgttttatgttcccatataaagagtacttaatgcagtcttggtgggttaggggaggctttctattgaaagtgatatataaattgaaaccctaaaaagtaaagtttttacaatcctttttctgtaacttcaaaatccaaaatctctacctaagatgtttataattttttatttttttggaaatttgattcaaattcatttggtggcaaaacctgaccttacccaaaatgaagctattcgtggtatttattccacttagtgtaaatgtttattcattttgctgcaaaaataatatgtttgattatttagtcagactgcctcagacttcactgggagtgtgctgtagtatatatatggtaaaggcattgtatttccttcctaaaatccaaatgagagatttcagataggagattaagtacttttgatagttgtctgcattggatttgtagggtgattcaggtggctggagcagcttgagcagaggtctggaggcaagagaggcttctttgtgcaacagcatgtcgttcactagattactttcttttatatttcactttttaaagagtggttgatttttctagggttataataacttaaccatatgttaagttacttttctttctaaaattacttaggccagtgtgatgttaactttaagatcttgcttcacctgcctcttaaaataaaaataagctatatcagctgatcagttaataacttcataaatcataaatgatacttgatatgttttgttagagaaaacaaagcattttcaaataaaatgggatatttcatctttatgaagcatttctaaagtggatgttattataattttactcagtgagattaagtgacacgcccaagaacacacagaaagcagcttagcctggcctcaaacccatgtcttcaaactctgaaacccatgcattttaccatttactcactcactcaatcatcaaacatttattgtcctaggcactagatttagagcctagtgctatattaactactatggaggatacaagagaacacctccactcagatattaattttggtttgagggatacgcgtgtgagacaagagtaaggtgatatgtactatggtaaatgtataatgatagctgaaaagtacaatagagattagagatagaccagttaatatggactgaaattatcaacaatgttttaagtgtagcttttcagacatggctatgtgtattcctagaggtatctgacagtttctatctttctgtattgtaagtttttttctcggataaaactagtagtagttgtattggtttgttctcacactgctaataaagacatacctgagactgggtaatttataatataaagaaaagaggtttaattgacccacagttccgtatggctggggaggcctcaggaaacttacagtcatagtggaaggcacctcttcacagggtagcaggagacagaatgaatgccaagcaaagggggtaagccccttgtaaaaccatcagatctcctgagaactcataagaacagtatgggggaaactgcccccataattcagttatctccacctggtcctacccttgacgtgtggagattattacaattcaagataagatttgggtggggacacagccaaaccatatcattcagtccctggcccctcccatatctcatgtcttcacgtttcaaaacaaaatcatgccttcccaacagtcccccaaagtcttaactcattccagcattaaccaaaagtctaagtccaaagttttatccgagacaaggcaagtcccttccacctatgagcctgtaaaattaaaagcaagttagttacttctcagatacaatgggggtgtgggcgttgggtaaatacacccattcctaatgggagaaattgaccaaaacaaaggggatacaggccatatgcaagtccaaaatccaacagggcagtcattaaaccttaaagttccaaaatgatctcctttgatgccatatctcacagctaggtcacgctgatgcaagaggtggcactcacagacttgggcagctccacctctgtggctctgcagggtacagcccccctcctggctgctttcacgggctgtcatttagtgtctgtggcttttccaggtgcacagtgcaacctctcagtggatctaccattctggagtctgaaagatggtggacctcttctcacagctccactaggcagtgccccagtggggactctgtgtaggggctccaacctgacacttcccttccacacagccctagcagagtttccccatgagggctctgcccctgcagcaaacttctatctggacatccaggcctttgtatacatcctctgaaatctaggtggaggtttctaatcctgagttcttgacttctgtgcattcacaggcccaacaccacgtagaagctgccaaggcttggggcttgcaccctctgaagcaatggcttaagctgtatgttggccccttttagcccttgctcaagtggctgggacacagggcaccaagtcccaaggctgcacacagcaggggagccctggacctggctcaggaaaccatttttcccttccaggcctcctggcctgtgatgggaggggctgctgtgaaggtctctgacatgaactggggacattttccccattgtcttggtgactaacattagtctcctcattacttatgcaaatttctgcagttggcttgaatttctgcccagaaaatggggttttcttttttatcacattgtcaggctgtaaattttccaaatgttttgctctgcttcctcctgaatgctttgctgcttagaaatttcctctgctggataccctaaatcatctctttcaagttcaaagttccacagatctctggggcaggatgaatttagaaataaatcagccttaataactttgaagaatttcccctttacccttaaaattaggaaaaatttagaaaagtggtcaaatgacatgaaatggatataaaactactaattaaatcactaaaaatcatgatgtatttactttatattaaatcttttcagccaaagcaattaacaatatatgtttcctacctcttttgatattttccaaaatcacattttttcttttcaaactgaagaagagaaagattgaatttttttataaaggagaccattgttctacttaatttgggtcacagaatgattgttttttggatttcattatcctgggtactgtgatattggttatacatttacttcctaacattggggatatgaataagacaaagtttcacctgcatgtagttctcaatctagtcagagaggcagatctgtaagcaaatcatcgaaatatagtgaggatgctaaagaggcaggtggcaggccccttgaagacgtccaggagtactcatatctatcaggggcatgggaaaggctttatggagcagttgccacatgaacttgaaagacttttaaaagttcactcaccagataattgtgtgaagagaatggggtctgaggtaagcacagagggaatagccttggtaaaggcacagagataaaattgttacagctttatacccaaagtgaggagagtactaggggttgaagctatcaacatgagcccttactcatcttgggtaagactatggatggccttgtgtgccataccgaggaatttgaactttatcctagcagcctgtggatcccaaacttggctgcctatgagaatcacttctggactatgaaaacatatagatttgcccactggaccctctatgattctgattcatcattccagtaagctatcaggaagcatggaaaagttttaagcagagtgataatatggtcagatttgtatttttaaataatcagtttttacctttcaaacttttttttactgtagctgtaagaaatacattttatattatgatctagtatacacatatatgtacctgtgaacaactgaaacaagtcttactcttacaagtattgtgggatgtactgtggtattttctgttctatcctgatgttttagaatgctgtttgcaaaccgcttaattgactttgcaacccattaaaatgaattcaccatccactaatggatcataacccacagtttaaaaaagatatttctatagagaatgaattgaaatgtgcaaaactgaaggacttgagatcagataggcaactgattcagttatccaagtaacagatgtcatgggcgtgaactgggacagtggccttagcaggtgcagacagagaagaggcgaaaaagattcagaagtgtgtagaaggtagtggaatcacttcttagtgactcatttcaagggctaagggaggtcagagagtgtagggtgacttccagatttctagtttgaatgtttagataatttgctcttagtcagtatagagaacacaaaggaagaattggtaggagtgggttgtggcgggggaaagatatccagaaggcagttggatatatcagtgatttttttccaagtgagattcctttaaattttattttctttttcttattaaaatatatattttaaggccctgtattctccttcacctttcttatacaacctactttttcttacattggtttctagtgtttttatgtggattgccctaaaatatttttaaactttctgcttatgctgtaaactactgtaataccattccagtcttttccaggacatatataactccttgcccaaatgaaacttacgaaacttttttttttctttctgaaccacatcatcctttcctcatccatcagaggtagtgatctcatttttctgacctttctgcgtgttgttccattttgtatttccagctttgtgggcattagttgtctactgcattcccgtatgtaaccaactaaacattgttataagcagtgcagcaatgcttgctggaacttgataattttctgccacttgtgattcagttaaatagatcagattatagtcatattagggtttggctgggcagttctggctttgaaatctctcatgcagttgtagtctgaggtggttggggtagaacatgaggggaggaaggactggagcccatgagatggaccctggcatttcatgtggtatcaaggcctctccatttcctctctttcagtgggttagtgtggatttttttcaaggcagttggattactttcatggcagctaaagacttcaagaatgactattctagctctcccagtgtaagttgcatcaccttcttgacctagccttgccacatagtgttacttcatcattttatgttagctgtaagccaatcacaaacctgccgtggttcaaaggggaggggaattagactctacctcttgattgggaagtggtaaggctctagaagaaaatgtgggatgagaaatatttttgtaggcaatctgcaatagctatgtagaaaatatatcaatgtcatcatacagatttttagttttgcctggagtttgctactgtgttcgtactgcaccttgaatcttaaagattaagttagcttttatgatttaatttttcacatcttgtttaatttctgaacttggataatttgctttctccgcagcagaattaagtatatagttatgaagatgctttaagcctatgtgttaggtttcactggtacaggacagttgcaggcagcagcagtttggccagctctgcagagtgggcaattttgaattgcatgttatcttgtgtgttttctaagagcagttcttgattcctgtcttcaaaactctaagggacccctgtagcctgttgagtagactgctgaaagttttaaataactgaaaatacgttctcactttaactgctatgttccttgttagaccgcaggcatggctgtatgacataaaccaaatattactggctgtatttcatagccttgcaagttttcattagcaataggaaatgaatctgacaagacgctgtctttctttaagtatgtgcactattattgcttattttcagaaataagctcctatcagtatagtcatgatttttgactgataaagtttagttcccagttctgctgccgtgcttgaattatacttaataaatatcatttgataatctgctgacataaatactaattttaacaatggttctaaagttatattttataaatatactatgcaggaaaagaaatccctgaggatagaaaatacaaaacaacaattaatatggatactcctgttgcccctcctgcaccaccccacactgcaccgctgccccccccccccacccccttgctccattaatgtgttctttcatagaggcgtggcaagtttgtctatattgaagaaagcctatctggaatagtcatttagtgtaatgctgtttagagtattataaccacttgatggcaccctttgatttggtacaaacctcattagccatagcacagtgcagcatagtagttgtaatggaataacacataagaactaaagactgcaaggtatctggttaatgtagagatgaaatgaatgcaatagcaaggctaagctttcctgacccttcatgaaagaatagatgaaaaaaggaagaataagctattgtgccaaagggagatgatgaaattcaagatccacacacataatctctggctcagcctctgaaatgttaatccctgggtagaattatttgagctatagattgcaatttatcatcaaaatggcactgtgtcaaacaatactttttatatgtgtggtgtttagaactatccaattttaatataaaatggttcacagagcactggctaatatttaagtagcaactctttaaggttgtgatttgggggaatggagtaggatggtttctttacatcaaaatatgaattgtgttttagatagaaggctttgggagaatttttttctttttctcagtgacagtttatttttaatgccaggaaaagggatttttaaagaatgcctcttttaaattaagtggtttagaattgttttctttcatagacaaatgatgtttttgtaattatacaataattctgtaattttttctaacattgcttaaaaatatgctagctgatgaaatgttatatatttaaaggtttatgtggtctttcctattccaatataaaatatttgtatgttttctcttatttaaatcacccaacttctgcccactagggagtggagtcataattcgtatgtgttgtgatgttttttcccttaaaaccaaattcttccaattaaaagaactaaactttgatagtataggtggaggggtgggtattgcatatgtctattaatctgtcactctgagtaatactcatgttatggacttttcctgtgtaccaaaaaaaaaaccctgttgttattttctagaaaattaggaaacttaaaataaccctgtttctggaatctagaagcttgaaattccagtttaactatatatttttcctttaaactttatcatactaatttataagaggctttttttgcctcctttcacttaagaaaagcaattattttctgttattactaagaaattattttacttaattttgtttttatattcttcttacctgtttctgaaggtttgccaataagcttgatctttaacagaaacctatatttaatttacacctaatagatcataccattccagtaccttcattactaattgcagatgttgaaggcatgctgtgaccctgttagatgtattagatgctgtagcacaaatctatgaaacgccactcatctgtgcatgaataattctgtgttaccatattttagctctggtgggaaaaatatttgatttactggtggtagggaacatgagaggagtcactgtgaaaagcatatgtcctgtgaaaatgtcttgtctttggcagctgtcttcttttagtgatcatgaagagttaaaccttagatccagagtcacacctatggagactagaagttgtgcatgtttgagatattgctggccctttataatacccagtcatcaagaacagatagtatggagtagtcttttggctgttgccattaataagagtgctctgtgagactgcatagccatttcaaattgtttttggaggcaaagggttcagaatgtacattaggaagacacaaacacatatatatgtagtagaaaaagaccttggaattcctaacttggtaaaatattacaaagttgcttcatctatttacgtaattacatctgctgacgttttaatttaaatgccacctagaaagttgatagagttaagtttagctgagtgttttaaaaatgtgactttctcaactatgtaacacttctccacccacccacccaccaaaaggcctactccctgctttctgtttctgaggacagaatgttataaaggacggttagtgcctcaaacgtgcacaacctctgatcttcagaggtctggctctggatttaattcttaactattcatgatcacttaaagatgacagctgccaaagtcaagatttcagtaaccttttaagtaagctcctggttccacacggagtgccaatgcatacatcttccaacccactgcactggcagtctcatacccaatgctgaatacagtgttccagcctggtgcctttcagcacacacaaaactgatcaatgtccaattttatccaaccacccacactaaatatgaaacctcgtgatgctgtcacagatgcctgcagggtagcactcctgcaaattttaaaaaacatgagattgttaaaacaactaggaaaaacccctttctgatgccagttacctaaaacttacttgtttttgaagtagcacctttagttttctatatgatgtcagcgaatataatttgttgagaaaaatgtttcttacacattgtttttccacatcctcctagttttataggccttattaaatagtttcagtgagccagtctttgaaataaagcccaggtgaatatttatatttccactgtagcagcagcatgcattcttgatgattgacctttaccctgacataatgtcgtcttgtgacattgaatgaaataaatgaagaaactagtccttggcttgatttgtattggcagaagaaagcaaacagagtggtttgtcaggttgctaaaaacgtcaaaatacagttctgggacaatttctaacacaaaggttttttgttgtttgttttgttttgttttttaaataatgtgtgggtggttggatgttctttgaaaaaagcacacatttgaaaggaaattgaattccagcagtacctgtatcagataataataggaagtaaattgtttccctttatttgaagttgcattttattagtcagatgcttgttggtggcatgtttaaacattaaacatttagagaactgcacagctttacagaaaatagtgttactttatataaggattatgtattattaaaagaaataaggctctactcctataaacacttgttgtgttgtaactttagtaatcattaattttaaataattttcgtttctacatgtaagttatacacggtataacagaactccatttgaaaagtaaggtctaaaatatttttgtgtaattctcttgttactttatagattttggctttgcagacaagttgactatttccacaagaggtacccatcaatgaaatatcctgttttgtagatgttagtgtttataccattattaaatgagtacaaccctattcaattattgtctcttgtgttttatcttgaaagcattgctttcaggcagttaatctatttcaaattagtgttgtaatatttttgttgttttaagttataactcactattatgttattccataaccttaaaacctagtttcccaatatagatgtgggtttctggattaaaataatcaaatcacagaaatttagagctagaagaaaacttagaaatcataaaattctccttgctcattttcagataaggaaactaagatatcatctggtaactagcccaaagtcatattgctaatgagtggtaaactattcattttcattcattttcttcactcccagactgaggttctatataccaactttaagtagtacatgtatgtgataacatgcttttaaatgtttgctttttatgcttcttcaaatagttctagaaaaattgaattttttaaagaaaaaaaccatttgtaatgaaaggtttttaagataaacatcagttttactgaggtagataatttgatagtatttaaagaaaataagaccaaaacagccagcagccatatctggcttattcatttaagttcaatgcatgtgattccctgcttcagatcatgtgctgcatatactagctacattttaaaatctaaaatcccacttaatcatacactttgctaatatttttggaaaatacatttttgaataatataagaacattttagtttcattttaaaagatggttattataaagttttaaattctgtaatcgagtgaaaaatatctgacgttaaaagttttaaaaataaaaaataggttatgatgtcaagtttgttaggtaacaaagtttgattaaactttccaagagaaaaattttaatgatgttttaaatacctgtaagaggctactttaagttttctttatagaatgattacaatatatagttttatatttacaaattagtaaaataaggaagtgtagcaatataatttagtcaagaatactgcccaaatgttatttagtaatatttataatggtagtttagatatctagagattgctttaaaacagggttatttttaatgttaatgtataaatttccatcctggccaaaaaataacactcagcagcaatacttgttctcttcatatcgctaattaattagaagtttgctcataaagtgtttcagaatttctgaatacagttgtgttatactcagccttcttgccatccagatacaacattagacactttgttatatataggttaaacttggattaatattggtttacaagtactacttacagttatttcagacctctgcatctacttttaaggtatgtcagttgatacagttaattaaagtactacatatgctgctgtctaagccaatttaaatagtagggaatgtatttccagttatgtgagctacagaatgatggtactataacatgagatctccccctctaagccagtaatgttctacagtccagatatattagtgcctttcttttctcttctttttaaatagctgcttcttgtggagcagggctaactcctaggcagtgagcccagagtcagatgtattagtggttcatattctcgttttcaaaacatcttgtcttttttgtttagttttggaatggcagaaatctaactacataattgatttctgcacttagaagaatgctttacaaatagtagatcctcaatgatgtttgataaacgaactcatcacttatttatatactatatttatggatttttaaaaaatttgaccttactcagctatttaatttttcatgtgatagtcttgtatctctctgctaattttaggctgctacttaaagtttgaaagggtgtgtctttttgtacactcaaacaatacccagcaagatgctatgtgtttataaataccccaataaatgggtgtgtatccaattgatttcactctcagtatacttagagtgagatatttaagtgctgcttacctacagtgttattagttttatgactgaagaagacatctattgtaacagattctgtgaattagatgtcaggaatagtatgcaaataaaattgataggttttttttttgttctttagacttattttttattagcacttagtgtatctttaaaaattttaatatttattacacagccaacataatgacaatgctacgtatattaaaaaggaaaattatctataattccatcatatcaataaattgattttaatttagcatttttctttcgaacatatacatgttgtataatttttttagggtgctatttgtttgcatttagggtagattaagttcataaattcattaatgttattacatttcttattttaaaagatgccttatgcctaggtcatatgagtgcttttagaactgatatttttggataggtataaaagatcaatgtgtttattaactaaacatatccacaatgattgactttttttcaaccactcacaaaactgctttgcaggtgtgagctttgaggggacctccatttccgctgcagtgactctcactttggaatttactccagagacagcttgaactagtgaaaatctatagggctttggattattatacaaaacccatcattcacccagtcttttgcaatggtcatgttgattcaaggacagtttttgtgactaggttcagcgttgagtttggaagtagatttcagtgcatatatgtcaacaagtagatcatataaaatgaaagtgatgactaggggtgtgtgtggtaaaaatgaaataaagttgaagggaaccacctgggattgctcaatttaatttggtggaatggtcttattacctttcaggatattaaaaagaataagtctaaattggcagtgattcttattttgtaaataatagctctatgctgcatatgatctacgaaataaagaaaagagaaatggaaaacactaagtgtctttattctccaatggggaaaaatacaagagaggtataatttaactccaatagaaataaacaatggttgccaaacatgtgttaagaaggaggaaaaataagaggaaaaggaatctgtttttatgtcagaggaactatctgtgaagttaaggcctggatttgaagtcttacttgatatagttttgtacacaagtcttagaatgtccagatcatatgtggccagtatttcttatctttgctctcctaatttccatcctttgtttaactctttctttataagttgttgtcttcgcaatttaagaataaaacagagagctgagaactgacttcaaatccagccttttcttctcttttctttagtggctggtttctaaataatccacagcattttcccctataaatctttatttttcttcactccactctgtgttggtggacatgattagtgaaaatctactcaaaagtcagtcacaatatggttaaattatattcctggttttgactgcctgcacccttaaatcaaaataggtgttgtgagaaacaaaattgctacaactagtatttcttggtagcttgataaatagttttatttagaaaagtgattttataaaaattatgaaaagatagaatagacagcattttacatttctcactaactcttcttatgtattcatatattaagtaaacttttcttcaaactgaatattgtttttaatcattgtacatgtgaaaagtaaaaacactttaagtgactatgtgtcagattaaatttgggtactactttcaaataccctaaatttgaggaactccttttgcaatataactttttattctgattgctcaaaatttatgttttttaaaaaagtctctatatttaaaaattagataaaataatcatgtttgcttataccatatttactattgaatcttctttaaactttttatcatcttactgaaattaaaatactaaacagataagtcacaaagcctatttttggataaagagagaaaggtattcagcatttttctagtttctaaaaaggtggaaaaactctacacttcaaactacttaaatgtttttattgtttgtgagcctaaaacatgtataaaccctttcttttaccacgtgtgtatttaaataagtaacacttcatatcttctccatataaagtgaaatatttccttaacactaacacaagttggttctcagccaaaccaaatagaagaatgaatgctttgttaatcattcgtaactaatgtgtgtatacacagaaaaaaaaaatcaaatctgtttttgacatgaatcttttgatggaattagcaaaagaaaaaaaaaggaactttttagcacaggtcaagcctcttttaatttatgagcataaaagttatttttaaaaaatcaatacaggcacatggtaacaaatccaacagtatggaagaactcgtaaggaaaattaacattctcctgcctcttccttcctccctccatcctaccccattgtggtagtctcttaattgcttcagattctagttcttcagtggtttcatccatggttctagttttatatattaataatatgattgtactatatttcataattatttcatgatttatcaacttaggcaacatttattgaatctcctattcagattgtacatgggtggctgggagcatttcagaaatttaagtaggtattctctgcttattccctcagtccaactcctttctccataaggttcttaaggcatcagtacagtatagttccactgtacccaccactgttcacactacctctaaaactggctttactctcatgctcttcactgtctatgcttgctctctgattcctttccattttttcccttgttaataatatttgcctctttttgtattaaaattgaataaatcatagattaaagttagggaacttgtatacttttccttttaaaaatatacaaaatgcattttaaaaaacatgtatagcccaaagtaattgtattttgttttgttttaattttccccctgtgggtcagtgttcctggatttcctgcccttccttaatagataatagcctgaagaaaaaatttttgactttaaaaaactgaaaaggcaatcatagtataaattggacttgattttatgctctaagattgtaacattgttctcacagaactctttaatatgaagagaaataataaattttgtaatgtcagacttttctgcccttctgccccttctgcttggttcagctggtcctttctattcttttcctaataaacctctttaatataatttgtccttgcccaccatcttttgctaggagataattccaatttaaaatggtaatcaggataaaaatggagcttggcatttaattttaggactttacttttactagaatacatcagttacttctagagattcctgtactgacttcagtcctttttacagagcttgtttgggactctgcctagaaatatgcataaaactgtgtgacactgcctaagtcttccttttcagcattttatgaattacctttgttaatttatgttactgacaaaattgattgcacctctatggttaagtcagaatttctgccttcaaaataggggtattagattgtggatcaagatgactaggttatcatcaaataggtcaccttttaatacacaataagagctgactagtaatgttttataccttccttttttcatttaaccatatacatggatactttttaagaatgcaagaaatacactctaaaagttttactgtgtcttaattctttccacacataaaacgtaattttgattgttaagattttaaaatgtaaaattttaatcatgaatgcatcctgttttattcaaagttccaatgcagcttaatactttgacttccatagcatataccatttacaaaacacttccatgtatttaatggtactggattctctcaaaaaccctataaataaagcctgtggattgtgtgttgttcattaatggtttaatgaagtttaaatttttatcttaaacacctctttccatgacttctgacttttttttttttttttaaatttctaagaccaaacagaggcagatctttttctttgtctcctaagttctccctcctccgtaggccccctctctggaaacacacacacatatacactgttttaaaacccaatgaataaaagtacagtggttttatcttccctagctcccgtgaaactttggagccctatgaaaggatcctattctgttgttataaagagacaagcatttgggaaaaccttactaaattatttcttttttgtcctatcctgtgaacatatcctgactggtaaaatatgaacatgtagacatcaaatacaaatttctgtttgtttgttttttaaatgttcaaatactgcttacagttctgactcttagctatgcatggcttttgtgtcagattactttgcgtgcagcaacctggtggtagttgttgcttgtattataatttgagcaccaacagcatactggatgccacactagacacatcccagccccacgggcaccagttgattggcagaaagctactcccatagagtggtaataattgcagaaaagcaaaaggaactgaaatgaaatttttatcaatagttaacctgaaataacccttgctagataatgttctccaagtaaaagtctatttaaggctttagttctcaaagatactacctgttagtgtacttatctttgctactgtgttaatgaataaataaaaatacgccaatcaagtgtactgctatagtatgtgaagagccaagttcattgtacacttcaacacaaccttttttacttaataggcaaacttttgcctgttaattgtggatggaggatacccaggcatgagctcttttgggcctgcatctatcttttttaaaaaacaaaaaacaaaaatacaaaactgtaaatgaaaacagtagtagaactgttgataggatttgaattcctatagctatctatgccttgataaacttacagcatgtttaaactttctgggtctaagtttccttcttcatctgtaaacaggggtaatagtaccagccttaactatttaacaaggtgtcaatgcagatcaaataaacaagagtatcaaactaggtaactaaacaaatgataaaaatggccattaactttctaagtgctgtaagatcaaatggagtgaaaatagatcattttttaaaataaggcatatctggaatatatggaaatagggaaggaaatataagtagaattgaaagataatttttgtttcacagaaaaataaaggccgggtgtggtggctcacgcctgtaatcctagcacgttgggaggccgagggaggcggatcacttaacgtcaggagtttgagactaacctggcaattgtggtgaaacccccgtctctactaaaaatacaaaaattagctgagagtggtggcgcatgcctttaatcccaactgctcgggaggctgaagcacgagaatcgcttgaacccaaggggcagaggttgcagtgagctggggttacgccacagcactccagcctgggtgacagagtgagactccgtcaaaaaaaaaaaaagaaagaaatatctgtagaaatctcaattctcttttcctgtagactgttagatacagtcagttgtctgcctctttagagactagtatactagttgtggtggtttaagagtgtaggctctggacatttcctacctgtgtgattctgagaaagtcgatgaacttggcttttacctcaatttacgtatctataaaatgaagataataatacacctatttcatagaatttttgtgcattaacatgtgcttagaacagcgccagacacatggtaaattgtcattgtaatttgtgttttttttatctgacttaagcagtagctagagttatagaaattcatgctataggaaggccgggagcggtggctcaagcctgtaatcccagcactttgggaggccgaggtgggcggatcgcgaggtcaggagttcaagaccagcctggccaacatggtgaaaccctgtctctactaaaaatacaaaaaattagctgggcatggtggcgggcgcctgtagtcccagctactcgagaggctgaggcaggagaatggcgtgaacctgggaggcggagcttgcagtgagccgagatcgtgccactgcacgccagcctgggtgacaaagcaagactccgtctcaaaaaaaaaaaaaaaaaaaaaagaaattcatgctataggaaatgtcacatggtgtctctagtcttttctatatgtgagacatagtttttaagctttcatattagatactctaaaggaaagatgtatggttagagttggtagtttatacaacttttatagggagctgtgtagtagatgttccatacaaaccatgttattcataattacatattgaaaaggttccctgtaaccaggtacattatctatatgaaatgttagtaatttgaaatgttgaatcttgcattttaacagtatttgctgatttttatctgaaaatattaattggtctttatgttacctcttttttgcacactgtattttagagaattatactgtaactatatatgactgttcagttttaaattgtaatagttaattatgacttttaaacttcggaaagtttaaaatatttttatcaccctggagctgaaaagtactttaaaaatcacctgcctaccttcctgctcttagacaatgctgtgcctaagacatcacagaaagctatggtaattacctatatgatttttttaatctaaagaaagaagatcctacaaattgccctgaggcaagctcaacactacacaaatatttaagtatttgattatactggaaactatgaagttggggcatcagtatgaggacctgaataccttcttaccctcgcctttgaattacctatagggggaaaacaactctttaaaaaacaacctaatctactcagtacaaaagcaagtatggcaccagaatatgaaagttcaaggaaaaaaagcgtgtactctaacagtggtgttttatctatatccttcaggtaattttggagttgggcatataagctgctagaatacctacctggaggaggagatgaaatgttccatgtggccaccttgtctcctttagagactgtcacattcaaagtatattgaccacattaaaagtactcgtggtagaaagcaaaggtgctgtttcgtcacctaaaggtgaaaacgtgctgtctggaacttcgaaaaactcaagtattcaataatttttatgccagtcatgtccagcccataattgggtctttcgtctccacctctctgcataaactgaatgtcccttgtccttttttgtagtgatggcagtgatgatgcttgaattttgaagccataaatgtgatgtgttaaccctaaatggtcctcatgtataggagtgtccttgaaaaaaatctcatctacctcatgatttaatatgatatagtgtctctggcagtagataacccagcttttctttctttctttaatgttacttgtaacaaaatctttagtcaccaaatctagtgactctttaaagaatgttaatatcagaaaggttttttgtttcctttttttaatggtgagagggcagtggtttttagttgcataggataaaaattccaggactgtatcctaagatttgctggttaaataattataaagaccattggattgtgttttatactggcagttgtctggagactatataaactgtatcgctgggaagaaatgtggatgtagttgttgtgaaacagcctaaaacaagctagtgatttataaatcttagggtttttgttctattttgtttttggcaagagtggtggtcaatgaagcatttgaaggtgtttctctgcaaccttactaacagattgtaaagaaatgaccatatcctgccacatataggtgtttttcaaacagatgttagtatgaagacacaaaacaatgtattacaacctgttctttaatgtctatgaaagaagctttgagttcactttcattttgggcataccaaccatcacccttcatgaaaggcttagtagaactagatgagatccacagcattcacagggtcactttcagttatccttttagtcaacattggacaagaagaaatgcttccaaaccaatgactagttagttacaggactattaaggaatcaaccctgggcaccacctctaagagaaaagttacagaccttgctggatttttatatcctgtttattcaaaggtttataactatacaatattttatctaattcacaattttttgatgatgtattttaatttcaccagtgaaagcccatttctaacattcatcttgttaaccactaagctattcattttaccaataaacctcacttctgatattcactatgcaaattaccgatgtctcaagtgttgatcacgatagggataaaagaagtacttgtggtcgctgcttctggagtatagccgtctgatacagtgctcccttgacatggctcctcagttaggactgctgactgcctctggagtttgaagtttaactaactgatacatttatatcaatcacaccatctatactgaagtgttgtgagtatattacagacatcatgacaggactgttgctaaacacttgaaatggtggaaataatgtaatacatcccttctttcaggtggttatgtgtttaaatttttttcaaaatgcatttgatcaacatttaaaaatacgtgctttcagttcacttatttattgatactcttcatgagagaattcaagagctagatctggcttttaatttttttatacaactcttagtaaatttattacaaatacttaaaatcatgcttacatgtctgtaattaagtagcataattaaactaaattttgttatttgtagccatttctgtttcatagagtttgtatatttaaatttcacaagcaagttggtttgttgtatatttcttaactagagaccaatttcactcattatctttatagaataaaatttgtacattcattcaccaatttattaagcatctcctatgtgctgagatttgtactaaaaaatataattcccaaactttagtgtgcattggactcatcttgagaatgttaaatcgaaagtgaaatctaggactctgccttttaacaaatatcccaggtgctgctgatgcagttggtcacaggatatactctgaggaacgcagcccaagagataactgtttaaccactctgaacaccttcctagaaaaggctcacagcctgtggaggcaaacaagaaaacagaactaataactgatatcatataggatcaggtgcaacgaattctaactctggctgaggaactttttagaatatttgataccttaacccatggttctcaatgaatgtagtggtgggtagagtgtggaacatttttttccccgggggaatatttggcaatgtctggagaagtttttgagagtcatgtcttgctggaggaggggcagggtatgccactggccatctagtgggtagaagccagggatgcagctaaacactctatgatgcataggaaagcctctcacaacaaagaagaatttagtccaaaatgccagtagagctattgctcagaaatgttgtcttagcttatttttctgcctctcaccttaatgtctgttgttccccttccccatacacacatacttttgagaaagttacacagttttaaataagaataaatgatgttaaatatgaatagatgattattataaaagatataaacaataaagaaacgtataaagtaacaaaatgaaagttctccctcacccacacagtcctagacatttaaaatgatattacacacacatatgtgtatttaaaggttgttaggtttctgttttgttcttaaatgggatcatactttttttttttttttttttttttgagacagagtcttcctctgttgcccaggctggagtgcagtggtgcaatctcggctcactgcaacctccgcctccaaggttcaagaaattctcctgcctcaacctccccaatagctgggattagaggtgtgcaccaccacgcccaactaatttttgtatttttagtagagacggggtttcgccatgttggccaggctggtctcgaactcctgacctcaggtgatccgcccacgttggcctcccaaagtgctgggattacaggcataagccaaagtgcccagctatagagatcatacttaacatgttgttttgtgacttgcttttcttccttcacagtgtacaattgctgtacagtgagtgccacgttagagtacagatggatgtactgtaatgatttaactgttcttctgcaggtggatgttaagattgtttccagtttacttgatagtgttatgaatagcactgcattgggcacagagtgagaccctgtctcaaaaaaaaaaaaaaaatttatgcacacgtgcatgatagattcccagatactggaatagattcccagaatggaactgttcagtcaaaagggacagttattttattttgatagttttattgctgaaagaatatccccataacaggctataactgtttatattcccaccaacagtgattgaaatgcctgtttttcacaccctcagcgatgctagctattaccacatttcttaatttttgtcacttcgatgggtgaaaatgctatctaatcattatatcatcattatatctcaccattataattttatttccctgataattagtgatgttgagcatcttgttatatgtttattagccatgcatgtttttctgtgaattgttcatgcccacccattgccaactttcaattgaaataactgcatttttcgtacttatttatagatccttatgtgttctatacattgcttgttatatatcttgcagatattttcaccctgtcattttttcagcattgcaaatagtgcctttcatcacacagcaagctttcagtatttatacgttcaaatttgtgtcttttatgcggtacagtgtagtggataaatgtacaagttgtagagccagattgcctgtgttaagatttcagttcctccactcactagcaatgtaaccttaggcaagttttgtaatcgttttgtgcccagttttctatctttaaaatgggagtagtaatactatctacttcctaggattgttttaaggaacaaatgagatattacagtaaaagacttagactactgcctgacaactagtaagtactctataaaaagtagcttctattgttatttcttctggttttatgccttatttaggaaggtcttctgtgcctcaaaaatgtaaagatgtgtcaccacagaaaaaatagtttggcacaattttatcagagtatgggatgcctttgggggagagacagttgattttcctcatgtggaatcagagacagtgctgcaaagagctttgctatgttaaagagtttgaacttgattgtggaagcagagaaaaaaaaccttgacaaattacaagcaagaaagagttgtataaaagattcctgcacttctcaattcatgatggaaggagaagattgttcagtaaatggtactgggactatttgggaaaaaattacctcctcacctcactacaaaaggaattataagtggatgagaaagtttgttgaagaaaatcaatcaaaactaaaagagaatagaagtgaatatttattaaatcggtgggtaaagaaaaaacagtggagaagaaatcacaaaggaaaatatagatagatttgtttacataaaaataaaaactaacgtatatttaaaatcatattaagactcatttttggccaagacccacttattgatgggagtataaattggtattgtataaattggggattgggagtaccaatccccagccctcaggccatggattggtactggtccgtggcctgttaggaaccaggctgcacagcaggaggtgagtggtgggcaagcaagctttaactcccgagctttgcctcctgtcaaatcagtggtggcattagattctcataggagtgtgaaccctattgtgagctgtgcatgcaagggatctaggttgcacgctccttatgagaatctaatgcctgatgacctgaggtggaacagtttcatcctgaaaccatcccctgcccttcaccccagccctggtcctggaaaactgtcttccatgaaactggtctctggtgccagaaagattggggacagctgttctagaggacaaatggtagtcatataaaaaagtttttaaagtatacatgttttggatccatttatttgaccaacagaaatttatgttaagaaagtaatttaggatcaatgtgaagaattgactaagaatttttcatctagttatcacttatgaaaaattgaaaacaacccaaatgtccaaaaatatgggattagttaaattatgtccataaaatggaatattgccattctaaattatattatggtatggtatttattgatacagaactatatttattatatttaatttaaaaagcagtttgcaaaagaatgtatccaatatatgatccagtttcttaaaaataaatacaaataaagtagaaaaacaacaaaatgtaaaaatacatatctttggtggacttatgtatagtcttgttctttatgtctttgtattttctttttttttttttttttacagtgaacctgcattacttgtgtctgtatatttattcatttattttttgaaacagtcttactctgtcacctaggatggagtatagtggcgcagtcttggctcactgcaacctcctcctccaaggttcaggcaattctcccatctcagcctcctgagtagctgggactacaggtccacaccaccacacctgactaattgttttgtatttttgttggagacaggatttcaccgtgttggccaggctggtctcaagctcctgacctcaaacagtctgcctgcctcagcctcccaaaatgctgggattacaggtgtgaaccactgcacccagactgtatatttaaagtgagtttcttgtagacaatataaagttgggtcttgttttttgaatcactctgacaattgctgtctttcagttgctgcatttagaacctttatgttcaaagtgatcattgatatcatcgaattaatgtctacttcatttgctactattttctggatttttttttttcctgagtcagggtctcactctgtcatttaggctggagtgcagtggtgcaactgtggctcactgcagcctcgacctcctgggctcaagtgatcatcctgcctcagcctccccaggagctgggagtacaggcatgtaccaccatgcttggctaattttttaatattttttttgtagagacagggtctcactatgttgcccaagctgatcttgaactcctagactcaagtgatcctcttgtcttgacctcccaaagtgctgggattgcaggcatgagccactgtgcccagccagttactattttctaattgttgtccttgttctttatatctgtttttgtcttccactcttctactttttgtggtttttcgtttggtttgtttttttttgtttttttgaggcggagtcttgctgtgtcacccaggttggaatgcagtggcgcaatcacagttcactacagcctcaacctcgtgggctcaagaaatcctcccacctcagcctccttcgtagctgggaccataggcatgcacgaccacaccccactaattttttcatagagagggtatctctgtatattgcctagctgatcttgaactcctgggttcaagcaatcctcttgcctcggcttcccaaagtgtgggattacaggtgtgagccaccacacttggcttaattgagcattttctatgattccactttctttcttttcttagcttctcagttaattgttaatttttttttttaattttagtttttttagtttggcttttagttcccccagagtttgcagtctacagctaatccaagcccactttcaaataacaccatgccactttacaggtagtggaagtaccttataataacgcagtaatcctattttctctctctagtctcttacatcattgctgctattctttttacttatatataagcatacaaaaacatttatagtcacccctcagtatctgcagggattggttccaggaccccctgcagaacccacagataggaaaagttggcagtccttatttgtgagttttctatcctgcaaatactgtgttttcaatttgcattttgttgcagatatgaaacccactgacactgagggctgactatatttactgaaaaaatttgtgtataagtggatccacacagttcaaatctgtgttattcacgggacaacatacgcataacaatacgtgatctatacagtgttgcaattactactttacacaaactgatatctattggatcagttaagaataagaaaaaatggctgggcgtggtggcttatgcctgtaatcccagcattctgggagactgaggcaggcggatcacctgaggtcgggagttcaagaccagcctgaccaacacggagaaacccccatctctactaaaaatacaaaattagctgggtgcggtggcacatgcctgtaatcccagctacttgggaggttgaggcaggagaatcacttgaacccaggaggcggaggttgcagtgagctgaactggcaccattgcactccagcctgggcaataagagcgaaactccgcctcaaaaaaaacaaaaaaagaaaaatgttaattttaccttcatttatttctcctttggtgctcttcctttctttacatagattttactttctaacctgttatttttttcttctctctagagaacttcttttaacatttcttgcaaagcagatctactggcaacaaaatatctcaatttttgtttgtctgagaaagtctttatttctccttgacttttgaagaataagttcacagggtacagaattctaggttggtaggctttttctctcaaaactttaaaatatttcactccacacttgtttgtatggtttttgagaagtgggaagtaattactatatttgtttctctatagataaggtgtttatttcctctggcttctttctagatatgccgaactggacaatgaagctcaaccctgtaatcccagcactttgggaggctgaagtgggagatcacttggggccaggcgtttattccaacctggccgacaaagtgagaccctatctctaaaaaaaaaaaaaagaaagaaaagtacattatatgcctaggtgtaggttttttggcctttatcctgcttggtgttctctgagctctctagatctgtggtttaatgtctgacattaatttgggggaaattccaagtcattattatttcaattatttcttctgttcctttttttttttttttcctctgcttctggtatttccattatgcatattgacttcttctgtagttgtcccacagtccttggctactctatttttttttccagtcttttttctctttgcttttcatctttgaaggtttctattgtgctgttcttgagatcagagactctttgccaagcagtgtctagactactaataagcccatcaaaggcattcttaatttctgttatagtgtttttatggtgtttttgatctctagcttttcttattggttctttcttagatttccatcactctggtcttacaggctgtctgctttatctattagagcccttagcatattaattatcattttaaattattggtctgattattccaccatctcttctatatctgagtctggttctgatgcttgctctgtctcttcaaactgtgggatttttttttcttttagtatgcctggtgattttttcttgatagccagatgtgatttcctgggtaaaaggaagtgctgtaaataggccttgagtaatgtgatggtaaggtgtggaggagggaagcattctgtattcctatgattaggtttcagtcttagagtgagcctttgcctctgtgttatgaacttcgtaagtgtttctcaatattttcttctcccttcttacgtggggcaggatggctacagtgggctgcagttgagtatttctcttctcccaggttagactctgataaaaccccagcaggttaggctctggttaaacagtttctcttgagggcagaccttggtaagagcagagtaggccaggcgcagtggctcaggcctgtaatcccagcactttgggaggccgaggcggacagatcacgaggtcaggagttcgagagcagcctgaccagcatggtgaaaccctgtctctattaaaaatacaaaaattaaccaggcatgatggcatgtgcctgtaatcccagctacttgggaggctgaggcaggagaatcacttgaacctgggaggcagaggttgcagtgagccaagatcgcgccattgcactccagcctgggcaacagagtgagactatgtctcagaaaaaaaaaaaaaaaaaaaaaaacaagaagagcacagtacccttgtgttttaaaatggttcctcctcccctctcccccaactggaagcccaagggaattttctactgtggttactgtgagaacctgatcaagctcttggaagtaaaactcacaaaagcatggggttgccgtgtgaccttatccccctggagtttttttgttttttgtttttataatttcaatttttattttagattcaaggggtacatgtgcaggtttgttgcatgggtagattgtgtgatgctaaggtttggggtatggatcctgtcacccagatagtgaggatagtacccaataggtagtttttcacctaccaccctgtcactcccccaactagtagtctgcagtgtccgttgttcccatctttatgtccatgtgtactcaatgtttagttcccactgataagtgagtacatgcagtatttggtttttgttcctgtgttaatttgcttaggattttggccttcagctatatccatgatttgtctacacctagcctctacaaaatacctccaaaaaaaatttttttttgctgtcctgtacaaaactcagaaataccaaaaatacgttcaacataaagatattcactgtaccaccctttctaagagtgacaaactcaaagggacatacatgtttaataatagggaatggttatgtaaatttgtggtagaaccatattacagaatgatacacaacttctaaaatttaggtttacaaagttctaatgttaagtttaaaaaattagatttttataagtggtatcgtgtgaactatttttaaaagactagagaaaatatctcaaaatatgtacagtggtatcaacaagttggtaaagttttaagggattcttttttgtacctctccgtatatttataattttctgtggtgaattttcttatgtaatcagaaaaaaagtatagcattaaaagaaaagatgatctcccttacagaatcacggaagatgaaaccgaggtgtgtgtgagactagagaaagggagacatgtccagaggctttagcctagtgtgctcacggatgatgaggcttgcttgaatttagggagaagtgacagtagagatgggaagaagagtccagattctggagagatttagcagttagagccaacttgttttgatgagtcttgagattgagaggcttgatggtggtataattcactaagatgagaaactaagaggagaaacagcttaaggagtggagatgagttcagtttggctatgttgagtttgtaatgtgggtaaaatgagcaatgggcacttgggtgcttagatcgggagctcagggataggtctgtctagtcctgaagatttaggagtcattatcagcacatgcattcaagtccaggccgtggaagatgtaatacttgggtaccaggtcttatttaaactaacagattattatatttctctcagaacatctaatggaagctaagtttaagatctgctagttttgtttcttgtttaaggttaaataaacaactgcataaaatagtatgactaaactttttgttgctttcttttgggaacaggggaagggattcatataaacttcccttagcaactttgtagtcaactggaggttagggttgctttaataattttttttgttttcaatttggacattctacaacccatttagacctttcacctaaacactttaagttgtattttaatgtatatctgtagtttccttctaagaaggttgaggatttttatttggattttttaagacaaaagctagattttattctaaaatcaatataatttttataatgtttatgagtatgtatctgaaccaatttttaatgttgattctttctcttttacatttgtgctaccaaactctcttccatccgaccatctaagttggttattttagctgatatggtttctaattaagtctttttggttgagagagcttcctgtggcatgtctgcttcagcatttaattgctccatggactccaaattaaattttatagtattccattttggtctgctgatgaagcagagatgttttcagcgtggcctgagaaatgtggtacttgtgacagcttggaggaccagcatcacagttttgaaaagtaagaactgtttaacttatagattgtctttttatcatttgacagtagaatttaaagtgttatcacagagttaaatgagagaatgccaggcccataataggctcttattaatgatttatagaataatgcagaaatcattagtcttgatagtatagcatgtcaaattattttgtttcagaaagagtgaagtcttgagagtttttaggttgaagttgagtgaaaagtacccacaaacaaattttataactgttaggtacagcataaggtgttcttgcattggggtgacaagttggattaaaaaacttctaaggtctcttctaatgattttgattcttgagtcagtagagaaagtggatatttacaaaaataattgggtgtgtgaattctttacattttgaaataattcacataatcatgagacagaggacaagatctgatccactgagacttttaagtccagtgctgtggtttgaatgtatcccccaaagttcttgtgttggaaatgtaatccccaatgcaacagtgttgagaggtgggacctttaagaggtgattagatcatgagggctctaccctcacaaatggattaatattattatgggagtgggttctgtatggtgagagtgagtttgttataaaaatgagtttagccccctctttctcttgctctcatgctcactttcgcttttcacaagctctcttgcccttccacctttcactttgcgataatgcaacaagaaacccctcaccagatgctggctccttgagttggtgtttttaggctctagaactgtgagccaaataagtttcttttcttaataaattacccactctctgatactcttgttacagcagcaaaaaaaaatggactaagacagaaaattggtactgagaagtgagattgtggctataacaaaaatacttgaaaatgtgaaagtggttttggagcttggtgaaaggtagaggctggaagaatttggtgaagcaggctaaaaaatgcctagattcctatgaatagagcattgagagtagttttggtgagggctcgggagaatacaagagctgtagggagagcctagctctttttagaggttatttcagctgtgattaggatgccagtagaaatgtggacagtaaaggctattctgaggaggtctcagagggaaatgaggaagaaggtattgggtactggaataaagaccatccttattatgaagttgcaaagaatttggctaaattatgtctatgtccaagggctttatggaaggtaaaatttaagagtaatgaactaggatatctggcggaagaagtaactaagcaaaatattcgaggagatgcatcgggacttttcactgcgtgtagtgagatgtgagtggagagaaattatttaaagacagaatttataattaaaaggaaagcagaatacaaaaagttggaagattcatagcctggccatttgaagagtgaaaaggcatctttaggagagcaaactaagagtttagctaagcaaccacttactaaggagattagtacatttgctaaagagagtacaactagaagggagccaggtgctattcatcaagataatgagagaataaccccacaagcagtttgatattccaggctgcctgtcccatcacaggctcagagctctaggagggcagaatgacttcaggggatgggcgtggggtggccttaacaggcttactgcccagggccacctcagtattctgttccctgaattccagctcagtgatttttagccaccccagccatggctgtggttcaagcaggccaaggtactgcttgtgctgcatctctgcaggctcaaccggtaggccttagtggcatccatgtgatgttaagtctgcaggcctgtaagaatgcaagaactttgggggcatggatacctctacctagatttcaagggatgtcatggatagcctgggggcccaggaagaaacttgttccagaggtgaagccaccacagagagtccccactagggcagtgtctggtggagccatgggagcaaggttacagcagagagtcctcaccaaggtgatacttactggactgtgggggtgaggccacctgagatacgccgaaactgtgagctaccactgtgcaactccagcctgggaaagctgcaggcgtgaaactccaacacatgagagctgctgggtggactgagtccagcaaagccataggggcagggttgcctgaggcctatccctgtggctttgctcatgtgccccagtgtgcctaggatgtggaatgtggagccaaaagcgatcattctttagctttaggacttaatgttgttttccttgttgggttttagactctctgggaactagttactcctttcttgttgcctatttctctcttttgaaatgggaatgtctatactgcatctgtcccaccattgtattttggaagtagatgactggtttaatttcacaggttcacatctggagaggaatttgccttatagtgaatcatgccttgagtctcaccaatatctgctttagatgagactctagactttggacttttgaattagtgctggaaccggttaagactttggggttattgggatggaatgaatgtattttgcatgtgagaaagacatgaattttgggggctgtggtggaatgctgtagtttgaatgtgtcccccaaagttcctgtgttggaaaagtaatccccagtgcaacagtgttgagaggtgggaactgtatgaggtgaatagatcttgagtcctctgcctttatgaatgcattaatttcatcatcttgagagcatgttctttattgggagagtgggtttgttataaaagcaagtttggtcccttattgcctgctctcttgtcctttggcattctgccatgggatgacacagcaagaagattctcacaagatgctggccccttgacattgaacttcctgccctccagagctgtgagaaataaatttcttttctttgtaaattactcagtctctggtattctgttatagtagcacaaaatagattaacacagccagcattaatctactcacatattcttagaatgccaatcagaattatggttgcccatcactttattttgtggtaccctgattcagtagtactcagaacagaacttaagagttctgatggataagggcatgaacagaatcaggcactagactgagactctagaagggtatggtgctgcaagcagtgatttattatcaggtacttactattggcctatggtgatgttaaggcatagcttctaaacagacaaaacaacaaaggcatgacgtgttgcattggtaatcacaggtccacatctagagaattccaataaaataaatttgaaacaatactacattgaagacttcaggtcaaagtgagacaggtgaactttgttgtgatgtttataaaaatgctcagttctgttcttatcaaatttaaatgaagaattctgcttttggaaatgtgatgggctagatagcatgaataatccatattggaaaatagctaaaaataggtacaatatgaaaaaaatcttttaaaatgcatccctgaaatggcacttatagaagcaatccaaagacataaaacaataatagtaataactggaaggggaagtccagaagataagggttcatcatagctttcccactgaaggtttctactgaacctatgatttactgcttttacctctccatggagatgtagaaaaagtctagcatctcccatttctccaaggtggaaggtctaataagacccccttgttgcataaagctaagaccccagatttgtactatcactgtaaggatgaagaagaaataaactcactgcatagaaacgaatgaggaaatctgccacttctattcttagcattagttggtcaaggcagtatcacccttgaaaatttataaccaggagctagccctcacatgggtttcatttaagactgttcttgatgtggtaaaattattaatttcattacatgtcaacactagagtattagtctttttaatatgctgtgtgacaaaatgaaaagtatgcataaagaaattatgctgcattgcaaaggagaaagtttttcaagaaaaagcacttgtccgattacttgagctttaaactaaagtagccacttttttcctggaacaccactttttacttgaaaaaactaactgtggttattcacccttgggtatttggcaaatgttttattgaaactgagcaaagtgagcctgccacttaaaggtgggcaattgaaattatatgtcaatgacaaagtttgagctttcaattgaaaattagagaccttgaaattgatagtttcccagtgcttgaagatttttctgatggaataggtgaagatataaacaaatatgattttttggaggtattatatactgcagtgtgtcaatatctgcataattcagagaatcaatatttttcaaatgactataatgttgcaaagtcacgcctggataaaagattcattcagtatgcatgatagagcaatggattttaatgtaacagtttaagaagttcattgataaagtttcagcctctatattaccattagcctttaagaaactactacttgttgagtttcggtataaaatcaaatacgaagacttgaaattatctgaaaagaataattaaaatactcccatacttttccagctacatatctgtgtgatacttgatttttttcttcatatacttcaaccaaaacagtctgtattacacagattgaatataggactagagctgtctgtcaaaccagactttaaagagactttagagagagataaagacattgaagagatttacaaaaatgtaaaatagagacactcttcttattaaattattttctatagaaagtatatttattcttcataaaacatgttaatatatgaacttgttatttttaaatgaatgaaatgttttctagattgttagcttttaatagagtaaatattgatagatacaacccacataaacagaagctctttggagttctcaaataaagtgtataaagggtcttaagacaaaaacccttgagaactgttagtctaaactctccaggaaaagccagtgattatcagactggattaaaattgtttttggatatatgctgtttacaagagacagttctaaaataagaggaggttaaatgtcagaaagaggaagaggagcctgtaaagaagactgtggcttcagttaggggataatctgtgtatggagttgtcatggatttagctagtttaagacgtggctctattgtctcctgactctcctaattctataatgtttctggcatctgatttgcccacagtgcttttggaatagctttccaaggtattactgaagtggctcactgccttcattcccttttccccccacataaaccaaatgaaggaatacctattttgctccatttctccacacacccagggtcccttctacctgtttatccccgttctggcttggagaaacctctgcccagctgtgcaaatggaaacagactgtacagttcttgttacctcacatctttttctcgtgtttaggagaggtattataaaggaatgtgcaaaaaatcttgaacagaagaaactaatgatgtaaaggtacttcaaagtgttgtaagtcctagaattacacttcattcacttaagaagtatttattgagtagtggctatatgctatggctctagggctaggatacagtggtgagcaagtaaacagtatttgcatatttgctcatgtaagttaaggagaaaaagtaaaggggaatatgaaatgtgtattgggagtgtggttgaaattttaggtaaggtgggcagagaaggcctctctgggaaagtgagttttagtaaaagacttgaaggaagtgggcgagctagccatataatatctatgagaagaacattcctagtaatggaaatagcaaatgcagaggctctaagggagatgcatacctggtgcattggagaaagtaaggaggccagtatattggggcagaaaaaaagatggaacaatagcatagtagataagatcaaagagcaaagtcaggaaggcctggtgatatagggcctgtcggtccagtaagggctttttggcttttgctgtggggcaattgaaggcttttgagtagaggaatgagatcatctggctttaccaggatcatcatagtttctgtgttcagaataattgcaaggcaaaggcaggagcagcaagattagtttaaagggtattaatccagttgaaaggaaatacagtatcaagtaaatatacagtgtgctcagaattgtgtgagagtgtgtgcgtgttcagagggaggggtggtaaattgaaaaaagaggtttattataaggtttgttacttggaattttgcccagattatgagcagctcctcaactctttcacttatttgttccttgattcgtgcactttagtaaaatattccatgatctcacatttgaaaatttctactcctactttccttatcacatagaaaatataataattcggtgatacaagtgattttacataaaaatgctcctgtcataaaagtggacagcagtatatacacagcagttaaatattttttaagtacccctggaacatttgtgaaaaatacaggtgtaccattaaaaaaactttttaaatggtatgcctgtatagggcagtaacatgagtggagcttgcaggctggaagttgctctggttaagtcagtgagtgagtggtgagtgtacagtaatgtcttaggccttcacatttactcaccactcactcactgacttaaccagagcaacttccagtctgcaagctccattcatgttagtgccctatacagacataccatttaaaaagttttttaaatggtgcacctgtatttttactgcaccttttccaagtttacgtatgtttagatgcacaaaacctaccattgtgttaggattgcctaaagtattcagtacagtaacatgctgtacaggtttgtagcttcagagcaataggctataccacatagcttaggtgtgtagtaggctgtaccacctagagttgtgaaagtacactctttgatgttcacacaatgatgcatttctcagaacgtatccctgtcattaaaggatgcatgactgtatagccttaactgcttatatcagcaaagaagaactgctcaaaattcaggagttagaacagaatatacccaaggaaagtgggaggaaggaaatgataaagatggcagaaactactgaaatagaaaacattgactagaaagaatcacaaaatcacaagttgttgatttggaaagtctaatgaaataaccaatttatagcaagaatcatttgggaacaaaggagaaaaggcacaaataaatagtattggtaatgaaaaatgtacaagaccatatattttgcagagatcaatgtaataaaaagatatattaaattattgtactttagtaaatttgaaatcttagatgagatggataaattcctgggtggggagaaaatatttaaactcacttagggagtctttaagtctttcagagaatgggaaaggatgccgcagctcattttatgaggctaatgtaaccagggagcataaaagaaaggaaaatcataggcctatatgctccatgaatatacagaaatcccatgcaaaacattagacctccaaagccagaaatatattttaatataaagaagtacatcacgacctggttggctatctccaaggaatgtggagttgctttaattttggaaaaatctattaatttacctcataagagattaaagtttaacaaaaaatctaaagaatgtgggagaatgggaaactcttagaaagtacaaactaatacagcctttttggaatacaatttggtattttccgataaaggtgtacatgtacatatcctatgacctggctattcccatcctagaaatatttcccagataaattattgtgcatgtgtaccaggatataggtgtaaaaatatttgtaacagctttgttaataattccaaacctgcagccgggcacagtggctcatgcctgtaatcccaacactgagaggctgaggcaagcagatcacctgaggttgggggtgtgggagtttgagaccagcctggccaacatggtgaaaccccgtctttactaaaaatacaaaaattaactaggcatggtggtgcacacctgtaatcccagctacttgggagactgaggaaggagaattgcttgaacccaggaggtggaggttgcagtgagctgagattgtgccattgcactccagcctgggtgacagagcgagactccagctcaaaaaaacaaaaaaaaaaaaacccgcgacaacccatatgtccatcaacaataaaatggatagataaatcgtagaaattcatgtaattgaatattaggagcgatgaaatttaatgaaccacagatgtacatgtcagcatagatgaatattaagaacatgatgttgaggctgggcgtggtggctcatgcctataatcccagcactttgggaggccgaagcgggcagatcacctgaggtcaggagtttgagaccagcctggccaacatggtgaaatcccatctctactaaaaatacaaaaattagccaggcatggtggcaggtgcctgtaatcccagctgctctggaggctgaggcaggggaatcacttgagcccaggaggcagatgttgcagtgaaatgagatcgtgccaatgcgctctagcctgggcaacaagagtgaaactcttgtctcaaaaaaaaaaaagaaaaaaaaaaaaaagaacatgatgttgaagataagaaacaaatttttaaaatggtaattttatttccttatataaaagtaaaaagactcacaatactgtacaatataaatcttttttcactttttagttgtggtaactatatataacaaaatttatcatttcagacatctttaagtgtacaattcagtgccattgagtacattcacaatattgtataaccatcactactgtccatttccagaactttttcatcatcccaagtagaaactatctgtacccattaaaaactccccattcaaccctttccccagcacctggtaaccgctattctgctttctatttgcctattcctcatataagtagaatcatataatatttgtccttttgtgtttgtttttttccacttaccataatgtcatcaaggttcatctatattgttgcatacgtcaaaatgtcctttttaaggctgaatagtattccattgggtgtgtgtgtgtgtgtgtgtgtgtataatatatatatatatatatatatatatatatatatatatatatatgcacatctagttgatccattcatcagcaggatattttcaaaaagtgaagggaaagagtaataaaaaatttagaatactgtttccttctggaggaaggaatggaaaggatacaatttgggaggggacatgcagcttgtaaggtactggcaatgttctgtttctcaagctgggtggtgagtataggatattcattttattattcttaagttttatgctttattatgtatatttcataattttaaaattcaaatattaatgccattagtttaatttttagtgtcttgtaagagacctgataaagtatttgtatatgacagaatcttatagaacagtctatgtaataaagccctgaaaaattataaaaatctaagtaagtttctgcacctttacctctagtcctcttgcatgggagaaaggattacatttctatcatgtggtttatttaataaaatattgtaataaagtcagccaaatattttaataggagaggcattacattaattttacttattgtggggttcataatagatgaaaaagcatacaatgaactattattctgtaaggaaactaacttgaataatttggacaagaaatgtcctctccatcttcttagaatatgaattaaagcctggtgtggtagctcacgcctgtaatcctagcactttgggaggttgaggtaggaggatcgcttgaacccaggagttcaagactagcctgagcaacatagtgagatcccattcaacaaaaaataaaaagtgaactagatgtgggtggtgtagtcccagctacttgggaagctgaggtaggaggatcgcttgagccctgtaggttgaggctgcagtgagctgtttttgcaccactgcactctatcctgggtgacagagtgagaccgtggctcaaaaaagcaacaacagcaacaacatcaaaagaatatgaactaacagttatgccattgaactacattgcttgctaccattatgttttataccgtgttcttagttttagggaggaaaaagtggtgaaattatctaaatgctttttttaagtataattttttattttttatttttgtggatacataggtgtatatgtttctggggtacatgagatgttttgatataggaatgcaatgcataataatcacatcatggaaaatgtggtgtctttcccctcaagcatttatcctttgtgttacaaacaatccaattctttccgttatttttaaatgtaaagttaaattattactgactatagtcaccctgttatgttatcaaatactaggtcttattcattcattctaaccaaaagtttttttttaacgatgtttaaaaatatttataaagaagtcctgagtctcagaatatgtttattcatttttataatcagttcatttcttattagaaaaattgtaagatctttccccctttatgctcatgtacagagaaaacatttattcacctgttgcttgcattgttactacttgaatagcaatgagagtccatagaggtggagaactcattttaggtttggcttgaacctagtgggggtccatgcataaattttaattatgtaactacactattttaaagtaaacattctgcattgaattgtgcagttatctattttttctcctttcaagattggtgaccctggatggactatttattagtgtaatgaaccaggttaaatggtccataaaaattagtaaacactgtttattgagtgctgactatatgctaaatactctaattattttcatgtgttattgcaagaatttctctaggacatatttataggatgagaattgttgagttgttaagatttgcatgtattcaactttacgaggtaatgtcagattgtttttcaaagtggctgtatcagttgaaactctccagcagtataagagagtttgcattgtttcacattcttatcaacacttggtaatgttcaactttacaaaatatttgccaatctgaaagtgtgaaactgaggcttagatacatgaagaaatctgccaaagattaaccaatgaataagtgctggtgctacagtcgaatccaggtttgtctgattccaaccgcaatagactgtatttcaaagaaatggaaatatataggctaagtctttttataacaatgagaatagttatgaaaaataagtgacatttttaaatttaaataattttgtgtaagaacttaggggaagtgtttctgaaaatgtgattttagattaactgaatcagaattgcctggtagtagtggtgtgtatgtgtggaggggggatattacttttcagtaatcagattcctaggtccatctttaggtctactaatttaggatctctaggggtgggattcaggcattaacatttttaataatgtttcttagttttgtttttggtttttaataaacattgaagtttaagaacctttgctttagggattttgaactaatttcgaaaatactgccagatgcacatacgaactgatgtttaaacataggcccagagacagttattcagacagacattcagcactcacttttgtattgactcttatctccaaactttcattttctactagctcctcttactcttttttctctcattcttgttcttttgtccaacccacatgtgatctgaagtagcattaggaccctggcagcaataatagtaattctctctaaactctctctctctccctggctgatccctagtccctttaagaaggactgtaggatccaaaagacatgcttgtttgagtgcagttatttcattcctcttatagaaccgattatagcaatgatgtccatcttgggtgggtacagatttagacttggtggttataaagaacaaaaattcatggagtggggttagagctgtgaaagatccccatattttccctcattactattcttcttaaaatgtattttctgagatagctaattttaaggagagaacaatgtctgaggtagctggagaattactaggaacaccattcaaattccttttcccaaaagggagacattatatcaaggacatagtatattaaggacacagactctagtgaggtcctgtgttaattagtattgggaatggatatcatagactaaaaagagctctagtctactcatctgcccagacctcagaaagggctctttgcattgttcctaagcaaataattgcttaagtagtacagctaattgtatttagaatttggtagcttttattacctattgtttcaaagacactgatttaccagatgcttaaaaaacacatttttgtttgccatgaacctgagttcagcagaaaaatttttctacatactttttattctaaaaaatgaaattggcagaatatgataaaaaatctagacttttgcagaagcattcttaaactaagttttcaaaattatgctcatttctaagttatcttaatttttatagcttattcagttataaaattaaataattatattaagggatcaatgtcatactttgtgaaacagatttgtttaacaaaaactgaaaatatgtgacagtttatatgtcaagctttcaaaacagaggctttaaatcctatattatatgtagaaattgttagctattctaaaggtacaatgagagattattgttcatatcagtgtaataaattgatactctctgatcatactttttcattttgctcattgtcagaaccttgaaccttaatcttattctttgattgacagtagcaaccagggaaagaacacttgtattgtttggtatagtcacatctgttcaacttgattcagttgaggatatttgcatattcttaagtatttcttctgagagggcttaaatccttctcaagtgcttgatgcatttttgaaattcattcataaggtatctacatgcactaatagttctgtatattattgctgtgcataatctgacagataaggccacattttaaaacaaggtattctttagggatgctacattacatttttacttgtttcgctgggtagaaatatcagggttttttttaaaggctgttttaatattttgattaaattagtatgtccttattttaggcaaatttttcaaacataggagaaataaagatttattaaataatagttcaaaggtattaatggtagtttttcttgtcttggtttgaaaattgaataattttatggaaaataattatagaacttgaatggatttctgtttagcctcctaattttatggagaaggttactgagactcaagttttctgacttgctcaaggtcacacagcttgaaaattaaggtttaaattttggtcttaactcccatatcagtaaactacaagaaataatggtacatgatttctgatttatgttatttacacattatcctacatctgaaattttccctttgccatagaacctgcagagattatgtcttattcatcatatctccccagaatttacacgatgtcttgtacaaagttaatgcacaaccattattttgctctcctgttttcattgttctcctaggctattctgtaaagtatagttaagaaacataataactttagtaatggaatgttaagtacttttgatagcaaataggtttcattttgtgttctatttctgatgaattggcaatagcaatgttgagaagaattctgagatctgctggagtcagttagtggtgtctgggcataggatcagaaagccaactgtttcttttatgatatatgtgcttttatgggagagacaactatggactgaacaataaaaaaaaggcctggggaagaaataagactcaaattacaggatacatagaattcagatgttgtagacagaaaaaaaaaaaagaggtagaatgccaccaaggctggaagttctataaataatcgtaggcgtttaaaaaggagaaatatcattaggttacattaaatattatcaaagcaaagcaaataactgttgagtatttgttgatgcctagccctgtattggatcctcttctcatagtaaccctggagactttctgtcctagttttcattccttgcttctccttttctggtgtttagggttgttctaatcttctcttgtttctgcctgggttaccgctttccaattgcatatctgccttacttataaatgtaacaactgtgatacaacttcattgtaattttatttagttattgtgtgataggaatgtaataggagaaggaagttttcaattattatttgatttattattaaaatcgtactttaaaatgtttggctataaaataactcaaaattacatactttttttttctttaatcttccaggaatccccttctggtcgaaggaaagctcttgctactagcagcatcaatatgaaacagtatgcaagccctatgccaactcagactgatgtcaagttaaaattcaagccattatctaaaaaagttgtatctgccgctcttcagttttcattatcttgcatttttctgagggaaggaaaagccacgtaagtttcttttgtcaaataagcttccttacattgtgtttcagtacaccatagcttttgactcagtagactggcaatagttgaacatcttacagcataccaatcatttttgccattctttgtttcagaggctgaattaagggaactccttgttacttataaatagtctcttttgactccagagaatgtacagtaatataaacgtgagcacagctggtttcaaaatttaaattgtatattttaggatattataagtgttttatatttcagtgtcttcagtgtagtagtctgtactctgaggtacacacagttcaatgtgtagaactgtttgatgcaattgagacatgagaggaacccaaaacgaaaagtttaggataaaagggatgaaataattaagggaactcttgccaaatcatattccttggctcaaccttccaaaaatcatgtaggaaggtacagttagataagcagtttattgtaatcattttcttttcaaaaatcacttcttaagcactgagtcagcattgcacaaagatttctagattccattctagtctcttataagagtaaaattctaacttgacaaaatgaggtgaacatacctacaaagcggggaaaaaagtaagattcaccctggttattgcatacaatcaagtcaggggtaagtgaatgttacgggtgttgtgaaagggttcgtacctacatggagtggaagatgaagagacaggagaaatggaaattctatacctagacttaaaaggtgaggggaaagagacagctgtgaacattttatctaatctgaatcacagttctgaatgtatttgacctagtggaaggtggttactataattggccatgtctacttgactgattagactggattctgtgcgtcagtcaaaatgagatgtttgacactcatctacatggcaacacatgacttgtgagataacagtaagcctcctctctggcaagttggattctaagccagtgtggtagagagacagtgcagaatggaagcatcttagtctttcatctcaggaccttaaattatagacttaaatactgagtaattaaaaataaagatcttaccctgaagtttaagccaaaacaaaaggaaaggaaacacaggaagaagagacacaaattcagagaagatcctttgagggtggacttccttccactgggcaaaagctgtaagtgaatcagcaccattcacgggaatctgggtgagaggaaattcagccaaaccaaatgtctcaatttgaattgaaaaggaattctttccgaacatcctaaactgcctctctacctcctccttctttgcctggttaccttccccaaagaaaaatgttcaggtttaaaatgtgaggaaattaaaatggtatgcaattaagcaagttaacttttttttttttttgagacagagtctcgctctgtcacccaggctggagtgcagtggcacgatctcggctcactgcaacctccacctcctgggttcaagtgattttcctgcctcagcctcccgagtagctgggattacaggtgtgtaccaccacacctggctaattttgtatatttttggtagagacggtgtttcaccatgttggccaggctggtcttcaactattgacctcaagtgatccgcccacctcggcctcccaaagtgctgggattacaggtgtgagccaccgcgcccagccagcaagttaatattttaagaatgacattttgaaattgtctcctgttgataagagagcaatttgtaagacattcacgtaaggtaataacttttttgctcatgcaaactttgtgtcactaaatttattttaaaaaggggaaatgactttgttaactctaaggcttatatgagataagatgcaaagaattttttaaaaccagtttagtctgtaaagccatactatatttagaagataacggcgtattaagcattactttacaaagaaacagtatcttaatttggctttctgaatttgggggaagtatagcaaagtaaaaattaatttgtaaataatagatacatatttcattcactgtagtttatttgaaatttaaggtgaaaataatacatgatgaaaatataaatgatttgactttgagtacttaatgtaaactttataaatttgtacttaaaatacttaaaacatttaaaaaaagttcagatttatcaaatacatggtatttaacatacaatcatccaaggtagttttttttatcttgtagctcttaaaaaggttagactttgtttttaaagtgcttttcctgctataatagtttcttaacttttgggcggttatggccctgttggaaaaacaatatacttaagcaagatttaagtgtgatttacaggggtttgccactttgtttccctcttacccacaaactcaaaagcctacgtggacttcagatttaaaatcttgttctaattcctttgggcagtttgaatatttaaactctagatcttatctgatttgcaaactgtctcactgtttttgaaacaagtttttgtttccagacttaattctcaggaaaccatactttaattccatgaagaaagttttaggccaggcacagtggttcacacctgtaatcccaacactttgggagcctgaggtgggacaatcacttgagaccagcctgaacaacatggcaagacccccctctctacagaaattttaaaaattagctgggcattgtgctctacacctggggtcccagctactgaggaggctaaggcgggatgattgcttgagcccaggaagatgcagtgagccatgttcacactgctgtactccagccagcctggcttatagagtgagaccctgtcttaaaaaaaagaaaaaaaaaaaagaaaagaatattttagtcttccatatatatctacagcacagaatcgaactaattcctaaccagttaaattttttaaattatgttatttcaataaataagtgaaacaggtggtgtttggttgcataggaaagttctttagtgatgatttctgagatattggtgcacccatctcttgagcagtgtacacggtactcaatgtgtagtcttttatccctcacacccctcccactcttccacgtaagtctccaaagtccattatattactcttaggcctttgcatccccatagcttagctcccacttacacgtgagaacatacgatgtttggtttttcattcctgagttacttcacttagaataatggtctccaactccatccaggttgctgcaaatgccattattttgttcctttttaaggctgagtggtgttctatgttgtgtgtgtgtgtgtgtgtgtgtgtatatatatattatatataatactactatatataatacataatactactatatatactactatatattatatatagtggtattgtgtatatataatatataatatataataatatataaatacgtaatatttataattatttatatatttatattatgtatattatacatatatactattatatatattatacatatacactattactcctgcaatagtggccataatttaagaataaaaaaaatagatattgacatggatgtgatgaaaagagaacagttttacactgctggtgagaatgtaaactggtacaaccactatgaaaaacagtatggagattccttaaagagttaaaaagtagaactaccgtctgatccaggaatcccactgcagggtatctacccagaaaaaaataagttattacaggaaaaagacacttgcacatgcaatgtttatagtggcacaatttgcaattgcaaaaatacggaaccagcctaaaagctcattgaccaatgagtggattaaaaatatgtggtgcatatatatatatatatatagacacacacacacacacacacacacacacacacacacacacacatatatatacacatatacacacacacacatacacacaatatggaatactactatatatataatatatatagcttggattacaggcgcatgccaccacgcccggctaatttttgtgtttttagtagagatggggtttcaccatgttggttaggctggtctcgaactcctgaccttgtgatcacctgcctcggcctcccaaagtgctgggattacaggcatgagccaccatgcccggcacatatatcttcttttaagaattgtctattcatgtctttagcccactttttgatgggactatttcattttttacttgttcatttgtttgacttccttgtagattttgggtattagtcctttgttggatgcatagtttgtgaatattttctcccactctgtgagttgtctgtttactctgctgatgatttcttttgctgtgcagaagctttttagtttaataaggtcccatctatttgtttttgttgcatttgctttggggttcttggtcgtgaactctttgccgaagccaatgtctagaagattttttccagtgttatcttctagaatttttatggcttcaggtttagatttaagtctttgatctaaccagttaatttttaatcttattagctctttactaattaagcatgccatttaaaaattaatgaatatgagtatttagatttttcaatattcttgtgcaactgataagaaagacttattgacataccttatagaaagaaggaatttattgttttcttaagaaaccatcatttttctaactgtcatttagtacaatgtgttatattttgaatcattgatgtagagatgaagacatgcaaagtttggctagtttgatgagtatgaagcaggctgacattggcaatttagatgacttcgaagaagataatgaagatgatgatgagaacagagtgaaccaagaagaaaaggcagctaaaattacaggttggttttattagcattaaactaaaagtttatcttttgttgcagagttcaaaaactcattctcatttcccaggaaaaaacaattctacttattgggtttctttttttttctttaagcctttctacaataaaatataccatttagttctctgacaactttccatgctgtttataatagattttagcagtttgagatcaagtacaaggatggtcaaaataacaaaaaacattcttgaattataatacaaagcaacctaaatctggtcatacttattttgtcaatgtgtgaatgaaacctctgtaagtaaagatctgcctgtaaaggataataggacacaataaggagatggattggccagctgcttctatttcatattcatttatttacttgaattatgtggacattctgtgttttgaatttatatatcttatgtatcctggtattgaagcttccatgcaggtattccttcaagctgagttgatcaagctactaagatgttaagtggttagaacttctttttattaattggtcaataaatatttattgacaatttggctatcacacttaagcaattgatgtcatacttctattattgctgtgaaaattaagcacaatttacatattccttttagttaaattaattgctctcaatttctgaattgatgtcccttcacttctatcatctgtttacctcctggtgattttttcaaattcatttgggcactttgttactcatcttttggttctgcctcaactcttgctatcatgtgggggatttccatttactccatggatcactcatttaactactcagctaaaaagttatgtgacttccttgactctgaagaccttcacttccattccacaacaagaaatctatcataaggaactgctcagacttgtgtgcaaaattagatgttttttcatgtgtaaattttattattttctaatttgtgattgcaattttgatttattatttggcccaaccatgttttggagagtgtgttttaccatgtgctttgtttatttatttctagtttgtttgcttattcattcaaataaaattcaaaagtctcttgaatttcaaatgttttaaaaatattattgaggttttttatttgtagtctagatatgtgatttatacattttctagaaatatgtttttacatgtatattctatttgtcgcattcatcattagactcaacttctcattacaggcatagtttgttttactgaactttgctttattgcacttcacagatttttttttcttttttctttttttttttttttttttacaaattgaagatttttggcaaccctacattgagcaagtctatcagcttagtctgtttagtctatcagtcttaccaacagcgtgtgctcacttcgtttctctgtgtctctgtgtcattttggtaacttttgcaatatttcacactttttcattattattatatctgttatagtgatctatgaccaatgatctttgatgttactattgtaattattttgaggtgccatgaattgcacccatttaagacagcaaacttaatcaagtgtgttctgactgatccaccaactagctgttccctggctctgttcctctccttgggcctcctcgttccctgggacataacaatgttgacattaggccagttaataaccctgcaatgcctatgggtgtttaagtgaaaggaagagttgcatgtattttcctttaaataaaaagctagaaatgattaagttttgtggggaaggcatgtctaaaccaaagataggccgaatgcagaggcctcttgtgccaaacagttaaacaagttgtgaatgcaaagaaaaaaattctagaaggaaattaaaagttctaccccagtgaacacagaaaagatttaaaaaatgcataaagccttattgctgatacagagaaagctttaatggtctggatagaatatcaaaccagccatagcattcccttaagccaaagcctaatccagatcaaggccctaactctgtccaattctgtgaaagctgagaaaggcgaggaagctgcagaagaaaagtttgaagctagcagaggttggttcataaggtttaaggaaagaacccatgtccataacatgaaagtgcaaagtaaagtagtaaatgctaatatagaagccacagcaggttatccagaagatctcaccaagatcattgatgaagctggctacattaaacactgattttccatgtagacaatacagccttctattggaagaagatgccatctaggaatttcacagctagagggacaaagtcaacacctggcttcagagcctctaagcttcaaacgacaagttaactctcttgttagcacatctttttatcgcgtggtttactgaatattttaagaccattgttgagacctgccgtacagaaaaaagatgctttccaaaatactactactcattcctttttagtacactccctgaaaaaacaacaccactgctcattgacagcgtacctggttgcccaagagctgtgatggagatgtacaaagagattagtgttgtttctgcagcacatagttcaaggagtaattttggcttttgagtcttattatttaagaaatacattttataaggtgtagctgtcataggtagtgattcctctgatgatctaggccaagtcaattgaaaacctcttggaaaggactcactgttctagatgccattaagaattttgtgattcatgggaggaggtcaaaatatcaacatcaacaggagtttggaagacagaagaggctgattctgatcctcatggctgactttgaggggtttaagacttcagtggaggaagtaactgcagttgtggaaaaatagcaagaggatcagcattggaagtggagcctaaagatgtaactgaattgctgcaatcgcatgataaaacttgaatggatgaggagttgcttctctggatgaacaaagaaagtagcttcttgacatggaacctacttctggtgaagatgctgtgaacgttgttgaaatgacaacaaaggatttagaatatcacatcaactttgataaagtagtggcagggtttgagaggatttatttcaatttagaaagaagctctactgtcagtaaaatgtcaaacagcattgcacgctacagagaaatttttaatgaaaggaggattcaattgatgcagcaaactttgttgttgtcttgtttaggaaatggcaacaagtattttaaggaattacccaaccttcagcaaccaccaccctaattaatcagtagtcatcagcatcaaggtagacccaccaacaccaaaaagattatcacttactgaaggctcagatgattgttagcattttttaattaaggtatatatgttgttcttagacataatgctattgcacacttaatagactatagtataaacgtaacttttatatgcactgggaagccaaaaagtttttgtgacttactttattgcaatattcactttattttagtgatctggaaccagactagcaatatgtctgagattatacctgtacagttgaggctggaacagcatggattgaacggcatgggtccacctatacaatatgttttttcagccaaacacatggaaaatacagcattcacagtgtacaaagcctacatacatatggagggcgcacttttcatatatgtgggttcggaagggcctgctttgggacttgatgtatggattttggtatagacagggttcctggaagcaatcttccatctccacgaagggatgactgtatatgtatctttttttatagtttatttttttaaagacagaaaacttcactgctaattatttattctataaaagtttattctcttaaagcctcattataatttgtatcagtttgccccatttaatgcctcttgccttgaaattttgcctgttgatatttgtaaacaatggtttttttagatttttattttcttggcatatttgtcacttgatttttaacctatctgtgttattttaagtgcttcttttatatacagcatttggttgatttaactttataagctttgcccttcaactgatatacttaaatgtatttatattactttatttatacttttattttggggcttttcttattttttccacccatcccttacatgttgcttttcttagattttctgtatttaaacatttttcatagagtaacttagaaggtatataacctagtttcattttaggctggtattctctctaataaataaataagccagacaaagaaatgagtaaacttttatttctctacttacattaaaaataaagcgggggaggagccaagatggccgaataggaacagctccggtctacagctcccagcgtgagcgacgcagaagacgggtgatttctgcatttccatctgaggtactgggtgcatctcactagggagtgccagacagtgggcgcaggccagtgggtgcgcgcaccgtgcgcgagccgaagcagggcgaggcattgcctcacctgggaagcgcaaggggtcagggagttccctttccgagtcaaagaaaggggtgacggatgcacctggaaaatcgggtcactcacacccaaatattgcgcttttcagaccggcttaaaaaacggcgcaccacgagactatatcccacacctggctcggagggtcctacgcccacggaatctggctgattgctagcacagcagtctgagatcaaactgcaaggtggcagcgaggctgggggaggggcgcccgccattgcccaggcttgcttaggtaaacaaagcggcccggaagctcgaactgggtggagcccaccacagctcaaggaggcctgcctgcctctgtaggctccacctctgggggcagggcacagacaaacaaaaagacagcagtatcctctgcagacttaaatgtccctgtctgacagctttgaagagagcagtggttctcccagcacgcagctggagatctgagaaccggcagactgcctcctcaaatgggtccctgacccctgacccccgagcagcctaactgggaggcaccccccagcaggggcacactgacacctcacacagcagggcattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgtctctcctcctccaaaggaacgcagttcctcaccagcaacggaacaaagctggatggagaatgactttgacgagctgagagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatgtatgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcaggttaccctcaaagggaagcccatcagactaacagcggatctctcggcagaaaccctacaagccagaagagagtgggggccaatattcaatattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaacaagcaaaatcaccagctaacatcataatgacaggatcaaattcacacataacaatattaactttaaatatacatggactaaatgctccaattaaaagacacagactggcaaattggataaagagtcaagatccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaaaaagaagagctaattatcctaaatatatatgcacccaatacgggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagacattataacaaactatctctcagaccacagtgcaatcaaactagaactcaggattaagaatcccactcaaagccgctcaactacatggaaactgaacaacctgctcttgaatgactactgggtacataacgaaatgaaggcagaaataaagatgttctttgaaactaacgagaacaaagacacaacataccacaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaacaactaaaatcagagcagaactgaaggaaatagagacacaaaaagcccttcaaaaaatcagtgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcaaagaatactacaaacacctctatgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacgcaaccaaaaaagagaattttagaccaatatccttgatgaacattgatgcaaaaatcctcaataaaatactggcaaaccgaatccagcagcacatcaaaaagcttatccaccatgatcaagtgggcttcatccgtgggatgcaaggctggttcaatatacgcaaatcaataaatgtaatccagcatataaacagaaccaaagacaaaaaccccatgattatctcaatagatgcggaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattagacaggagaaggaaataaagggtattcaattaggaaaagaggaagtcaaattgtccctgtttgcagatgacatgattgtatatctagaaaaccccatcgtctcagcccaaaatctccttaagctgataagcaacttcagcaaagtctcaggatacaaaatcaatgtacaaaaatcacaagcattcttatacaccaacaacagacagagagccaaatcatgagtcaactcccattcacaattgcttcaaagagaataaaatacctaggaatccaacttaaaagggatgtgaagcaactcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaaggtaccaatgactttcttcacagaattggaaaaaactactttaaagttcatatggaaccaaaaaagggcttgcattgccaagacaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggaatccctatttaataaatggtgctgggaaaactggctagccatatgtaggaagctgaaactggatcccttccttacaccttatacaaaaatcaattcaagatggattaaagactgaaacataagacctaaaaccataaaaaccctagaagaaaacctaggcattaccattcaggacttaggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacagtgaacacaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacatgtgctggagaggatgtggagaaataggaacacttttacactgttggtgggactgtaaactagttcaaccattgtggaagtcagtgtggtgattcctcagggatctagaactagaattaccatttgacccagccatcccattactgggtatatacccaaaggactataaatcatgctgctataaagagacatgcacacatatgtttattgcggcattattcacaatagcaaagacttggaaccaagccaaatgtccaacaatgatagactggattaagaaaatgtggcacatatacaccatggaatattatgcagccataaaaaagggtgagttcatgtcctttgtatggacatggatgaaattggaaatcagcattctcagtaaactatcgcaagatcaaaaaaccaaacaccgcatattctcactcataggtgggaactgaacaatgagatcacatggacacaggaaggggaatatcacactctggggactgtggtggggtggggggaggggggagggatagcattgggagatatacctaatgctagatgacgagttagtgggtgcagtgcaccagcatggcacatgtatacatatgtaactaacctgcacaatgtgcacatgtaccctaaaacttataataaaaaaataaaaataaaaaaaataaagcaaaatttattgactctcttcttgtagaatgagagatgcagtatgattctcttctttatttaaacccttccctccaaccccattggctattatgtttatttcaataacattttgctaattcttttcaatagtatatactgacatttgcattttattttataatgatggcagcaataattttttaaatgtgatatctttcccatctttgagttttggcttcttttcttttttcttttcttttctttctctttcctttctttcttattttggttatttggctatctggagtatttccagaagaataagtgggtgtctttcccctagtactaccactcaccttctaccttgtcttagtttgcttgggctgctgtaacaaaataccttaggttgggtaatttgtaatcaacagaaatttattgcacacagttttggaagatgggaagtccaatatgaaggagcctgcatatttgttatctggtgagagcctgttccatgtaatggtgccctgtatgtgtcttcatgtgaaggaacagcaaagaaaagggacaagggaccaagggacaaacttgctccctcaaagccttttttttttgagacaaggtcttgctttgttgcccaggctggagtgcagtgacacagtctcggctcactgtaacttccacctcccaggttcaagggattctcctgcctcagcctcccgagtagctgggatcacaggcgtgtgccaccacactcagctaatttttgtatttttagtagagatggggtttcagcatgttggccaggctggtcttgaactcctgacctcaggagatccgcccgctttcctcccaaagtgctgagattataggcgtgagccaccgcgcctggcccttaaagccttttataagggcaatagtattatccacgagggcagatccctcatgaactaatgatctctccgtaagctccacctcctaataccctcaccttagggattaagttccaacataggaattttggggggacattgacattcagaccgtaatatacctatccttcaaaatttaattcacttgtcacatagtctgagaagcctttgatgccccctgcctcttaagcttgaccattccatcctttatggtactaccatatacaaatgtaggcattttcctatagactgagtttttataattccagtgggttattaattggatctttttagttagagaatatggtgtattatttatagatggcttttgattaaaactaaatctcaattagatacgggtacttttaagtaggaatttttaaagccacacatttgcagttgttttgagcagtattgtgctattttgatcacagcagtgggagaaaaaatgataatatgttacagtttctacactagtattgaaaggaagagtgagaacagtagttttttaaggaaaatatagatgtaatgattcaataattattagatttcatagctaaacccttgttgattaaacatatactattccttattttctaaaattcctgcaagagcagtaattttcttttagacagtttaaaattctctgaatctaattgaagaaattgttttgaggcaactttggatgcctctattttgtgttatttacattttttatattttatgaaattccctgaaaatagaaactatgttctaatcattttttcatctctagcttccagcacattatctgaaacatattaggaattgaatatatcttaactgaaaggccatagtgaatgaatgaagcttcattctctctggcttatcttgttccatttgacgtttaatcacatagtatcttgtacagggtagagtggttccattttatggaaggaatatgttctggagggcacacataattgaaagctcagtaattcaaaactagttttctaaaaggaatgaatgtaaattgtgtgtgttgaagaagaaggggtgggtggggcagtgggtgtctagatgtatgttctaagtcctaataaattcacaatcattgtagcatattttttatttgatattacagtttttttcttgtcattttctattatgtttgcagagtatggtaacctaaattaatagcacagcatattatggcagttgtttggctttcttagttgtatttttgaacacatgtaaatcccattctaaagttactaactttcagggatatatttttttagcaacagcacgaccactttaaaagtgtttgagtgaagtagttttagcaaataaaaggtttattgaaatttaatgcattaatgttaaaataatagctcaagaaaacaaaatggacatattttataagcatggttacaaataaagtatggtaagtatttttatttaccagcaaaagtggcaataacttaaatacagtttgtattaactcttccttccaagtttgaaattgttattgacacagtttttatggaggaattattattttaaattgttcctgttaattatatcttaatattataatctaaatgcataaagtgcaattgcattatatcactaaaaattatattgaatgtattgtttctccaacaaagctcagaatttcttgagggaacagactgttaacaattgtgtacctcttagattgacatctcacggttattcatgtagtgagtaatttcttatggaaagttgctgttaaattagcagtatttgacaaaacatatcctccaaaattacagtctttgctaggaggtgaaagtaaatccatggtatctgtacttgcactgatcaaaaatccctacactgttctgagacagactcccctgctaaatagatacatatctggggactagctctcaggcaggaaccatttattgatgctacttctatagatacattttactgaggtacagcaccagtgaataggcaggagaattttgaattacagttggaaaaatcactgaaatgtagcaggagtgatagaccttggagctggagaaaaaatgccttttaatagaaagcttgctgcagccagtagtagaaattatgaaaccatatggtttcagaacaataaatactggcagtcacacagtgcttgagccagtatttggcagtatgatcatctttggaattcatgttgaatttctgaatacacaccaacaggaagaaaaataaagacccctgtattgtaaagacaaggccctgatgaatacatcacagaaaatcaagttcaactgaagcagtttacagtaagcattgttaagagaactcagacattatgaggctcctgaaagacccctgatattcttaaagtttgttgtgttgcaaagatcaccatggggtctacctaaaatcagctggacattcagattcattcgcatgacctacataggccaagcagtgttagattgacttaaaaggatattggataggaaacacagtatgccagcagggtattcctttttcaccagagtcttcacagcaatctgaatactgttgtttatcccctaccaccaaatgacaacttgggtacaaagtgacaagattcagatagttaggagcagggattgctttgtcttaaaatccccatgcaacacaagagcagattatcttttttttttttttccttttaataccctaactggtctgagctaatacctttgtaccagtctcatgggtacagtttccaaggttcctataagggacatgcacatttataagagtctctacattcaaagaagctaaaacctgtggccttacaccagctatataattcattcagaatcttcccatccagatgcaatttgtcaatcaggtttgatttttaccataagcaatgtttcctggtgtttgttaatccttttcccatagttgataaagttaatttgggagaaggaagagagagtgacatatttggctaccttcagggaacaaaatctaacagcacagatggtagtagaggagataccaattacatattaaggagctagagttgatgatggtatgactcagccctctgagattaaattctacttactagggctatgaatggagataagtaggtatcccaccttttattagaaggttccttaaaataaatatgggactctggtcagagagtaggaccattaatttgctcctggtttttacctggcatccacccaccagtacctaggcatctcgtgaacaaaatcataggattgttatgggctcaattaaaaaaaaaaaaaaaagattagccaggcttggtggcatgcgcctgtagtcccagctacttggaggttgacatgagaggatcgccttagccaaaaaaaattttgtttaaataaaaattaattaaaatggccacctattttggaggtcagttaaaaggatgagaatatctggaaaactgcctctgttatgtagtcactaaggttgggaataggaggaaagcagagaggtagggcaattctgatccctttagccaataagtttataaggtatcatagctaccttatttttaaaggagtttgaaaccctaggatgagagactgacgtcatcaggaatatatctttgcagtcttagaactcaaatatgtcaactcagagaatagtaacagtagcagaaaacacagactataaattcagcttgctttctctgtcactcttaaatgctaatgctgctttatttgtacttatgacactaaacataatctagcttccctgacttctgaggctctgggagaattctactgatgctgagaacccatctgacagggcttggatgggaacgagggctctaaaaaagaagtcagaagccttccagtatttaggggaggagccagaaggcaattaatattcaaagtacctatatgagttcactaaggatttatcctaggaattcaaggttagtttaaccacattaataaaggaaaaaaattatatagtcaattcaacagatgcagaaaggaacatttgacaaaattcaatgccaagtttcttagcaaagtttcaatagaagagaatttatttattttgataaaggacattcatgaacagctacagctaacatcatatttaatggtgaaacattgaatacttttcccctaagattgggaacaaggcaaggatgtttgctcttaccattcaacattatatttgaagttctaccaaactcacaggatataagatcaatatagaaaaatctactgtatttttatatatgaacaacaaacatttggaaaatgaaatttaaaaaatttcatttacagtagaggtaaataaaaaacagactaagaaataaatttgacataagatgtgaaaaacctctgactaaaaagtataatacattactgaaagtaattaaagaagaccttaataaatggagagataacctgtgttcatagattagaagatacagtattgttaagatatcatttttcctcaaatcaatctgtaaatccaactcaatgccagtcataatcctagcaggtgttttttaaaaataaagaaattcaaaagtgattctaaagtatatttggggatgcaaagtaaccaaaagaatattgagaaagaactgaattataatagtaatgctacctgacatgaaaatttactataaagctgtagtaatcaagatagtgtcaaattggcataggataaatagatcaacagaacaaaacaaagtcctgaaatatacccaagcttggccaattaatttcaacaaagttgtcagcataatccagtgggggaaaaggtcttttcaataaatgatgctgaacaactggatgtttgtatggaaaaaatgaacctcaacccccacctctccacatacattaattcagtgtgttcattataattaatagcaaacattaattcaagatagatcatagacctaaatacaaaactgtaaaatgatgaagcttctgaaaaaaagcaaaacaaaaacctagaaacctgtgtttctgacctcatggtaggcagagggttttaacagatgacacagaaagcaataaccaggaaggaaaaatttgatagattaaacttagtcaaaatttaaaacttacactaatcaaaatagattatttaaaaagctaggcatagtggcacgcacctatagtcctagctactgggaggctgaggtgggaagatagcttgagctcaggagttcaagtccatcctcggtaacatagtgagatcctgtctcttaggaaaaaagaagaccattaagaaaatgtacgagcaagtcatagattagaagaaaatagtcacaaagcatatatctgtcacagatcttgtttccagaacagatttttataaaaatgccttacagctaaataataaaaaagacatgtgaccttatttttttaaaatggacaaagatttggacatatggttcacaaagatctatcactagccaaatggcacatcaaaaatccatcacttttaatcagggagatgcaaattaaaatcacagagagatacaactctatatctactagaatggttaaaatttaaaagattggcactactaaatgttggcaaggctgtggaccaacaaactctcatccattgttggtagaatgtataatggtaccatcacataatgagtgtcttttttttttttttttttttcttgagacagtctcactctgtcacccaggctggagtgcagtagcatgatttcagctcactgcaacctccacctcccaggttcaagcggttcttctgcctcagcctcttgagtagctgggactgcaggtgtccaccaccatgcccagctaatttttttttgtatttttattagagatggggtttcaccatgttggccagtctggcctcgaactcctgatctcaagtgatcctcccaccttggcctcccaaagtgctgggattacaggtgtgagccaccatgcccggcacttagcaagtttcttacaacactgaacatacacctaccctctgacccatttatttaccccaaataaatgaaaatatatgtctccaaaaagatttgcacaaagatattcatagcaatttattcgtaatagtcccaaactggaaatagctcaggcatacatcaacagaagaatggctaaaccgtagtatgttcatgaatggaatactactcagcaataaaaatgaactattgatatgccctacaacatagatgtacctcaaaaccattatgcttagtgaaagaggctttacataaaagatacactatatgatttcacttatgtgatgtttttagaaaaggcaaaactattttaataaacattaaaatagttatagcctgtgggactggggattgactgaaaagaggcaagagagaactttggaagatgttgcagatgttacgcagcttgggtcacatgggtgtatatgtttgtcaaaattcattaaattatacagtctaagatttgtgcctttatgtgtatgtgtaagtaaaatactggaaagtagcatgtaaaaattatagtaaatatattaggtttgtaagaaaatgaatgatttctaactttctgatttattgatctactgtgtggtatagctggtctcctgactgtgtcctaatgaattaatacctcccaatattcatgctcttttataatctcctcctttgcagcttggctggcctggtaaatcactttacccaatataataaaatggaagtgactatgtaacttccaaaactaagttggaagctgccttttagcttctgcttggtcctctcataatgcatgctctaggaaaaaccagctgtcatgtaaaaagttcatgtgccctgagactgcattgctgagaggaaccccaaactagccatgtggacaggccacttggagagagagagagatgctgggccatctgcgagttgttctagccttttcagccaagatcaaacgtgagtaaagccattttggacatccagccctgtcaagctttcagatgacttcagcccactgccatctaactacattgaactacccagctaggtccagtcaacccacagaactttgagagataataatttgttgttttaagtcaccaaattttgaagtggtggcttaaaatataatatttctatagataaatgaaacattatagatacatgcatacatgcatagacatagagatagatacatagataaaacagtgtatctataatgtaaaaataaagaatattttatatcctcctgcctttataagatgatgcaaagtattatgactcattcggttcattcattcattcatttacaacgtacattaagtactagctatgggcttaaaattgctagttgttagaaatacaagacgaacatgacatagtagcacagctgttgaattctatttttaatatattaagtgtgtgaggggactatctatggtcattagagtagaagtgcccactaggtagttggaaattcaagtctggcactcagtatgtatttgagaattatcttaatttatgtgtttgtagttaagccaagagaatagatgaattctttcaaaaaagaacagatttaggggaaaaatgggacctatgatgggatcctaggcagagggaagagtaattattattaaaacagactgagacagaactctctgtccgagataggaggagaatcaggagatgctagtatcctaaaagaggcaatcacatatttatgggtttaagcctgtggagaaagtgacatcttttttaccttgatctctgccagaaagttgaagagttactattttagaccatcttaaaataagacatacctgaatctcgttataatttagagaataacgaaggtactgcaagatttgcaggtatattctagcctacaggaagtttttttttctttttactacagactttcttaaaaggaaaaagccacctactcgtcacttgtcgtgctgccatccccatccccaccttttttgttcaatgtgataatctctggtggtcaatttcgatcttcttttgccttccttactgtaaggaagaatctcaaattatttgaccctttgctttgattgcctgcccctgatttagtttctcttcttattctcatcaatgtgaagcaggtccataactgacatacagttacaggaaatatatgggtttattgctcaatttgtatagtagtaggggagaaatataacattattagcattttccaaacgttttcaattttctgtgaaacaagactttataaagtaataaagtattatataaatatattgggttgggtagtacttttggtcagggtagcatgtaactgaaaaaacttcccattaaaaaaattccaggaataaatttttgttataaattttcttttaagttaattttttccgattgtaaaagtaaaacattgtagaaaattggaagaaacagacaagtactttttttagaaggagaaatacataacaaaattatatattttagggttttgacccacatagcaactgccaattgaagtatttgcatgggaagtttcaccaactgtctaaaactaatagcccagtctcagttgctatccacagtcatccaacacgcaaacatagcacttatcttagatttcttgcctatcctgcatgccaaattaatcatcaaatcttcttaatttattcttcaattaacaagtatttattgagtgccttccctcatggagtggtgatgctttgtcttgcttcctatcctttcttcccaaacgctgccaccatgttgctgctggaatgtagtttctgaaatatgctagattcccataactctcagaataaagttcaaattctttagtttgatcacaacaaccttcatgataggacagctgccagccccatctaattccatttcctatcgctggcatcttaaactccaatttgcagttcttcaagtgtgtcatgttctctttgcctccctttgtcctcatccatatcctcttttattttaataatcataatgtctacttgtcttgtgttagctcaaatgtagataaaaatccagaaagccctcctaacctctgagttatacatctctctttcagttagtttcccgtagcctacagtgctatctcaatgataatgtttatcatacagtacatattactttacttgcctatctgtcccactaaaatataaagccatgagagcaggtactagcacaggcatgtaataggtacttgataaatgcttattaaatagataagtggttttttttggacattgcttttttatgatttgtgctaacatttatttgcaaaccaaataagggaagcattggtatagaaatcaaaattaccttttcactctgttaatgtaaatgaaagttgtagaagcagaagttctaggagtgaagtagggatttacttaagctaaggataaatggtggaaactactaggacagtttgtcattagtgaagagaatgtaaagaagaaattactttgaattagttaatgaagaaatggccgtaagtgattttagatgtcaccaaaagcatgatgatgaggaagacatactctaagcatttggaaaaataattcagtcatgtaatagagtcatcttgatagtattttttaaaatgccgacattatacctaaaattctgtggaacaatattaatgttttgaaggtaaagactaactctaatacttcttctatattccctgcggtgctcaaatataacatgtttaataaatgattgatttcttctctcattaagattacttttaggaacataagataattaaaacgtcttagctatataaagaaaagtgcaaatacttgagcactgtgtaaacattttttgacctattaattgcacatataggaatataggactaataaataatactaagatacatgataaaatgtggataataatacttctttggttattgatgagaattagctgattgtggatgcaaagcctttcctactgcttcataattaactgctattatttctttttatattttatattttcatagttattcatattttatgtttacaaagttattcctgtggggcaaataaataatactaatatacatgataaaatgtgaataataattcttttttgattatttatgagaattaactgataatggatgcaaagcctttcccactgcttagtaattgttagctgctgttgttaatatttctttttatatgttcaaagttattaatatttttaaagttaaaaataaatcatttgtaaattttgaaaaatgcccaactagtaaagaatgaaaaaaaaatcagtcatgagactggtaatcacttaacagtgatcctacactccattatatttttcctaaaaattacaaaattacagtgactgcaagaggcaggtaaattatctaatttatgaattaattctacctactgagaaattagctaggttaccttgagtcagagtacgatttaaaactattggcaaaacaagatggaagaagaaactttgtaagtctgactatttagctcctactgttcaaattgggattaaaaagttcaattggtattaattgcgtttactttctgttttctatggtttactttgactatctcaagcaattttggttatgcaaaatatatttactcatttagaaaagggaagttgataagcttatcaacttttcatatatattttgctgaaagatctataacatacctctgacagcctagtattttcatacctgcattccttggagatattgtgagtttggttccagaccaccacaataaaacaaatattgcagtaaagcaagtcacacacattttttgatttcccagtatatataaaagttatgtttacactatactgtagtctgttaagtgtgcaataccattatgtcacggcatcttcaccaggagttggttccatgtcaagaagctactttctttgttcatccagagaagcaactcctcatcctttcaggttttatcatgagattgcagcaattcagtgatatctttaggctccacttctagtgctggttctcttgctatttccaccacatctgtggttacttcctccactgaagtcttgaacgtctcagagtcaaccatgaagatcagaatcagcctcttccttcttccaaactcctgttgatattgatattttgacctcctcccatgaatcacaaaattcttaatcgtatctagaacagtgaatcctttccaagaggttttcaattgactgcccagatcattagaggaatcactacctatgagagctatatcttacaaaatgtatttcttaaataataagacttgaaaatcaaaattactccttgaactgtgtgctgcagaaacaacactaatcacctgtacatctccatcacagctcttgggcgacctggtgcattgtcagtgagcagtgatgttacttttttagggagcatgctaaaaaggaatgagtagtaatattttggaaggcgtctttttttctgcacagcaggtctcaacaatgggcttaaaatattcagtaagccatgctgtaaaaagatatgctgtcatccaggctttgttgttgcctttatacagcacaggcacagtacatttagcatcatttttaagggccctaggattttctggaatggtaaatgagcatctacttcaacttgaagtcacattcttcagtatcaacacaagttgaagctacattagcttcagacttcttctgcagcttcctcacctctctcagccttcacagaattgagtagagttagggccttgctctgggttaggatttggcttaagggaatgctatggttggtttgatgttctatccaggccattaaagctttctctgcatcagcaataaggctttatgcattttttaaaagtttcatgtgttcactgggttagaacttttaatttccttcaagaattttttctttgcattcataacttgtctaactgtttagcacaagaggcctagcattcagactgtctttggtttagacatgacttcctcacaaaacttaatcatttctagcttttcatttaaagggagagacatacaactcttcctttcatttgaacacttagtggcctttgcagggtttaactggcctagtttcaatattgttgtgtctgagaaaataaggaggtctggggagtggtagatgggggaacaaccgggtggagcagtcagaatgcacacattattgatgaagtttgccatcttaaatgggtgtggtgcattgcagcccagaacaatttaagtagtaacagcaaagatcactcatcacaaatcacctaacagatataatgaaaaggtttagaatatggtgatgatggcagcggtgggccgtctggagtggtggctgtcgtcatgcctgctacagcagggaggcgtggctgaggccacacactccaagcagctggcgggaactggggacaagcaggagccccgccccttctgagttggggctggagctccctgggtgctactaaatctgcccaagccgtgctgcagacccaggtacccctctattcttggaccctggagcaggtgggagccctgccctcctgggtgcagcttcagctgcccaagttgtggctgtggacctgggcctcccactgcagggagcaggcaggagccgtaaccccccagcacagcttgcccaaacggcggctgcagacccagacatccctgcattcttgtgggcctgggaaggcttcccctgccctctcagcctcagaagtgcctgcttctgctgtctggcttctccctgctattggcacctgctccaatcttggaacaaagttggagctgagctcgggtgctgtcacagcccggccaggtgtgcacatgctcagggcagtgctgacacaccagccccctgccacctcggcagcagaccccttctggattttgggcaccgatgagcataggaggggagctgatgggtggctgagggcagctccatgctggcctgcaggcacccattggcacctacaccctaggcaccatgaatggcagcaggaggtaggttcctgggtagaaggaggaaggtctctggtgaggccccaccttcaggccagggagggcctgaaggctgggggccaggctgccagttccacagaccagagtgggaggttgtggtgctttttccaggccgcccatgaaccaatcagcatgcaattcctcttctctgaggcccatgaaagccctgggctctgtcagagctgagcagatatcaggacaatcagctgcagagagaagcaaccaattccagggcctcttctcttctcagagctgggaagttgatgggactacttgcctgcagagagaagcaacccactccaggacctctactctgctgagagcttggaagacactgagacaaacagttgcaaagaggagcaacccgttccagggcctcctgtctgctgagagctagaaagacaatgggtcgacctgcctgtaaagaggagcaagccactccacggtctctctgctgagagctgcagagttgacaggattacctacctgcagagaagagcttcccactccagggtctcctccctgctaggagctgaacactcttcaggacaccctgcttgtggaaaggagctacccactgcgagtctcctctgagctgttctgttgctcagtaaagctcctctttatcttgctcaccctccacttgcctgtgtacctcattcttcctggttgtaggacaagaactcagctcttttagccccattgaatggcagggttaggagaactgtaacacaaacagggctgaaacatgccccttgctcaccacattgcaggtgaagaggagagaagagctgctgcccatcagggagcacatatctgggagctccccatgccagggctgtgactcccgctttggggccctgtggttcctggcatctccaagcttccaggtgccaccacgttcccagtgccagatgtggaaactgcagtgcacctggtctacctgcagccttgcagagagctggtgcctatgccacacatggagcttcccactctgctgcagcagctggtgtgtctgactgcacagtggctagaccccacactcactcacactaccctcatcactccatgcctgactcgcccttggtaggcatgggatccaggtcagtagcgtgagccaagtgcagcatgccaggccaagtgggtggaatgagtccagcaggcctgagcaaaaaactcaggcaaaggcaccactggccacagaggtttccagccagaaaagctacatcccaaggatcctgtaacaatatgaattaccaaaatatgacacacacattaagtgagcacatcctgttggaagaatggtgctgatagacttgctaatcttagagttgtcacaaaccttcaattcataaggtggcagatggaattaaggttgtttataagctgaccgtgacatagtggaaagtatgctaggttatccgtgtgactcaatataattaccagggtggttaaatggtagagagtggcagaagagaaagtcatcacatgtgatgtgagaacaacttggcccactgttgctggctttgaagatggaggaagggggtcacaagttaaggagtggcttgtagacttctagacaaggttggcttctagaagctggaaaagggagggaagcaaattcttccctataggctccagaaaggaatgcagcctatcgaacttcctaattttagcccagcaagtcttctgatccccacaacagttggataataattttttttgttgctttaagcaaaaaaaacctctttacttaatagaaaatgcaatatctgggaagtgcaataaaatgtggtatgcctgtaggtatttgttaagtctgtttccatgttaatttgtgtctctatagatcgtaaattccacaaggacaataccatgtttgtttttgtgtccgaagaataggtcttggcacagactgataaataaatatttgttcaatacatgaatagttgcaggcagccatattataaatgcatattaaatgatttagttcaaataaaatttaccatgtgcccttaggtttacaatgttaaagaacagtacttttaatgtcaaatttacaactgtgttctacttccaatcgttttatttctttcctactgaataatctggatctatttgctgtatcgttatacctaagctattcctaggttgtaactttggaaatatcaggaattaccccgtagtatcctaaaaggttcttatttgagtagtctaattttcacccaatgagtgataatttcacatattcagagttgttcaaaatatagatgactcatgtaaaaaattgtatcttaaatttgtttctctgtcctttttagttctcttttattgtttttattataagatttttctaaagcatatactctaaagttgccttaaaagaacagatcctattaaaaaaaaaacagtagtagaaaatagtaactgttgcttttttcttgttttagtgccgatttttaaaatgcaacatgaatacatacttattatgtatataatccatgcatttatattcttaaaactttttgtttaaatttagaatataaaacaaatgacaaatattttctgtagtatcagagtatatatattttgttctgtttttaatatatgtgtttaaagcacagctctattttgtaaatgtgaaatgtgaaaaccagtgtcaacttctcgggttattatctcgttttgtgtttattaacatagtttttatgttactagtatacattttaacaataaaatgctttctattttaaaatatgagtacagcataacattcagttaagcatatctgttatgggttcatcaaaataacatccaccgaatgtattctgttgattaaccaaacatctcctctttgtctttttgggtaacagcatgctcctacttctctttaattaaatgaccttaccttatatttgtcttgactggcttctgtttacagaaattgtaaaccagttgaatgctctgagcagcttagatgaagatcaagatgactgcataaagcaagcaaatatgcgttcagctaaatcagccagttcctctgaaggtctaagagctttcctcctttctttctgcttctgattgcctgtatttactgtgacctgctacctcttgacttctgtctgtatttatctgtcagttttgtctttgtgcttttccttgaatgttttctttggtaatttgtagtgcaccaacaggcaacaagataacagtacttatctttagcaaagtcatgtcaggatccttgatagacagtggttttaaaacattttctaagataatacttggtcatacaacatgctacttcttcagtgtgtttatatattataaatatattgtttttagaatatttgcttatcataagcccatttcagttattcctgtttgggagtgaagaatgttctttctaaaagtctatgtcaacactttttttattggctcaaattaaattgacatggaagtttctttagtacagttcattatctgacataattttcaattaatactcaaatgtttgttttgttttgtttgaaaatgttggtatgctacaaaatacttgaatggcattctgtcattggtaaaatgctatatactattatttgcaggtattattcgtgtgaacttttaccatttgaaatatttcacgaatgttcaatacttacacttaaccataatagggaactaacccatatgtttattttcagagcttatcaacaaacttaactttttggatgaagcagaaaaggacttggccaccgtgaattcaaatccatttgatgatcctgatgctgcagaattaaatccatttggagatcctgactcagaaggtagcaagtttttctgtaattttaaagtctttgtatagtcaagttgacttgaactgtaagggcaggaaaatattttcttcagagactaacacacaaaaaattattgtttataatgatattattattgtgttcaataccacttggagttgatcagcaattctgggtcacttctatggaatggcttttaaagaaaaaagaaagccttacgtaaacatttacatggggctttacaagtctcattcgtttggtctaccaagtaaggtcagaatgtgggatatactgattttgggatggtggaggtagcttctctatatggatcattttccctgacactcagtctgttgagcccttctgccccaactctatgtctctctagccgagattctctagcagagaattagtagtgagagtgagttatgcatgtgaaaacatggagcagagagtaggttaagaaccgctgctattatatatatatatacagcatacttgtgaggtataaaaccagggattttttttcctgagtcacttttcttattaagtagttttgaactcataaagcctggctaagggctgttacagaagtgagacttctgtttaattgaactctgtatgcttaacataaatgcaagaatgattaactactgtttacatctttttttgactgtgtctgagaaatcttcatgaattttaaagaattttgctactgcctgtcatggtgaaaatgaggttttagcttcaggattcactctgttatagcaatataatttcataattctttctctgtctcctcttcctttaccttctcccttcttaccagactctaaattattaatagtaagtgtgtattcatgagttttttattttgtttgagggctatatattatgaacatattttaaatcttaaaaaggttacaatagctgggcacggtggctcacgcctgtaatctcagcgctttgggaggccagggctggcggatcacctgaggtcacaagtttgcgcccagcctgaccaacatagagaaaccccgtctctactaaaaatataaaaagttagctgagcatggtggtgcatgcatgtaatcccagctactcgagaggctgaggcaggagaattgcttgaacctgggaggcggaggttgcagtgaccaagatcgcgccattgcactccagcctgggcaacaagagcgaaactccatctcaaaaaaagaaaaaaaaaattacaataaatcatagaggcagtcaactacctcttttcatagattaggaagctgagactgagagaagttaaattatttgactttaggttagatggaggtggagttggaactaagattcttaatcaggtatccttttgaccacacaacttcttgattttatactacatacaattaagtatactgagttcaaaaatatttacaaaatgtcttgagacattcagtatttgaactttctattttaaaatcaagtaagttttctaaatgtaagtctgttatcagaggtataaaagagagtggcagacaacacataagatcatatttctatgaagaagaagtaagccagcctgattcagaatctttaattatacctgtagagccaaacaagtatgtgtcaaccactgatctttttaaatatatgcctattagagtctttagagtaagtattttttattattaaaatatttttatagaaataatttatctttattgattaaaaacttgcagcctcaaaacagaagtatttggggaagaaaaaaatgtgttgcaattgttcagattattctttttttgcttttacaggttcagttctcctcttatatttatgtgcttgagtggctttttttttttttttttttttttgagacagagtctcgccctgtcgcccaggctggagtgcagtggcacattctcggctcactgcaacgtccaactctcgggttcaagcgtttctcctgcctcagcctcccgagtagcctggattacaggcgcgtgccaccatgcccagttaatttttgtatttttagtagagatgaggtttcgccatgtcggccaggatggtctcgatttcctgaccttgtaatcggcccaccttggcctcccaaagtgctgggattacaggcgtgagccaccgcgcccagcccttgagtggcttttttagaaagctactaaatgtcggccgggcgcggtggttcacgcctgtaatcctagaactttgggaggccaaggcaggtggatcgcttgagaccaggagtttgagatgagcctggccaacatggtgaaacccgtctctacttaacatacaaaagttagcccagtgtggggcacacacctataatcccagctgtttgggaggctgaggcaggagaatcacttgaactcaggagacaaaggttgcagtgagccaagatcgtgccactgcaccccagcctgggcgacagagtgagtgaaactccagctcaggaaaaaaaaaaaaagaaagaaagtcttctcttaaaccctcctttgttgcctattctagcatcttcaaatcttgctctatagtttgtatactttcttgcttttggtgttgtaactgatgaatttgcttggattaatttttgcaatcctcttcctgaaagaaaaaaataaaaatcttatttttattgacccattttgtcagtttcttaagcatttgagccctgatatttgttaatacaaaattggataggaaaaactttacagtctctcttcccttatggagaaaagaaaatgcttaatttacatgattataaagattctagtggtgttaagtttgaatattatcatggtattacaaaagatactattactgagtctctttaggctatgtttaaattcatttcagtattgatttattatgattttatgacttctctttcacacttacttgcttctccatggtgtacagactttcagctcagaatttttcattttatgttcttttcaacataaagacaaaataaattttctgggctaacatgtacagtatacgtggtttgactttaaaatataaaagtcattggccgggcatggtggctcacacctgtaatcccagccctttgggaggctgaggcgggcagatcacctgaggtcaggagttcaagaccagcctggccaacagggtgaaacctcatctctactaaaaatacaaaaaattagccaggcgtgatggcgggcgcctgtaatcccagctcctcaggaggttgaggcaggagaatagcttgacaccgggagaggtcactgcagaggttgcagtgagccgagattgcaccattgcactccagcctgggcaacaagagcgaaactccatctcaaaaaaataaaagtaattaataaatgtcagtcataaaatttttgtaataatcagattaagttgtttgaaatgtcacttaggaaacaatttttcttgagaatttcaataatcaatttcctgccttcctctcacagaatattttgttagcattgcatagcataattaaaattacttttaatgcactatgacttttggctcactgaaattttcctacaatttgagaaaatatttttatcagcaaatcttagacagttttattacaaattcttgttttgttttaaaatactaacaaacataaaaaaaaaagcctcgtgctaagtactactactactatagtggttttgtattttgagtcagagttttattttaaaagtaccactgaggccgggcacagtggctcacgcctgtaatcccagcactttgggaggctgaggcaggtggatcacttgaggtcaggagtccgagaccagcctgaccaacatggtgaaaccctgtctctactaaaaatacaaaaattagccaggcgtggtggcgcatgcctataatcccagctactcaggaggctgaggtgggagaaattcgcttgaactggggaggcggaggttgcagtgagccgagattgcaccactgcactccagcctgggcaacagagtgagactccgtcacacacacacacacacacgtaccattgttgtccaggcatggtggctcacacctgtaatcccagcactttgggaggccgaggcaggtggatcattgaggtcagaagttcaagaccgtgccgctgcactacagcctgggcaacagagtgaaactgtgtctcaaaaaaaaataaaaatgaaagcaccattgttttcaaattaaaatttgaaataataaaagctagaaaaacttgatatatctatcagcttaccagtattattatagtgctttcaccttgaagattcttatgttattattgattgaagttacattgaaaaaataatctcattaaaagctctaaagatttaaagtcttgtagcatacagaaacctcctctttgaaaactttgagaaaacaagttcagtggcctgtgagtatatatacgacacaggacagaatgaattatcagatccctgagtggtctgtgcttacgtaaatatcaaagaacatttcaaaagtgaatcaatttcctgttctttttattttattttatttttttaaattttatttttctgtgttgtttttttttttttttttttttttttaaacagagtctcgctctgttgcccagactatagttcagtggcgcagtctcagctcactgtaatctctgcctcctggattcaggcgattctcctgcctcagcctcctgagtagctgggattgcaggcccccgccaccccacccggctagtttttgtgtattaagtagagacagggtttcaccatgttggccaggctggtcttgaactccttgacctcaagtgatctacccacctcggcctcccaaagagttgggattacaggtgcaagagactatgcccagccttaaattttatttttgaattgaggtcatgctctgtcacccaggctggagtgcagtggtacaatcatggctcactgcagccttgaactcttgggttccagccatccttccactgcaacgtccctgggaactggcactacaggtgtgcaccaccataaccagcccatttcatgttcttttaaaaacagaaatttattatgtatcggtttgtaatggcaagctggtagactacaataaaagaatataattttgcacatctaagaaaacattttcaaaattggcatatcataatgttaatactgttagatactgcagaggatctcaagaaacagtaatgatccaaaaatgccatttttgggagtaccattcctggagaaattgacagagattttagatatcacatcttctgaacattaagactacttagcccctctaaaatatattattgttttattattgctttgctctttctcagccccatagagcttattaattcaataatgcatatatttgagaacactaaacaatattagaaaatatcatatggtattcatgtgatttaattcatctgctattattttatagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgagtaagtacatttcattttgctgtcatcacaagttagtctctatgttacctaaagagatccttttgtaatgtacctttagatgggtacaaatcattaatgtacactttataagtcagtatctaactcgtccactatctgagtgtttatagtcttaaaccttattctcccaccctcttccaggtatgtgtgtgtgtaccctaaactaacaagtgaggaagatatattcctagaatctctggttggaattccaattgtgtcttctcacagaaactatattataaatggtatttaggtttttggtttttttttccatcaaactctgtagacattaaacttcagttatcttataggtctgttggggaggagaacaaaataatcatttgtggtattgatttgataagaagacttgtttagataccaaacagtgaaataataatatttctaaattagggattatcacaagctcagtatgaatagactgtgtaattagggctgccatttgcccaaatctggagtggggataaaaaggggatgtgttcatactgtaatctggagttatacagttcatagcccatgtggctacagaccatgacattaagtgtgttttaaaagcagcagcaaaacctccacttccagtcatgatgggataacacagactggatttagcctcttaaacaactaaaaaatggaataaaattattatatgaaacaataggattcagacattggacacaaacagcacaggataatgatccctgagagaacagaaacaagacgagccctacaattatgtaacttatttgtgggagagagtttctaaatgcagttcagagagaaaaaaactcagatcccagtaatcaccctgaattaaggagatagagtttggacttgggagtactgaggtgaccagaatttgtagaagagaagaggtacggaatttatacctgtatgaggagcactactctgtgagatctgtttcagagatctgtagaaagcccctcctgagtctttagctgagtgtggatcagagcttgcgtgtgaggaaatcacgaaggacaaagaaacaaacagaatgatccctggagtttgccccagaccaagaataatttgtgttcccaccagccagaaagaaaagacttcctaacacatgggacattcagtagaggcctcagagaggtattgcatcagttgtggggccaaattggccctaaactgaaagctgttctaggcctacctaacaaagcttaaaggcaaggctcaaaagaatcaaacttatctcaagtaatttaactgcatcacacatgaagctcaaaacagttttaatcaataccaaaaactccagcacacaaaacatgaaattcatactgtatgacagccaatcaaacatttatcaggcatgtaaagaaacaagaaaatctgacctgacccataatgaggagaaaacataatcattagtatagatgcagaaatgggacagatgatggaattaaaagatcaacctggtaaaataacttttataaatatattccagatatccaagaaggtagaagaagacagcatagatgatattagaaaattgaaattgaatttatagagatgagatttttcatctcatacaaagtcaggtgaaaaatagactggatgaggttaaccccttgttaaatactgcaaaaggaaatactagttaacctaaagacatagcaatagaatccatccagattaaaagagagaaagaagaaaataacaaaggatcagtgaactgtggaacaacttcagtggcctaacgtgtgtaaagaagtgaagagaaggtaagaggacagaaaaagtatttgaagaagtaaacaccaaaagttttagaaataaaaaaatttaaaaatataaacaaacctacaggtcaaagaagccaaatgaaactcaagcacaagaaaaatgaagaaagtcatagcaaagcttgttaacaaaaacaactcaagccagaagacaatgaggtgatattcttaaaggactgaaggaaaagtataacaacaaaaacctgtcaacataattttctattcccagcactccaaaaaagcaaaatgatactacttgaaaatttggatttacacgaaggaaaaaagcacatgaaatgacaaatatattagtatatataaaatacttgtcttatttttaaaaatctctctggtagataattgtttaaggcttcaataatgtattctgggttttataacatatagaagtaaaacgttatgatggttgtgtaaaggctgagtagcagaatgaaaggatactgttttaagcttcttatacataatgttacttgaagacacttttttcagagttgacaattgtttatatagaaaagcataaggaatctttaaaatgggtactaaaactaaaaagtaaatttagcaaggttacaggctacaatattaatatataaattcaattgtgtttctctgtagtcacaatgaacaatcagaaatcaatattgaaaaaaataccatttatagaagcatccaaaacaaaaaactcagggataaatttgaacaaagatgtgcaatatgtatataccgaaaacaacagaacgttgctgagagaaattaaagagtgaaatcaatgggaaaaaatacaatggccatggattcaaagatataagttattttcagtcaatttataaattcagtgccatcccaatcaaaattttagcatgctttttaaaaaaataatttgtcagctgtttataaaatgtatgtggaaatgaaagggacttagaataatcaaaacaactttgaaaaagagcaaaatttgaggatttatactatctgattttaaaactcattaaccaagacagtgtggtattagtttactaatagactgtaggtgactggaagagagcctggaattagattcatacatatattgccaatttatttttgacaaagctagcaaagaaaatcaattaggaaatgataatcttttcaagaaatgatgctagaacaattaaatgtccatatgcccctcctcaacaaaaaaaaagctacaattcttaccttccactgtataaaacatttatctaaaaatagatcacacaactaaaagtaagaataaaaactgaagattcagccaggcacagtggctcacacctgtaatcacagcactttgggaggccgaggcgggcggatcactttaggtcaggagttcaagaccagcgtggccaacatggtgaaaccctgtctctactaaaaaaaatacaaaaacttagctaggcatggtttcagtcacctgtaatccaagctacttgggaggctgaggcaggagaattgcttgaacccgagaagtggaggttacagtgagccaagatcacaccattgtactgcagcctgggcaacaacagcaaaactccaccttaaaaaacaaaaaactgaagattctagaagaggacataggaaaaagtcttagtgactttgtatttgggagatttcttaagtagaatgcaacaaaacacaaaggataaaacaaaaaatggttaatttgtacttcatcaatattaaaacgtttttctctttataaaactcttacaaaaatgaaaaagcaagccacagtttggcagaaatgatttgcaatacctgcatctggcaaaagacgtatccagaatatgtaaagaactcttttaactcagtaataagaaaggggaggccaggtgcagtggttcatgcctgtaatctcagctactcaggaggctgtggttggaggatctcttgagcccagaagttggagaccaacctgagcagcataacaagagtctatctcttaaaaaaaaaatttttttttaattagctgggtgtgatagtgcacacctgtggtcccagctactcaggaggctgatatgggctgatcacttgagcccagggtttcaaggctgcagtgagctatgatcactccattgcactccagcctgggcaacgctgtgagacctcgtctctaaaaaataataaatttaaaaatttattaaaagaaagggggaaatattccaacagacatttcacaaatgaaaatattgtataggaatggagagatgctcagcttcattagtcatcaagaaaatgcaaattgataccacaataagatatcactacacacctacccaaatgactaaaatttacaagactgactataccaagtattgtcaaggatgtggggccaccggaactccacagaactctcagagtacttctgaatggttcaaccattttagaaaaaagtttggcagtctctgaaaaagttaaacatacatgtatcacttgacccagacattccatttctacgtttcaagagaagtgaaagcatatgtccacaaagacttctacataaatattttaacaactttattgattataataacaaaatgggaacaattcaaatatctatcaacagacaaatggataaacaaactgtggcatatccatacaatgcagtactactcagtaataaagaggaacaaactgttggtaaattgcaagatcattatactgagtgaaagaagacagaccagaaaatactatactgtgtgataccatttattttaaactctagaatatgcaaacaatctatagtgagaaaaaacagatcagtagttgtttacaatcagagctggagggaggaagagattaaaaaggggcatgcaggaaacttttggagggactggaaatgtttggaaatgtttgttatcttgatttgtgctgatggtttcacacttgcatgcatgcataaaaaatactcattaaatattttcaaatgtaagccatgtattgtttatcatttatacctaaataaagctgttttaaaaagaacagcaatctttaactttaatagcagaaatattatatcacgtgagtgatatccagcttggaattcttgggcctttaggtctatttgatgtaaataactggtgtgtgacgggagagatctttaaaatatttaataataagtaatataattatatgatcacttgtgagactatatgagtctttgctttctttggaaatacataaacttttgtgtattaacattatttagaacttgggaaaaatagttatttctttaaaaatgcaggttgaaaggaaaatatttcaaaacactctatatgtgggttgagaggggaataataataaggctcctttgattcatgaaagtttggggtaatagctttgtgcaaaaggagaaatgttatctctctattgtgcattggttagctcttattttaagcactatttgactactagttgttgtattttataaggggcattggtgattcagaatgttaacaaagtagagaaaaagagtcattaaagtgtccagaaccacatcaaatgaacaataattcagagcacagggactgtttgattttaaaaatagatgatttaagggaactttaataaccaacttcaaatattttgagactagccaggtgtggtggctcacacctgtaatcccaacactttgggaggccaaggcaggtggatcacctgaggtcaggagtttgagaccagcctgaccaacatggtgagaccccccccatctactaaaaatacaaaattagctgggtgtagtggcaggtgcctgtaatcccagctactcaggaggctgaggtgggagaatcgcttgaatctgggaggtggaggttgcagtgagcccagatcatgccactgtactccagcctgggcaacagagcgagactgcatctcaaaaaaaaaaaaaaaaaaaatacatatatatatatgtatttaaaatatatatatgtatatttttgagacttttatttgaaagagtgagaaaattgacttgttttctattgctgtggagttgtgtttctcatcttttccacattttatagcatgtgctgcatgcttcctgggtatggctaggttttgataaaacctaaaaaagttctaatctccaaaaatctcagagttacatcataataatcatctgattctaaacccaaacccaggttgacatcttatttctaattaataactatatggggggttgaaaagttggccgaacacttggtaaagttattgtgtttgttttctttgaaatagctaacatgtgattgaaataaaatttctcatgggtggtgtaggtgctgagtaatagccacacacctagaatatttgaatgtaaatgcaaactttaagtacaggcattcaggtattccaagatacatgagtattacacaacacactcacacctgctctcttattaacaaattaaagagacatctaatgtttgcttaaactttttaaatgccttaataaaaactaaaatcagaatcattgggtgtttccttttggccattctttttccacatgaaagtcacagtctttacaagtttctcgtgaataaagagtgttctaacttgctcaatcatctggggttaccagagggagcctgtaaatactctagcttctttattttgtagaaatatacacacaagttctaaagattgcgcataagctaatgtgcaagtccagaaagaactctgtttgtattaattacttgtttagtatttatcatcttttctctacaaaagtttataggttcaatgtcagtagcagaaatcttccaaaatttgttcttacttcaataataaacttatgacctttcatcaagcaaaaagcctatgtgactcaccttccattaccaaacttcctgtatactctgacattaaactatcacaaataaatagtactgaatcctttgatgtgtggaactacctttagtgccccagcatatccataagcacaaagagaaagtattcacccttccttgccttttaggacgtgtcctttacacttagcaactgcatgggtttctcagttacttatgtttgggggataattcaactcttctagtttatgtagtaaaaatgaaaaccaataagccaatattattttttcagaacttttatgaagtgacttttgaggcccagcatgcagtcatttctcgtatggttttgtgtcagtttgccaaggaaacctttcattgaattttattcagggaagctacatgcccattttaataactttgaatttgtttttccaaagaaacatagatatcaaggtgagaggaagagactattccttagcttcattttgtattatttttccagtatgtttaaattaatcctgaaccaactttggtttttctctctataattcatttttcttgatgaattattttctaagcaataaataatgtcatttaaaattattctgtccaattttctcctaatataaccgatgaattttcaacttactgagttagtgatataactaatttattactcaaatatacaataccaagataaaaataattgtcttttagagtgatgcataaagttctgaaatagatttttcaaatcatagatgatcaacagaatgtgaaaatagtctcaattctgtaaatattttttatttgcttacatttatttatatttaaaatatattaatcagcaagtatgtaacttgtcattgtagagaaagggataagtgttcacacaatactatctctgtacagccactattcctgttcattttttatagcacttaaaaaaattgatatatgcttcacataacatgaaattatacactttaaaatttacatgtcagtgatttttagtatgttcactatattgttctaccattaccactatctaataccaggatgttttcattaccacaaaaagaaacctcatacctattaacatttagtcccaattcccccacttccttcattctctggctacaactaatctactttctgtttctgtgaatttgactattctggacatttcacctaaatggaaacatttcctgttcattcttgaaaagtagggaattgaatttaagttagggatctctgatctagaagggaaaaggaccattcaaaacttttataagtagaggcttcttgtccttattctgatttagtgcctaaccagtagtggtgccagcacactgttgtctcagaggtgaattacaagtgtgtggagatattaattttcttagtcctaaagtacttggcaaatgcaagtgttaaacgctctgaagagaggcactcttaacttagactacacaggaattcctcaggtgaaaccctgaactcacaatatagaattacaaaacacacaaggaaacagtttactaagagaaagagtcaggagacaaaagaaataggattatacatgcaagaacttcaaatactagatttgacagatagagactataaaataagtatgtttaaatgattagtaactcaaatctttgtaactgaggtaccatacacacagatatatgaagaaatgtacttattaaaattaaaaattcctggagaattaaatattagacacaaagaaaaaatgaactggatcagagatgtgagagagttatctagaatatagcacaagaagaataaagatttataaaaatggaaaggctaggaaacctgacaggaagttgttcaacatatatctaataagatatttcaaagagaatagagaaaatacagaagaggctatcaaagagataaaggcagataatttttcagaaccgataaaacacatgactcttcagactcaggaaatacaaggagtctgaaacagaataaatccacacctagacatgtcatgggtgtcaaaattgctcaaactagaaataaagagaagatcttaacaactacatagaaaagatgacttacaaaggagcaatattaggctgacagtggattaatatcttcaaaccctgaaacagaataactgacaactagaattctctacccagctaaactatcacttaaatgtaaggctgaaataaagacattttcaaagcctaggagaatttactataagcagaatcttgctgaatgaactgctaaaacatgttccgtaatgagggaagaatttaacatagaagaaaagatgaaatacaagaaaacgtaacagagctcgagcttaaaaaagaaatcaaattgacattttttacatcttacttccttttccttggatatggaaaatatacacgatttactattgttaatatttaacatttttctaagcttctatatataatagtttgagctgaatgtgaccttgtattaaatattttaagtactttttaaaaccaaattaaaaaataaatctggatagaaatggaccaaaagattaatagtcattatttccaaattccaggttatcactggtttgggttttatttgaaaaaagaaattttagttttcagtgcatgttttattattttacttgtaaatgaactattttttgagagacatctaacaataattcttctttcacttagatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaaggtaggattttattcatagtaaaacatgtattaatatttgctgttttctccccgtgccatttaatttaaattaagaaaagtaatttttggctatttttgatgatttaaaaataatatccaagacaatctattgtactgcaacactgcatttatgtttgtgagcccataagtttacagtacagtatggattggatggcttgggttaagattgtttttaaaatgctattttgaaatgagaggaagaaaggtcttataattgtaagattggtgctttaaagaaaggatactctataactataggagagcttcagcagacaggcccctgctgatggacacccacccaccgcctccccacaccactttgatggcatgcatgtgcacacagacctcaccaccctgttgtcattgatgggcttgtgcacagacctcatgactaccaccctgaccctaccctgccccctccagtgcacacatgtgtgcaccctgccaccccgccattgctggtgtaagcatatgcacacagaccctgccaccctgcccctgccagcatgtaggcactgctgccccatccctgctggtgtatgtgcaccccacctcattgccgccaccagtgcaagtgcacatgcacagtccccactgccccatcagtatgggcatgaacctcactgctgccaccccgatgaaatgcttttgccagcaccccacatcagagtgatcttgccagcagactgggaacatctcaggccctcgagcacagcaggtgcttaaatttgaggtcccagataacaaagccgtgggtctggtaccaggccctgtgggttagagcatgcagcccacgagtgctgagagagccttggccccctgaaataatccaaaaacaaagccagtcatctgaacacaacttataccatagtcaaaccttcaatggcatcaaataatgtaaaagtaaaaaactgcatccaaaggacagcagcttcaaagattaaaggaacatcagcccacacagatgagaaaaagccagtgcaagaacaatggcaactcaaaaacccagtgtcttcttacctcaaaacaatcacactggctccccagcaatgatacttaaccaggccaaaatggctaaaatgacagacatagaattcagaatctggatagccatagagatcatcaagattcaggagaaagttgaaatgtaatccaaggaatccagtaaaatgagacaagagctgaaaaatgaaatagtcattttatgaaagaaccaaaattatctgatagagctgaaaaactcactagaaggatttcataatacaatgggaagtattaacagcagaatagaccaagctgaggaaagaatctcagagcttggagaccaattcttctaaacagctcagtcagacaaaaatacagaaaaaaaaagaatgaactaacaaatcccctaagacatatgagattatataaagaaaccaaacctactactcattggcatccctgaaacagagggagagagagcaagcaacttggaaaacatattcaaggatattgtccatgaaaatttccccatccttgctagagaggtcaacattcaaatgcaggaaattcaaagaacccctgtgagattccatataagatgaccatccctaagtcatatggtcatcagattctcccagatcaaagtgaaagaaaaaatagtaaaggcagagagaaagggcatgtcacctttacaggaactccaccaggctaaccacagacctttcaacagaaaccctacaagccagaagagattgggagcctatattcagcattcataaagaaaagaaattccaaccaagaatttttgtatccagccaaactaaacttcgtaagataagaagaaataaatttcttttcagaaaagcaaatgctaagggaatttgttatcaccagacctgccttacaggaggtccttaagggagtgctaaacatagaaaccaaagataattattggccaccacaaaaacacagttaaatacatagaccattgtattagtctgttctcacattgctataaagaactactcaagactgggtaatttattttaaaaggaggttaaattgactcacagttctgcaggctgtataggagacatggctagggaggcctcgggaaacttaaaatcatggcagaaggcaaagggaaagccagcacatcttacatggtgggagcagaaggaatacacaaattcaaacaaccagatctcatgagaactcactcagtatcataagaacagcaagggggaaacctgccccatgatccagtcacatctcaccaggtccctcctccaacattgggaattacgattcgacataagatttgggtggagatacagagacaaaccatatcaaccatggacactataaagcatctacacaatcaaatctatataacaattagcttaacaacacaatgatagaaccaaatccacatatgacaatattaaccttgaatgtaaattatccaacttgccattgtgtgccccacttaaaaggcacagaagagcaggttggataaagaagtcccaactgtatgctgtcttcaagagacccatctcacatgcattgacacccataggcccaaagtaaagggatagagaaaaatctaccaagcaaacagaaaacaaaaaagaggaggggttgctattctaatgctagacaaaacagactttaagccaacaaagatcagaaaacacaaagaagggcattacataatggtaaggggttcaattcaataagaaggcttagctatcctaaataatatgcacccaacactggagcacccagattcataaaacaagttcttagggacctacaaagagataactatgcaataataattggagccttcaacaccccactgacaatattagacagatcatccaggcagaaaactaataaagatattcagaacctaaacttgtcacttgactaaatggacctaacagacatctacagaacactgtgaccaacaacagaatgtacattattttcatctgcacatggtacatactccaaaatcaaccacatgctcagtcataacacaattctcaaaaaattcaatataactgaaatcatactaactataccttcagaccacagcacaataaaaacagaaatcaatactaagaccatctctcaaaaccatgttggaaattaacctgctcctgaatgacttttgggtaaacaaataaggcagaaatcaagaaattctttgaaacaaatgaaaacaaaaatacaacataccagaatctctgggacacagctaaagcagtattaagaggacagcttgtaacaccaagtgcccacattaaaaagttagaaaggtctcaaattaacaacgttataccacacctagaggaactagggaatcaagaacaaaccaaccgaaagctagcagaagatgacaaatcttcagccaaaatcagagctgaagtctatgaaatcgaggcttgaaaaacagtacaaaaaaattaatgaacccaaaagttggttttttgaaagaataaataagattgacagactgctcgttaggctagtaaaagagaagattcaaataaataccagaaatgacaaaggagacattaccaccaaccccatagaaataggaaaaacattcagagactattacaaatccctctatgcacagaaaacctacaagatatgagtaaattactggaaacacaacctcccaagactgaaccaggaagaaattgaaaccctgaacagaccaataataaggtctgaaattgaatcagtaataaaaagcctaccaaacagaaaaagccttggactagacagattcatggctgaattctaccagacatataaagaagagctgataaccaatcctactgaaactttccaaaaaaaataagatgagggactcctctctaacgcattctgtgagaccaacatccttctgataccaaaacttggcaaagacacaacaaaaaaggaaaacttcaggtcagtatcctctgatgaatgtagatgcaaaaatctttaacaaaatactagaaaactaaacccagcagcacatcaaaatgctaacccaccatgatcaaggaggtttcattcctgggatgtaaggttggttcaaaatatgtaaatcagtaaatgtgatccatcacataaacagaactaaagacaaaaactacatgtttatggctgggcacagtggctcatacctgtaatcctagcactttgggaggctgaggtgggtggatcacctgaggtcaggagtttgagacaagcctggccaaaatggagaaattgaaatttcaccgtctctactaaaaatgcaaaaattagccaggtgtggtggtgggcgcctgtagtcccagctacttgggaggctgaggcaagagaatcacttgaacccagaaggtggaggttgcagtcacccaagattgtgccactgcactccagcctgggtgacagtgtgagacgctgtctcaaaaaaaaaaaaaacaaaaaactacatgtttatctgagtaaatgcagaaaaagctatcaataaaatttaacatcccttcatgttaaaaacccttaacaaactaggtattaaaggaacatacctcaaaataataagagccgtctatgacagttctgcagttaacaccatactgaatgggcaaaagctggaagtattccccttgaggaccagaacaaaacaaggatgcccactgtcaccactcctattcaacatagtactggaagtcctagccagagcattcacacaagagaaagaaatagaaacaatccaaataggaagagaagtcaatcacttttcctaaatgacatgatcttgtattgagaaaacctcatagttgctgctccaaagctcctagatccaataaaaagcttcagtaaggtttcaggatacaaaatttctgtacaaaaatccataacatttctatacaactacaagtctatataacattcaagctgaaagccaaattaagaacacagtcctattcacaataacacacacacacacacacacacacacacacacacacacacacacagagacagagagagagagagagggagagagggagagagagcctatgaatacagctaactggggaggagaaagatctctataatgagaattacaaaacactgttgaaagaaatcagagatgacacaaacaagtagaaaaacattatatgctcatggatcggaaaaatcaatattaaaatggccttattgcctaaagcaatttgcagattcaatgctatttctatcaaaattaccaatgaatttttcacaaaattagaaaaaaaaaactattccaaaattcatatggaaaaacaacaacaacaacaaatagcctggatagccaatgcaatcctaagcaaagagaacaaagcttgaggcatcacactatctgactttagactatactagaagggtacagtaatcaaaacagcatggtactggtagacgcacagaccaatggaacagttaagagaactcagaaataaagccacacaactacgaccatctgatctttgagaaagttgacaaaaacaagcaatggggaaaggattcattattcaacaagtggtgccaggttaactggatagccatgtaaagaagattgaaactggaccccttcctttcaccacatacaaaaattaactcaagatgcattaaagacttaaatgtaaaacctaaaactataaaattataaccctagaagaaagcctaggaaataccattatgtgatattggccctgatgaagatttcatgacaaaaactccagtagcaattgtgaaaaaaaaaaaaaagaaaattgataaatgagacctaatcaaactaagagcttctgcacagcaaaaaagaaagaaacaaaaaacaaaaaacaaaaactcttgccagagtaaacagacaatctacagaattggagaaaatattttccaactacatatctgagaaaggtctaatatccaaaatccataggtaacttaaattaacaagcaaaaaacaaccgaccaaccccattaaacaatgagcaaagaacatgaaaagacacttctcaaaagaatacatacatgtggccatcgagtatatgagaaaaaatgctcaacatcagtaatcttttgagagatgcacatcaaaaccacaatgagatactgtctcataccaggcagaatggctatcattaaaaagtcaaaaaataacagttgctggtgaggttgcagagaaaagggaatacttatacactgctggtgggaatgtaaaatagttcagccactatggaaaacagtttggagattgttcccaaagaatttaaaacagatctaccattgcatccagcaatcccattactaggtatataccaagtatatacccaaacatactaggtatgtttatcacagcactattcacaatagaaaacacacttgatcaacctacattgcccatcagcagtagaccaaataatgaaaatgtggtatatatatatacaccatggaatactacgcagccataaaaaagaacaaaatcatgttctttgcagcacatggatggagctggaggccattatcctaaacaagttaactcaggaacggaaaaccaaatactgcatgttgtcacttataagtaggagctaaacattaagtacacatggacacaaagaagggaacaatagacactggggcctacttgtgggtggagggtgggaggagggtgaggatcaaaaaaatctacttactggatactgtgttttttacttgggtgatgaaataatctatacaccagtcccccatgacacacaatttactcatgtaacaaacccacacatgtacgtcctgaacctgtaatacaagttggaaaggaaaaacggaaaaaaaaaaaaaaaaaaaaagaaggaaaggaaagggaaaggaaggggaaggagaaggggaaggggaaggaaaaaggaaggaaaggaaactctaaagcagctaggcataagagacagctttatacaaatataaaggaagaaatctaaatcatcctttgacaaatgaactggcaagattaagtctcagtccagttaaatgttttgttggagaatttcaattttgtcactttgatttatgtcaaggtataattttggcttgtcactcttttttagaaattttaatacgtgatgactacatggaaaggtaaaacacctttggaataaaacctaaagctattaaacgattccattgtaaataatatggtgtcttctgtgtgttggtcttagcaaatttttttaggtaaataacttttgcctatctagtcatgggtgtgcttttaccgctatattaggttatttaattctcatagctggtaatgttaaaaatgagattaacttgatctcagagggataaaggaaagattacaagtcccccacctcctgccagtagagaaaggattggaacctagcattttcattaattgtatgattttggaaccatactctactcgggtacctgggcttctatttttctcaaggacattgaagttcagtagtttcttttgagtagacaagttttaatttcattctgtggcttttgttaaatgccagacttctgaaatagttcattttatttgtttgcctgtatttttattgttttagagggagagtttgttcactgagttcctcattcagccattccataagtcaatctccaagtgtttgtttttatatcacgtgtttttttcccccaatgacttaaattctgtcttgctgggttgtgctagagaaagagggaaaaatgctaaatggaaagagcagatggtagaaatataaggcaaaaggagatggccaattccaatatccataagagtaaaaataaacagtgactgggacactagccagaatcaagaaactttaggtcccttatccattctgaccataaagaatacctaaacctatcacttgtttctctgattctctagtccctcattgcctacttcctataccattcctctttattccatcaggagtttggagctaattaagaattcctaatttctctgtagaggaaaggaaatgggccgggtgcggtggctcacgcctgtaatcccagcactttgggaggccgaggcaggcagatcacctgaggtcaggagtttgagaccagcctgaccaacatggagaaacctcgtctctactaaaaatacaaaattagccaggtgtggtggcgcatgcctgtaatcccagctactcaggaggctgagacaggagaattgcttgaacccaggaggcagagtttgcagtgagccgagatggcgccattgcactccagcctgggcaacaagagtgaaactccctctcaaaaaaaaaaaaaagaaaggaaacaaacttaacagtgcctactgtatgccgggcaatattttgttacctcacttgatccatagagcaactgaggatacacacacacagatgcacacacacactatacatatacacacacacatatacatacacacacacatatatatgtactgtctataccattatctctgttttacatatgagaaactgaaccttggataagtaatttgctaaaaatgataaagcaagtagtgacactgccaggattaaaattcaggttcattgtgtgcaaaacccatgcttttctcactgtgtcatgctatctctagagagaggtatttctggttccaggttggaactctaaatacgtttttccatagaacttatatggtgattaagttttcttgtagcttgaaagtatgtgatagctatgtgaatagctatttttacattattttgaaggtaatgtttcattgcagatacattgtggaataaatgatgtttatgggaaagactgagaagtttagcaccatgcttctcttggaaaatgcctcattatgctcagacatagacattagagacacagtcatatccacagtaaccttttgctgatctggaagttagtttggataagacacctggtagtttggataagatacctggtgaaacccaactgaaaaattaatgctaaaaaagactagccgtctatagtcccagctactcatattgaggctggaagattgcttgagcccagagattgagatcccatctcttaaaataatagtattaatagactgctagccaggcacagtggctgatgcctgtcataccagcagtttgggaggccgaggcaggaggattgcttgagcctaggaattagagaccagcttgggcaatatagtgagaccctgtctctacaaaaaaattaaaataaaaacgttagctgcgcatcatggctcacgcctgtattcccagttacttgggaggttaaggtgggaggatcacttgagcctgggaggtagaggctgaagtgagccgtgatgcgtcactgcactccagccggtatggcagagtgaaacactgtcacctaataacaaaaaatattaataatagactgctgatacattattaagtaaaaaaagtgcataacagaatatagtgtgtattaaaaatgttattcatttctgtgtgtataaaaaatgttattcacatgtatatgcctatgcacatagacatatggtcacatacatttccaaaggaatcacaagtaatagtgattacatctgagaagaaaggtcttggtaagatggaggtatgccgaacattgaggaaggcatttcttttcatgttttaacttcctatattgtttgaattttcaaaccttatacatgtacttttgtttttgtttgttatgctaatagaggtgagtaatgagatcacttatctgttttttgttgccttctgtatatgatatgtacaagataacattttcttaaaatttaccctcagaggaagtcactcttaggcttgaccagtgttatcaaattgtgtgggccccgtggggttttatcaggtggcttagtgttctgcactggggaccaggtatggacgcttggcaggaaggctccggacccccttttccatttctactgtgcaaatccatgctcattcattttatatatttgagttcatttaagatttcatttgaaaaaatgtagactattgccaaaccaaaaggaaggaaatcaccaactacacaattatgtgtgagataaggcagtagattatcatcagtgatatgctgacaataattaaaaaatgataaatggaagccaagaatgcagttggaaagtagtacaggacttactcatcacaggaatatgcctgtatatctaagtagttcctgaagactttgcagcatcaaagcttggtaaaataattgacattttgatatgaaagggtcttactacatttagtatacgatattctatttaaggaagcaggaaaatgtgttttacatcaaaacatttctgttaaaattattaaagagtttttgatgcttaaaaagatcagcatctgggccaattggttttattatttgtaaattgaaaaggacaaaataatttaattaaaccttttggataaaaaacggctcaaattatagttgaataataaaaaattacacaacaattatttgtatatcaaaatgctgaactacactcaatgacaactgactgcggaggtggcaaagtgttcactgtcataaaatgacaactcagccagatgattgatttctccacctattgcctgaaacttatttttaagaaaattcatgaaaaagcaccaagactagaatttaaacaaagtgataataaatgtatacttatgttgcaaaataaaattcaaactgccccacaggcagctgtgagcccctcagtatcataaatccacataaactctacacttcagaccattgatttccatgtttgtaaaataagaaaaccacaatatttttaaaaaaacagcttaagaaaaaagatcaatgtttagagaagtaaactgacattaaacatgtaaccatccagtaaaataagttagttccaatgatggctgaccaccttttactgactatgaatataaattaatgaatatgcaaactactagataaaattcatgcacttaatacaacatgcaatttaagttattagaaaaaattcaggaatataaatgaaattgttcccagatacatctgctaaagtatgttattaaatactatatgacctagttccataaaaatcataatataaacagccaattactgacaataaaaaattaaaataaattaaacttacagttctctgattgcatagaaaagagccccaccgtacattccatgatgaaatgagtctggtcaagtagagaagggccccctcaaagatcttgattggcagagctccagtgattgacagcaatgctactgtctacttactccctctctgaaaatggaaaccctatctgtatcttatggctcagctaaataactgaagtcttcactcatattgttgcttctttctagaaagttctaagcaagactgagggttttcacttggatgttttcagacttgagtagactacagaaactgtggaaagctcagggtaaactcaaagtaactcacagcagtcttacttattgctcctaggagcaaattcaaaccacaaagcaagcacccttttcagcttttcaccttatataatggcttccttccagaaagttctttacctcaatttctgtctgtgtaaaactgtgcagaatggtgtctcagggccattcctgctgaaaaacagtaaacacacaatcaatgtgttaatttcctatcatatgtaaattgaaaatgtcaaacctttcaaggaaaattataaaaaggatgagaatcaaatgtaatttagtaaaataataaacacacagtttttaaaagaaaatttaaaatgccaaggttcaatgacagctaggaaatacaaaaggtaatcttactttacctgtaaattttttacttactgtcataccctgttcctcaatactactgaataaatggtatgctcctatatatattagctgttctattggttagtattttttttttgtaatgagtaatagaaacaagacatgtatttgaattttcttgcttaaacagaaaggataaagttacaaagacttaaagatattttgccaaaccctaggcaaagaatacaagcttggcttcaggaacaactgggaatcagcctcagtgtatctgcttctctctctggaataccttcaatctgcttttacctttttaatgatgatttagttaggcaaaacagtttatgttctggaatttcctacctcccctgtacaaagctacccttccttcagtgtgtctgactttagctaatggctaagaacaaattacactgactcaactacctttttaaaatatatatatgttgaccctatcacaattgttaatttaaaaaatatttttaataaaatgagtctctgtttaatggaattttagttggaattaggattttctgtgggcaatagaaagcctcacatgtcagcttagattaaaagataaatttatttctgtctttaaaaatattgaaggtccagtgctgatacagtagtctcacagtcatcagggatcctattatagtaatataatagtaatctataatagatctataatagattactattctaccattttcagcctaggcttatacttcatggcccaacattgtccccattctagtcaacaagaaggaagggacaaaaatagccacgccaacctccacctagggaggctagaaaatgtatcatttttctgggcagttgtgttacagctgaaaatcaagagttctattactaaagaagggtagaatggatattaggggtcagttagcaggctgtgccctaatacttatttaaaatgtgaatgtaaatgtaaatgagcctaaatcttggtgtctctcttatgagaaaacctgattacttgcaagagtctttttaaaataacatttaaaccaattaagccaagcacggtggctcattcctgtgatcccagcactctaagaggctgaggtgggagattcgcttgagcccaggagttcaagaccagcctgggcaatatagtgagataggtctccacaaaaaaaaaaaaaaaaaatagccagtctgggtgccacacacctgtagtcccagctactcaggagactaaggtgggaggattgcttgagcccaggagcggaggtcgtggtgagccactgcactccggccttagagatgcagcaagatcccatcaaataattgatagattgatacctagctagctagctagatagatgatagcaaattttgagggaagatcagaatattttacaattgaccataaagaagtttaggtacattacaatgcaaaaacacaaaaaaacccaggctgtcgaagttgaatagtttttttcttcaaggtcattgctctacattcatattatgatgtctggaaagacatgttaattttcagaacatagaattactggtgaggaagttgaaaaacattccttttttccctcctatagcacatatggtatcatttctaaaacatatttggatgtgtgcacttcatggcctggactagggtgaggcaagagaaatttataagacacaaaatttaaggaggcacattgtcttaggttggaacaagtgtgagctctgcatctgcaccaccctaaaagtgaatggctcctgaaatcttgcactctgtgcatccccttgactcacactagtcccagccatggtgcacagatggggcaaatctgacagagaaatgtgcagcagcagtaactcacttacaggcccttgtaaactcaaagaaccagtaacgctagcatcaagaatacccctaaaagtttgcctcttgatttttctcactgtgttcaatgggaaagataaaaatgctaaatttttctttttaaccctgattagaatgcttgccttttaaaacaaaatttgtaaagtttgatttagaaagtttgctcatttatatcagtatatcgtgaagtaactgaattaaagtgcctgtcacagttttctgagaattgaattaccatttttctttatgaagacaaaaatgcctccacatgggaaaacaacctgaataaagtaaataacttatttgtgtactttaacaataaagaatggctcacaaatttggcttatttgccaaatgctttataaagactgagcagttagtaacaaatggcaaatggagtgctattgctgtatattggcagggctactttagggcatattactgatgataaatgtgaaggaagcactggttagctcacctttactacatgaaaaaggaaggggattttatctggagtatttgaatagattcacacaaactatgacagaagtcttccaaactgtctgtactgataaacttcactttaggaaaaacaaacaaaaaatgcacagtggagttaggactgtggtgaggcaagagagacaattatggtgcaaaatttaaggagccactaactcctggaggcatgcaagtacaaacttggcacttaaacaaaccgaagagtgtcttcataaattttggcagtaggtacctcttttttttttttttttttttttttttttttttttgaggcagagtctcactctgttgcccaagctggagtgcagtggggcaatctcagctcactgcaacctctgcttcccaggttcaagcaattctcctgcctcagcctccctagttagtagccgctttgcccactttttaatggggttgtttggtgtttttgtgtgtgtgtgttttttttttgtaaatttgtttaaattccttatagatgctggatattagacctttgtcagatgtatagtttgcaaaaattttctcccattctgtaagttgtctgtttactctattgatagtttcttttgctgtgcagaagctcttcagtttaattaaatcccatttgtcaatgtttgcttttgttgcaattacttttggtgtcttcatcttgaaatcttggtccatgcctatttcctgaatgctattgcctaggttcttttccagggcttttgtagttttgggttttacatttaagtctttaatctatcttgagttaatttttatgtggtataaagaagggacctagtttccattttctgcatatggctagccagttatcacagcaccatttattgaatagggaatcctttctccattgcttatttttgtcagctttgtcaaagatcagatagttgtaaggatgtggcctcatttctgggtcctctatttttgttccattggtctatttttgtacttgtttttgtatctattctgtgtctattttgtctgttttttttatgtccatttttgtaccagtaccatgctgttttggttactgtagccctgtagtatagtttgaagttgggtagtatgatgcctctagctttgttctttttgcttaggattgccttcgctattcaggataggctctttttttattccatatgaattttttttttttttttttttgagatggagtcttactgtgtcacccaggctggagtgcagtggcacagttttggctcactgcaacctccgcctctgggttcaagtgattctcctgcctcagcctcccgagtagctgggactacaggcacatgccaccacacccagctaatttttgtatttttagtagagactgggtctcgatctccagaccttgtgatctgcccacctcggcctcccaaagtgctggaattacaagcatgagccaccacgcctagccccatatgaaatttaaaatagttttttctagttctgtgaagaatgtcattggtagtttgatgggaacagcattttatctataaattgctttgggcaatatggccattttaacaatattgattcttccaacccatgagcatggaatgtttttccatttgtttgtatcatctctgatttctttgagcaatgttttgtatttctccttgtaggtatctttcacttccctagttagcttatttttaggtattttattctttttgtagtgattgtgaatgggagttggttcttgatttggctgtcagctcgactgtttttggtgtgtaggaatgctagtgatttttgcacattgattttgtatcctgagatttagctgaagttatttattagctaaagaaacttttgggccaagactgcggtgttctctagatattggattatgtcgtctgcatacagggatagtataacttcctctctctcacatagtatttgaagtcctagtcagggcagtcaggcaagagaaagaaataaggagcatccaaataggaagagaggaagtcaaactaaagcatgttttcaacaaatttcagaggttgaatttatgttgtctgcctatagtgtaattaatctataagtcaataacaaaacagtaattataagaagcctgggctgggcacggcggctcacgcctgtaatccagcactttgggaggctgaggcaggtagatcacaagatcaggagtctgacaccagcctggccaacatggtgaaaccccgtctttactaaaaatacaaaaatttgctgggcatggaggcacgcacctgtaatcccagctactcgggaggctgaggcaggagaatcacttgacccgggaggcggaggttgcagtgagctgagatcacgccattgcactccagcctgggcgacaaaaaaaaaaaaaaaagtctctatatttaaaattaatatatatttcaagtaacctatgactcaagaagaaattataacagaatataaactgtaaattcactgaaaagttttagttttactacttgacatgttgacaaagaagatattacagtcaacttgaactcctgtaatcatttctatgagggctttatgttttacttaaactttttgtttggcactgttttttgatataagtcccaacttgaaaggcttgaagagcaagcctttcgtgtttgaacttggagaagagtctcaaaagcaatcatagcacaattgagttaatggagcaactggatattgtaaaataccttaatattccttttactgtctgtatccatgacatttaagcaagagttttggacatacttttattgttaatagatattctttaactggcttatatacagagagtcagactactgtgggacatgtaaacgcttcaatacctagattaaaagttgtaatctaaggattaatatatatattatatattggctccattagcgctattatcattaaaggtgtgttagcatcctcttcgcagacttgcatatagcgaggccgtttcactaggttttaagtttatggcttaggaaacttttaattttttttttaaacttccaataattagcattcagcagagtgctgcagaaagaagacttttaaagctggataaacctctctaataatgatcttattgaaaagcaaagccagtaattgaaaatacattgtgactaaattaataattctttgggaatgtaaacttataaagtatgtgactttaactggtaagttttgtagtattactgtatagtaaaatatgtttctagtgctaaattccagtttgggaccattcttatacctaaaatgccttgtgaattcaagagaattttttatgcgcatttacatcataattgtttatctgcatttacatcacaatttccaaattcttagagattaatagtgtgacgtaaccatttggataaagatactgaagctatttttccaccaccaccacgtgttattgaaacgaaattgtttagtgtttttctgtgtaactcttcttaaatgcctttttagattatactgtagctaggtgggtgttttttggtttttagttttttgtgaagaccattcacatataacttcttgtggtaaatcttcacaaggaagcaaaacagaaaaggttcatttaattgattagcataaataacaggttttcttttttattttaatcaaaaaacaatttattctttaatgttttcacagcttcagttattaagtagaggttgtcatttggcttgactttaatgaactaaatatatatgtaatgtgcacttatgattttcatacagatgtgaaaaaatttgatcatgtgttattcttattatatatttctttaaaacttgctaatacttttaattctacgtagcaaaactttaccttatacagcagatgttatcctcattgcagcccatgctattctcacaaatttataattgactaaaaatattttagtataaaaattatttatttgctccctcccaccctcaatagtgtttccaatagagctcctctaattttttggaaagaaaaaattactccaaaatatttacttaatacaatttaatatatcacatccaaatcattaccaattccatattaattatatttgaagcatgagacttcagagtacacataaaccaaagtaattactagtattccttttaatttcaaaaatatgaactcaaacatatgtgtacttcattatttctatgagcaacagccttcactttgataaacattagcaataaaaagatagtaatgaacatttccaaaagatatttttcaaaagaaatattatttttatctgaatttgaaattaagcttttacttactctgaaggaggcatccaagtagtgttaccctaattcctaaaatgtcaagaagaaggcaaagataaatgaacaatatatggcttgccaaatgctttttaaaaagttgagtatacatacacatattatatagttcaaaacaacattttctttgtgtcataagtaaactttctatcatatatcattagtaacctgagtatttttattataaaaaatactctcatgcgcgatcgttctcataacttttttttaaacggtgtgagatgttaaagtgctgtaaagtagaatctgaaatctcttcaagagttaatctcatttggcagtgggttagtaacaccagtcaggtggaatgctacaccagttcagtagtgctcattactactcttaacactgctttgaacatcaagtaaaaataaattatttatcttactaaaataagattactttagaatttgccaagacaaggggaaatatattcctaagaaatgtttattaatgataatgttaactgattttgtttaggtgagaaataaactaattcaaaaatgaatgaagcagaaaaatattgatcactatataagttttcctcatccaagaaatgtggctttcaggtttggaggtgggtataggtggcgaggtagtatcctctaaacacttaagatgtattaaggctgggcatggtgactcacgcctataaccccagctccttggaaggccaagacaggcagatcacttgagctcaggagttcgagaccagcctggccaacatggtgaagccctgtctccactacaaatacaaaaaattagctgagtgtgatggtgcacacctataatcccagctagtagggagactgaggcaggagaatcacttgaacatgggaggcagaagttgcagtgagccaaaattgtgccgctgcactccagcctgggtgacagagcgagactccgtctcaaaaaaaaaaaaaaaacagcaacaacacaaagacatctgggacatgcctgacctcatgtgctgcttcatgcattcaatatttatgtagcccctactatgtgtaaggaactgtcctgcaaactaggagttgagagggacatgactaagacaaagcctttgtctttagcaagcccaaaaactacccaatatggtaggcacataaacaaaaagtatggtacattataattagggctataatagagataagctagtgtgccataagagcattaatgagcattacttacacctctgctatctcttcttctgaatgcactcctcattagaggttagaaataggaataggaagagggagagagagagagagagtgaatgtgtatgtgtgtagtgagtggggcagcagagatgacaattgatctgagtgatcaaaggataattggagttcactacatgagcaaagaaagaaggggaagggcatttcaacaggaacaggtgggcaaatgcattgaagtatgaaagtgcccagttcaagagaccatgagcactactagtgtgattgtgggtgcagtaggtgagtggagtacctggacataaaaatggaatcaagttgtgaatattttatatatgattgctaagaaatttggactttattgtgtagacagtaggaatagtagcattctattgaaaccaggtactgaatggcactattaaaagattgtagtaaattagctgggcatggtgggcatggtgcctgtggtcctagctacccaggaggttaaggtgggaggattgcttgaacccaggagttagaggttacagtaagctatgattgccccactgcactgtagtctggctgacagcaagaccctagcaaaaacagaaagaaagagagagagagagagagagagagagagaatgctgcaggcaagcaggcaggcaggcagggctgcagtacctgatacagctatgtatttgaaaactgtacggatgaatctcaaatgcattattcagaaggctacatttggtatcattctacttacatggcattccagaaaaggcagaattataggaacagataactagtggttgcccaggggtagggaggggtacagaggagttttgggaagtaaaagaatagtgctgtatccagtgtggtggaggttatacaagtgtatgcatttgtcaaaacttgcataactgcacactgaatggatgcattttactgtatgtaaattctatcatcatcatcatcatcatcatcatcatcatcatcatcatcgctgcagaagcagagaatatcctgagcaacagagccctcctataataatgcatagcacttccagaggagcttgtcttaacattcctatcttctttgccttatttctgttgccttccctgtcttcagcttctgctgttactgatacttttggcattttaacctggggccccagtgacttcctttgatagatcttgggtccacagttgtaaaacagaactggagctcactctgttggtttccaggatcaaccttgtataccagtggatactatttgataaaggaaaaacacatgatcagatttcaatagaatgaaaactttgaagacagtatgtgacagatagaaactgaagaaaatgaagacaaggatatagatgagtaacatttataatatcccaggccagaaatcatgaggttctgagccattgagcaatgcagtgaagaaagagtaaacaaaattgtttagttagaagagagaagactacagaatagggtctgagggaggaaaaaagaagaataagagtcaaggatgattcagaagtttctagctttggggcagctggttggattgctcattccacttactcaaattcaaaaaatattgagtactgaactgtatgcttaacaatggttaaattagtaaatttaatgttaggtgttttctactacaatttaaaaaatatttattgagcactcagtgtgccaagcaatggaaataatagacactggatataatagacacagtttctaactttctggagatactacaaagtgaacccacaaataatatacataaaaatcatggtaaatgcatcggaggaaaagaacagggtactataaatacaatgatattagatctgttaagagataataaggagacaacagtaagggagaagaattccaggcaacatgtgtgaagtccttgaagcaagtaataacttgtcgtgtttaaagaatcgaaaaaaggctatgtaactggaaaggagtgagcaaggggacagtgatgttatacaagtcagagaacgtaggcactgcctgggatgtaaaggatcttacggaccattgtaacaattttggcattaaatcatgcgtggtggaaagccagttaagttagtgtatgtatgtatttgttgagggaaaggcaacgtgatttgtaacttcatattctaccgtacattttattttaacaaatgaactgtccctacttttatctaaggactcacacatcaatttgtgtattaaatccatctctgtggtctactcagggctttgatcctgattttacctctctgcttcttgcatcagtgtcttattctgtacctgaccacttcagttaggttacagatataatatagcccatctttaaaaaaaaaaaaaacaaaaaaccctgctagactccaggaatcccttcatctacttccctgtttctctgcccccgctactgaaaaagttgtctgtactcctcatctctagttccttaagtctactccaaacaggcttttctatctctgtcctttgaaacctctctggttaaagtcactcacatcttgccaagtccagtgcttaattttagtctatcttattgatcccttcagcaacatttaatgtagctgattactttttcctttataaatttttagcagaattgttttagctagataacatattaatatggttcaaaaatcaaaataacataaaaagatatacatggggaagtcttgcttctactcctgtaccatttactacatttcacccctttccaccctgcttcctaaccataaccactactattagcttcttgtgtattctcctcgtagtttttacacacatacaagcaaatccaaatgtttattcgtattattccctttcttgccccaaaggtaacatcctataaacactggtctgcctccttaattttgctcttctcatttaacagttatcctagaaatcttttcaatttggtatatggagagcttccttattctgtgtacatctctattccagtatgtggatgtactataatttatttagccaattactcatacatggtgttttcagtcctttgttgttatgagcaatgctgcaatgaataaccttgtacatatattatttcatatatgttggataaattttctgaagtgagtcaaagtataaatgactgtaattttgatagtcattgtcaaaaggccttccaaaggggttgtaccatttgcaatcagatctaattctatgacttaaaaaatactgtctctttagttatgtgtttcaaatttgtatctctagttcccactttttcctgagctctgcctactcagcatttctcctggtgcaaaattgaactatatttttcttccaaacttcttctcaacatttctcttgctgcaaaattgaaatgtattttccttccaaacttgctgtttcccctgtttttcctatctcctagaaaatggcattgcctttcatgcagttgctcaggaagaaaacttaagagccatttttttctcctgtttcctataaactacctatcctagttcaaatagatctttatttgatggtggaaatgttctgtatctgcattaatgtagtatccacaagctacacgtgactgttgatcacctaaagcatggctagtttctctaaagagctgaattttacagagtgaaaaataaatctaaaggccctgaggctagaatgactgagcatgaggaccagaatactaatggaacaaaaaaggcggtgagcggaaagaaacaagtttggagagagaggagatgaccaggtcacacagggcctcaaaggtcacggtaattttattctgcaggttatgggaagccattggtgggttctgattcgcgggagtgacataatctgattaataatattaaaaatcattccagcaagacttccagttccaaaagatacttgggagatctttctactgcaaaacagtaagatactgcataaaataaagatttttattgaattgtcaggcacagttattgttttctttaaataacagaaaacctgaggggtgagccgtgagctctcctgaaagacagagttaaccaagagcagaaaaattgttttgttttgtgcatatcttgatgtatatattatctttcacagtaagtaaataaaaattttaaacttggcatacctctaaagcagagaaacattatttctccagttttctaacaactcagtccctcatttcattcaaatctcttctcaaatgctacctccttaaagaagccttccctgagtaccctatataaaccaccccttttctccaatcactatatcatacctatgtactttggtcttctttatttctatatccttagagcctagcattggtgcttagtatgcaataggtactcaataaataattgttgggtggatggatagacgaaaggaaaagaaagagggagagaaggaaggaaggaaaagagagaaggaagaggggagaaaagaggatcggagaggagaccaagacagtcatcctggctcggcctttaatagagaaagagaatgtaaggataattttgtgttttaaaaaaatgaatttggttttagatagactaagttttagcttctacttccattgtttttccccctcttccatgtagaatatgcacctacacgcagatggcagaattaacatgagattggtcttgcctgtttaaggggctggtgaagtgttcattacattttgtgaaataggcaattaataggaaagaaaaatgcaaactataagaaaatggcccttaaactttcaaaaatacctcagctcagaataatcagaaggtgctggcttgttgaggtttaggagaaaattaattaattgtggccttcacagagaagatgtttcattcatgaactcaggagctgaaggggtcttccctaaattcaggacaacattgagaacaaggccatgggggactgagccttggagtagaacagtgacatctgcacataagggatattgttaaggcccatgtggagaaaataaagctggcttcaagtgtctcaaggtacaagacatattttaatagagaaatgggcagtgcacattttgtaatgtttagtatctcctgtgttccttcctgtccctttattgagaataaggaatttttccattcagttttgcagtttataggctctcactcagggataatatgaaagcatacactcttgccagaaatttttaggtgtggacttggagactctgggtctgaaccaggtgacagcagtttacatcagacttggacaaagaacacctggcatttgttctgtcacagatatattacatgcatatatgctggagttccacactgaggccatctgaaagtttcaacgatgatggtggttcctaactgctaaatcatgaaaatctttgacataggacattctaccttgatttatctgggtctctttccatataaactcattacttcaaagacgtctatctgctgaccagttggcagaagttccctatgcatcatagcaatttcttacatttataagattctccatagtctccacaacactgaaatatgcacagtttattttattgtctgtacagaatcgtgaagtagatggagtgggtgctgttgtctccactttacaaataaaggttagaccattcattgtatcacatgtaagtgtgctacatttcaggcaaacacaaattttagaatggaattactgagtaataacttgcaaaaatgaatcttctatttacaaaaataggatttggaaaacctctgttcagtagtaaactttgctagtacatttaagggttctatggtgcattaactactagacccaagcttggagaaacacagatatcatggtctcattagtcacttccaatataaggaaaataaaaaaatgaagactaaatatttactctaaaattacatcattgagaaagtgtaattcagtgaaggaaaatgatgttcacaggcttttttgaaaaatgggaggttatcttacttaaaatggggaaatgaccaggcatagtagctcacatctttaatcccaggtctttgggaggctaaggcaatgggggacacaggactgcttaaccccaggatttcaagaccagactgggcaacatggtgagaccccatcttcacaaaacaattttaattaggtgggtgtggtggtgcatgcctgtaatcccaggtactcaggaggctcaagtgggaggatcacttgagatcaggagatcgaggctgcagtgagctgtgatcacactactgcattccagcctgggaggcagagtgagaccctgtctttaaaaaaaaaagaaaaaggttgggaggaagtgttttttgttttttgtgggtgtgtgtgtatgtgtatatatatatatatatattttctttctctgaattttatcttaagttttgtctatcaagatttgagaaattatagtaaaatatattggtgacattgatggcaaatgatgttatcagtttgtttatatttatactcatattttgctgtcaacttaaactatgcactgaaatatcttcttggaaagtatatcttatgtatttgattattttttattatgaagcagtagcaagttgttcttagcagttgtttgagtttatatggtaagtagccaagtaatttctttaaaagtcttatattcagttttgccttatactgtgaagctcatttaaagtcaacaacactatattttatagaaagtatttattttcctttattaagccataggaacaacagtggccttttccttgattgcttgaaactaattgagcttggttcatcttaagttggcaggtgtcttttttaacttggacataagatgtgtgagtaagtgttcccgtattttagtcatgatgagttacgagcctattaaaaataattatcttcacctcataaatctttctttagttaagtttattttagttcttactttaatcttcctattaatgtctgctagtttgggtcagatgcatatgaatagcaacaaattatagatttgagctatatttagcatagagaaaaaggccagtggcatagtatattatagctgtagttcagtgtctgttcaaaagagtttcaggctcaacccaacccatctattttgctgtttattggaattgggaacgtttaaaaaagttgaatacgataatttagcttcatttgatagaactggataatttaaaaagttggagatgctattttatagaggaaacaaaaaaaagggaggctgcatttgccaaaatctaatgatgataacagggttagaatagatcctctgagttaattctcgcttgtgaatatgaacatttaacacttagtttaaaaaaaaaaaagaaaaagaaaggtgagcacagtggctcacacctataatcccagcactttccaaaggccgaggtagacggatcatttgagtccaggagttcaagaccagcttgggcaacatggcaaaaccctatctctacaaaaaatatggaaatcagcagggcgtggcagcgattcctgacgtcccagctgcttgggaggctgaggtaggaagatttcttgagcccaggaggttgaggctgcagtgagccgtgactgtgccactgcactccagcctgagtgacagagtgaaacgctgtctcaaaaaaaaaaaaagaaaattcagcaatgtactaccaagtatcaagaacattattataatttttagcaaatatggttataatatttataacacacaacttccaggttggaggcctacctgataaatcaagtatttctgagacagtgtgggcatgttagttacacgttctacaagagcattttttaagtcatgttcaagagtgtgctttgccattggcttctccatttgttgaattcaggatgacctatgcatgaataaatacgattaaggtatgaatttttcaacaatgaaaaaagcaacagatgtagctgactttgaacgtgggaggattgttgatgcactagtgcctaaggggagtgtctatgaggggaggaaaaaggaaagaaaaaaataactttccaaaatgtcagaaacataggaggggaagagtaaaaatagtccagaatacctctgtaggtcttttgtaattgtgatgaaattaccttgcagtttgaaaatcactattctttaaaatgtttaacatttttctttttgtattacaaagatgttgcttgaaaaaaatatatacatgcattttcaaaaatatggatggctaaaggggtatcgttaggaaaataggaattactagtaaatgattttatgaaggctgcttctttctgtcatcttattccatgttgggctgtaatagttaaaactgtgaatattgcataaaaattattctgttaggttataaatgaaaagtaacaagtggcaagactccaaaataattatatgtatgatgagaccatagttaatttctgactggtatatatgaaatatttttaaacagttattgcatataaatcactttacttcattatattttgctttgtttcatgtaaaaatagttggtttattttaaaagatattagtttgttatatagattctcctttcaggtgatttaattcacaactaaatcttatctttagtgtctattccatgctaaatgtgcattctggaagaactggcatttttgacatcagtgtattctagttcttgctattattagctcacttgctaagtgagctcttgtagtatgcggtaatgaataatctttgagctgtgaaaagaagcaaaatgcacagagaagcatttaaaacaaagggataattttatgcttcaactattaataactgaaagttctttagagggtttagtgggcaaatttatgaggaaaaataaagaatgaaattgttatgtctattcactttattaaaattacatgctaagtcttaaaggaacattctagatataaaatatttaaactgctccaacttggtgtagcatttttacaataaatttctatcagtgtgaatctatatgatagttaactcctataatgcctatagttctaattttaaaatatgtaaaggaatgaatccatgcaagaagattgtaataaaggttttaatgagtgattaaaaataaataattaaaaatttggaataaagaagaaaaacctaaacatactgagtcaggccaggtgcagtgactcacgcctgcaatcccagcactttggaaggccgaggtgggaggattgcttgtgcctaggattttgactccaccttgggcaacatagttagaccctgtctctacaaatttctttttaaaaattagctaagtatggtggctcactcctgtagttccagcttcttgggaggctgaggctagaggattgcttgagcccaggaggtcagggctgcagtgaaccatgtttgcaccattgcactccagcctggccaatagagtgagaccctgccttgaagaaggagaaggagaaggaggagaaggagaaggagaaggagaagaaacatattgagtgaaaaggtctgctccccaaaaggagaaaattttcgtccatagtttcttcatctaatacaaaatttttaaataggtcctcacctccttctttgattttgcagtgatcatttaaaacctgagtacatatcttacttccaccaccagcaccaccaaatctaagaaataattacttacctttctatgttttggtttatttttgctctttggactacaagcaatataaggcttgtaagggaaattgtacattcatagcaatcaaataaccataaaatatgatatagagagtaaattaccataagaaactgtggtatatggaaagtggtgtggaactttagagaaaggaaaggattcttgaaggaagtgacatttgagcctatgtcttactggtttggtagaactgagacaaagaaatagttgagggacatcttgagcaggtgaaatactccgagtacttcctcacataaaccctgtgtagtggtctttctcaaatatttacagttccctttacatgccttctcttccattcctttatggctgcacctgtaggccttttatctagaataacactcatcatagtttacagtgcatctactccacatctccatcatagagaggaggaaacagacacaaaggatttaggtagtttgcccaaggttaccccatgagttaggtgtcagccaggactggaacttgagcccatgtgcttcacccccccggcccatgggctgcccgatggtggcagaacccctgaggattatcaaggtcccttggggaataaggacctcagtgtggaacaggagccctgccaggtgtgggggtacccctggaggactgggggattggctgacctaactcaagttatatctcacttgagatctaactcaagtgactcttcccatgtgaagatccctcccagactgccaaagcaaagactattactctaactttttgtttttgttttttctttttttgcgggggatggagtctctctctgccaccctaaattcatgctaaagatttctagtgtcttaccatatgctaggaaatgtggatagagtagtaaacaagagcaagtcctgcccttggggagtttatattctagagagttagaaagattacaaaaagtaaataatttcagatttgataagaaagcaaaataagagtcttcagatatgatcagaaaggaagataagagtgccagaaagatgatattttaagtcatcaccagatttctttctatgaaggtgatgtttaagtagtttactaaatggtgtcaaggcatgaactggataaagatatggggaaagagcttccctaacagaacaaacagcaagtgtaaaggtcttgtgatgtacatttatattgggggtcatagaaagcctgtctatggaagtaacatttatgctgagatctaaaaggtgagaatgggttagccagtaggacaaggaaggaggaaagagggacactttatgctcagaggacagccatggttaccatattagaggaatttagcacattagaggaacaagtgggcaagtgtggctgcagcagcatcatcaaggggaatgaatagtgcaggatgaactgagaactagacagggactagaccatgcaatgcctttgaaggccatgttattccaaggatgccagcatctattaaagagtattttaagcagggaaatgatataatcaggtacatgcttgaaacgatcactctcggttgggcgcagcagctcatacctataatcccagcactttgggaggccaaggcaggtggatcacttgaatccaggagtttgagaccagcctgggcaacatggtgaaaccccatctctacaaaaatacaaaaattagccaggcgtggtgacacacgcctgtaatcccagctacttgggaggctgaggcatgagaatcacttgaaccagggaggcagaggttgaagtgagccgagatcaagccactgcactccagcctgggcgacagggtgagactccatctcaaaaaaaaaattagtcacttttgtaaaaatggcaggaggaagcaggagtaaaagcaggagagaatagaaacaaatagtctgggcaaaaaacgatggtagtttagattacagtggtgatagtagagatggaaagtagataaatataagatttttaattcacaagagatgcttttgacgttgtatataaaaaaaaactttcactaaggattttaagatttcctcttatgttttcattggattgtttataattttagctttcacatttaggtctgtgacccacttggagttaaattgtgttatgttcaaggttagattgaagttattttgtctttttttttttttttagcgtatttatacccagtcattccagcactgcatgttgaacagactgttctttctcttctaagttgcctttttcacttctgttgaaaggtaatttactgtatacgtgtccgtctattttcagactctgtcccagtgatctgtttgtctatctttacacagtatcacactatcttcattcctgttgctatatcataagtcttaaggttagagagtgtaagttcgtcatcttgctctttttcaaagttatcttggctattttagatcctttgcatttccatatgaactttagcatcagcttctcaatttcagctgggatgcattggatgtatagtatacaagtattacacaccttttatccagcttattcctaagtattgcatttttgcaaatggtaatattgaaattaaacttttaattttgagttaattctagatttacatatattttaagaaataatacaaagagatcccatgtgtactttatccagtttttcccaatagaaacatcttgccaagctctagtacaatatcacaaccaggatattgacatcgttacagtccagatacaaaacatttctttcaccacaaggatacctggagttgcccatttacagccaaaaccactaatccacttctatagttttgtcatttcaagaatgtaatataaatggaaccatatagtattatttcaggaatttatacttcaagaatgtaatataaattgaatcatataaccttttggaatggactttttttcacttagcataattatttggagattcatctgggtttcgcatgtatcaatagctcattccttcttattactaagtagtatttcacgatatggttataccacagtttaaccactcacctgttgaaggacatctgattgtttcctgtttggggctcttatggataaaatgctgcaaacatttgtgtaccaatttttgtgtgattaaaagttttcttttctctggcattaaatgccaggaagcatggggttgtatagttagttgcctgtttagtgttctaagaaactgccaaatgattttcttagagtggatgtgactttttatattcccaccagcaatttatgattgatccagattcactacatcctccccagcatttagtgttgtcattattttttattttagctattctgataggtgtgtggtgatatctcactgttgctttagtatgtttttccctaaaggctaatgattttgaactctctcttaatcatcttaggctgctataacacaataccataaactggttggcttaaacagcagtcacagttttggagactggaaagtccaagtcaccagcagatttggtgtctggtgagggtctgcttcatggtttagagatggcagtcttctcacagtgtcctcacctgcttgagaaaggaagccagcattctctggactcttacaaggacactaatccattaataaggagtctagcctcatgacctcatctaagcctaattactttccaaaaactatctcctagtaccatctcattaagggttagggtttcaacttacgaattttagggggacacaagcatccagttcataacaaatatcttttcttgagtgtatttgatatctgtctgtcctctttggtgaaatgtctgtcagtgccttttgcccattttctaattaagttatttgctattgcattattattgatttcctacaagttaactttaatctctctagttttggttcctgactgaagtttattttgtcctggaggaggaacatttggcaatgtctatatatgccttcagttgtcacacgagaagaaaggaaatgttactggcatctagtggaattatttgtgtagactgggttcatttcttctttaaatgtttgggagaatttaaccaatgaagccatgtggacctggagtttcctttggggtaaagttttcagctactagttaaatttctataatagcggtatttaggtaatttttgtgtgtgtgaaagaactttggtagtttaaatcttccaaagagtttgtccatttcatcttagctgtcaaattaattggcataaagttcataattttcttttatttaaatcttgttgatatctgtagaatctgtagtgatattacctctctcatttctgatattagtaatttgtgttttcactttcttttttacccctaatcagtctggctcaagatttatccactttactcatcctttcaagacctagctgttcgttccattgattttttttctctatttttttctttctgcttcattgacttctactctgatctttattacttccttcttagtttcttaaggtggaggctgaaataactgatttaagacctttattcttttttaatataggtgttcagtattatatatatcctggtaagacttattttagctccacaggttttgatatattgtgtttttatttacatccaggtcaaaatacttcctaattttttttatttgttttgagtcttggcttatttagaagtatcatttagtctcgagtacttgtaagttttcaaaatgtctttctcttcttgatttctaacttaattccattgtggttagaaaatttatctcatgatttaaactctcttaaatttgctttatggcccagaatatgattgtcttggtaaatgttttatgtgcatctgaaaaaaatctgtattctctagtcaggtttgttttgcttcacctcatatatcactgatatatctcccagtgcctagaaccagtggttggcacttagtaatgtcttaatacatttttgtggaatgcttacatgtatgtgctaaatcaaatatttaactcaaaagagttgaactcagtgctgtgggcctagatcagaggaaatcatgtgtgaataaattccttaaaaatatgttttcccatagatttaggcgtgcaagtaccgttttgttacatgaatatattgtgtagtgggaagtctgggcttttagtgtaatcaataaattcttgtgaacagagccttccccccaccccgagacaaggtctcacgctgtcacctaggctggagtgcagtggcacaatcttggctcaatgcaacctccacctcccaggctctcaagcgagatcttcccacctcagcctcccgagtagctgggactacagttgcatgccaccacgcctggttaatttttgtatttttagaagagatcaggtttcgccatatcatgcaggctggtctcgaacttctagactgaagtgatccacccgccttggccttccaaagtgctgggattcaggtgtgagccaccatgctctgctaagcagagtctttatgagaaaactgtgtcagaatatgctgaaagacttaagaccagaaagtgagcagaagttttacaccaaaacagaattgcctctgtgggttctaaaaggaaaatatgtttggaatcagaaggtggaaatgtcagctggcaaaaatgaactgtgacctggttccccagctgtatcagaattacttggggtctactttttacctctgaatgacagttttcaagggtagaatctcagaatatgtttttcatttttttatttttgtttgtttgttcatttatttttgagacagagtcttgctctgtcacccaggctggagtgcagtggcgcaatattggctcactgcaacctccacctctcgggttcaagtgattctcctgcctcagcctcctaagtagctgggactacaggcgcatgtcaccacacccagcaaatttttttaacttttagtagagacggggcttcaccatgttggccaggtcttgaactcctgatctcaggtgatccacctgccttggcctcccaaagagctaggattacaggtgtgagcaagtgtgcctggccagaatgtgtttttaatcgaagttcaatccaagtatcccctactctaggtgatttgatggccagcatatttgggaagtactaatttggaaagtgactgcttgtttattggaagaggaatgaaattggaggtgcttgaaggatctccaaccttaaaccaatgcgagttagtgaataatatgttatcgtatacttgtaactcagtttatatagtttgtaccatactatagtaaaagtggttaagtacttcaattttaatcccactgagtttgactttaaagaatcatctctcaaaagtagccttggaaagttgttggataaagcttctatggaaatctggttgaggggagaaaaaatcagttttaaatggtggttttatgacttaaaccatcgtgttaaattttttaataaaatatttaaccacttactgagttcttcctttctggcaggtgttgtaaactctataagaaagtgacttattttgcctaccattatattgccaatcctaacatgtaatggatgtttggtaaatttttgttgaatgaaaaaaaaaaatgcactgaattgctactcgtggcagctttggtaaaattaaggtttttgcccagctttaccttaaatttcctttttggacaagtcattgaacctctttggtttaatctcatttccttcacccttaaaaagcatgccaggttttcagatataagctaaaatagctgcaaggtcctgccctaatattttgatggggaatataaactttagatgagttaaaacagatcctcagtaatgcatattaccttccacttaataggtgcactttaattgaataaatgaatcttaatccagctcttcttttgtttgttttacgaacgtttaaatcaaaactcagaaagaatgtgtcattaggctaataatgctttttgatctgtaggacctcctgtactagaattcaggtcccggctttcatacgatgttctttctgggtaaaatttcagttctgagtcatctgcagagagaattatttttctggttcctgatttgtatttaaaatacgtgctaatctgactttgtaccacaaagtgagttgcatattctgcctagaatcacactaccaagcccacagatgatacctgttaactagagcaacttatttaacctctctctccctcagtgtgctcatctataaaataggaataataatagtgcttatcttataggactgtagtgaggattaaacacattaatatacataaagtacttggaaaagttctgtaagtgacagatgctactgctattattattgttgttcttgttgttacttatttgttttagattctgaccaaaataaggcattagaatgttttcttggttatttttttaactttcctgtcctgtttaggaacttttatttcattttatcttatttttgagatggagtctcactctatcgcccaggctggagtgcagtggcacaattttggctcactgcaacctctccctcctgggttcaagtgattctcctgcctcagcctctcaagtagctgggattacaggcgcccatcaccacggccagctaatttttgtatttttcatagagacagggtttcttcatgttggtcaggctggtctcgaactcctgacttcaggtgatctgcccaccttggcctcccaaagtgctgagattacagacgtgagccacggcacccagcctagcaacttttaaatccttaaggtaggctgtggagtgttagtgaggattggaaaagaagaaaacttcatgatgtttgccatggatagatttgtctgtgtaatgtattggtaaagagaagtaacattctcccaaaatttatggagatttttcaatgagaatactttaaacgaatctcctaaaattttatgtgtgaaatatatataaatgtattttctggagaaagatactagggttttaaaaatcattttattctgcatggcacctagattctttaatagtatacttgttgagatggaagctgcaaatggttgaaaactactagatagattatgtatgttaaaggagttggaggaacaaaaaaaccatctctatgagtgatatgatattagattagcttttcaagatagtcatcagagagtcacattaaatcctatgttgttgtgatttttttcctatgatattcaatagaatttttcagtcatataaaaagataaaggaattatttaaaaccagtacttgtggctcacacctgtaatcccagcactttggaaggctgaggcgggcagatcacttgaggtaaggagtttgagaccagcatgaccaacatggtaaaaccccctctctactaaaaatacaaaaattagccaggcatggtagtgcatgcctgtagtcccagctacttgggaggctgaggtaggggaatggcttgaatccgggagtcagaagttgcagtgagccaaaattgtgtcgctgcactccagcctgagcaacagagcaagactctgtctcaaaaaatattttttaatgcaaaaataaaaataaaaccaatacttgtatgcccatctttcaagttgagatacaacaagtatagttgaatcttcctgtgtatctacagttaaatgttaaagtgtatttaaatataatttcattttaaatttgaagcaccggtatggtctgagtttattattcatctgctttttgaacagttttcactgattgatatctctcaggaaaaatatagacttcggaatcacacaaaaaacaagcttatatattccatggtatattctacttcctatttctgcctccaacaagtagaagaatagggtatgcatatgatacctggtgggagtagtattccacctgtgtttatggtcggtagtaaaaattaacccacttcttttctatcagtaagagatgccaagtgtggataatcacaaagcctcaagctgtacactctctgatgaggagggaagagtggctggatgctgtcctacttcaaatggcaaacgatgtctgcattctcccctctggaaactcaccagctgtatttccatattgacacttttccctaatcacaccttcccacttatttttggctacatgtattatgataaggatgatagaaaacatttatgttttaagattacttttttaaagcatttatgttttgagatcacttttttaagacaaataaccaaataatcagtatattcaattataatgttaagagattagccaaatgatcttttaaaggcccttcccactagtagatctatgaaaatgataaagcattatatctcatattgaagttttgctgatttttcactgaggacaacaaaaattctttggagttatttaggagttttaaaagtataaattagagaccacaaaaaagggactgctgcttaatgttttacatcccccaaaatgtggttaacaccccactcagggcatgcttagcttggttggtaattacaattgagctgtaaaatattttgacagtttccaactgttgtgtacttgttagtcatttggtggcaaatgcaatttggtgaggtttttttggtggggcatgtttaattaagaatctttcaattaagtggtatgtcacagtaagcattgatacaaagttttgcatctatgagctacttttacattttatccaaagtggaaaaatgtatttctttaaaaacacttttatatgtagaaggttttaaagtagaaacattaaaagtggaggcttttatgcctcttcttttcatgataagcttttacttgtcgtctagtaaagcataactcctcaatacttaatttgtagcctgaacattgtatatgattttcctgggtaaatgaattcaatggcaaatcaatcaaattgctcatgataattacagaacagaaaagaggggttggatagatttttgttacatgtttttatcctttgtttataacaccaaagctaataatgaggtaatttgggtcatatgacaattcctagaaagagagtgtcaaaccttttcaatcaggcaggttgactgtttagacagaatagtgtaaccacagcattttaaaaaaaatctctgttaagcatacagctattagataaatcattatttctgaaattatagagctaaatgagagtgggaggaacttatgccctggtcagtgtatccaagggtaaaacagtaaaaaactcatcctcattcacttgaaaaactattatttaaaagttgcagttgtctctagggaaatcttcaaacatcttactctattttgtttatatgaattttgcttatgacactaccaatatatgtaaagattcttggggggagaaaaacaggaattctgtgaagccagttcattagttctttaatgtttctaattttttcttcaaaaatacgtgaatataaatattaaaatcaaatgttaaactgaattgacttgtactatattagtttaggttttattttgaaatgtataatctccccagtcaatgttaggaaattccttggacaaaccatctatatttgctgttataatctgtatatttagtgagcaaaaggactgaaatgaggtcagggaaaggattgggagtaagcttgtaattattggctctacttagagaactgagtaaggtaattaaaaatattaagttggttccatgactgtatgcatttgtataaactatatactttaacagggtgaatgttgctataaattatacttcaataaatgagcccttaaaaatctaaataaaaataaacttaggttgaaaaggaatgcccaagtcacatcccaatatcataaaatctgttatatcactaacttagccaaaattgcattcataattgaatttgatttagccttgtccaataaaggccaaaatttgcagaaaagttggataaaatggcctaagtattgcccttagatattacatttatatgtgctattatagtctattattaatatatatgtaaaatgtttctcttggaaatatctaaaaatgtgccttccccatagttggcattcctagatcggcatttccctttcattaatgtttttatatggtctatgtatacgtatggatcttttaaaaattcacattggtattaccgtaaaaaagaatttctttgtaaagattctttttgctatcatagtacctaattttatatacaaactgtgattgcatagtttttaaaatgaatttttgaaatgcaggttatattttaaatgtataccagaagaagaattccataattatttcataaaagtgaagagctaccatttaactttactaatttataaatcggtagtatatctcacttaaattacattcaataatagggctataggaaaaatagacttaatctgaacagtaaataacatgcatcccattttatatggattttaattttctcttttttattttagtaattgtaaaagaaaaagatatgctgaataagacagcacgctatttgagcccttttgggcatgtcacatgtataattttacttagatgggaatactaaatattgtgaaagcatccctctttcctagatactttatagatttgatataaccataatcaaaatacaaacaggatttttgaggggatggtatcaaaatgattaaaaatttatttggaaaataaatgtttaaggatttaaaaaaaattttttttaaaataattgttaatggggtttgattaggcatacaggatactaaagcagtatatacgataacaacgtactggtaaaaacagtaggtagataactgaagcaaaacatctaccccagaaacaaacacaatctcattcagacaccatacacaacacatttgcataatcatttaatatacaataacaggagtatcacagaacaatgaaatactatttgggaagtgatgttggataataacatagaactttaattcacaccattcactaaaatgtattctaggtagatgaaagcattacagcattaaatttaaaatgagctaggtgtggtagtgcacatgtgtagtcccagatacttgggaggctgaagtgggaggatgacttgagcccaggagtttgagtccagcctgggcaacatagtgagatcttgtctctaaaataatagaacttttaattaatgaaatatattttaaaagaaaaagaaaatataataatattactggatctctggagggaaaataactttctgaaccagaagaagcaaaagatagacaagataggcaaattggactctataaaaattaaaatgggccaggtgcagtggctcacacctgtaatcccagcactttgggaggccaaggcgggtagatcacttgaggccaggagttcaagaccagcctggccaatatggtgaaactccagctctactaaaaaatgcaaaaattaaacaggcatggtggtgcacgcctgtaatcccagctactcgagtggatgaggcttgagaatcacttgaaccctggaggtggaatttgcagtgagccaagattgcaccactgcacaccaccttgggcaacagagcgagactctgtctcaaaaaaaaaaaaaatttaaaatgacaagttaaaaagtgataggtaaggatgatatatttccatatttccaagattagaaaaagaactaatagctatttttccatatatatttatatataaataattttataatgtgtgtattatatatcatcaaaatatattttataatattgtgtatgttattgtatatattatcttttatatataaacataaaatttacatacacaaattttattaaaatataaatatattcattgtgtatataaaatatagctattatatacagtatacaatttaatagctattacaatatgcaatattacatatactgtacaatttatattgtatatatgtataaataaaagacatacacatatatatatatcatgtgttacttaatgattgggatacattctgagaaatgtgccattaggcagttttgtcattatatgaacatcttagagcacatttacacaaagctagatggtgtagtgtactacacgactaggttatatgatatggcctattgctgttaggctacaaacttttacagcatgttactgtactgaataccacaggcaattgtaacacaatagtatttgtgtatctaaacatgaaataggagggaggtcaaggttgcagtgagctgtgatcataccactgcattccagcctgagcagcagagtgagaccctgtctcaaaaatgaatgaataaatgaatgaatgaatgaaaagatacagtaaaaatacagtattgcaatcttatggtaccaccatcatatatgtaatctgtcattgactgaaacattatgcagtacgtgactatgtatattaatataaacagatgcgcacgtgtgcacacagatgcacatgtgtgtgcgcacacacacattttaaggaaaacattaagtagtaacagagttaggattcaaacctagatctaattgactctatagttcaggtatgttcttaatcccaatgctgagtccttttcttatgctttatactgtgaacataacttctccctcatggcagtttatatatgatttagttatattaaatttacagaactgaattgattttcacttgtttataacaaaatcagccataggaagaaattgcatggctaaatcatgctttcctatctgtgagaaattgcctgaataaaagcagccagactttttcattcttggaccagcaaaatgtataggagcataacagacctacagaggaatgtctcccagcactttgatttctgatttattctggtttcgtttgtttagtttttaggaactattgtgttccttcttttttttttttttagatgttatctcactttgtcgcccaggctggagtgcagtggcatgatctcagctcactgcaacctccgcctccaaggttcaagcaattctcttgcctcagcttcctgagtagctggaattacaggcatttgccaccacacccggctaatttttctatttttagtagagatggagttttgccatgttggccagactggtctcaagctcctgacctcaagtgatccacccgcctcagcctcccaaactgctgggtttgcaggcgtgagccaccactcccggcctattgtgttttttttcactgcctatatcataatcattaaacctggaatttctttctctctactactctttgatttacaactaccgtagtaaatttaaaataaataattgtagtacgggctgctggtccaaatgaggcacttatagagcccaaatgctctgttatggaatagaattttgcatattttatttgctgtttttataggcagataatcatacagtatccctttgtgattctagcaaactcggcatcacaatatattaaattaatggctacagactactcaaggccccaaaaggaaacatcagggatataaatataacctgcaagcatctctagtttgctgtgccctacatcttttcatcctctttactcttctctaatgacataacaaggaaatttttctgaaaatggtgctttagtttagggtcttgaatttaaacttatgcccctagttagtcttatgatcctcattttacattgattcactgaaagctaaagttggttgatttggtcatttaaaaatatgacaattcctggacatgcatatctgcattgtctacgatagtggttctcaaacttattggtctcaagacctctttatgctcttaaaagtttttaaggaggtagaggattctgagaaaataacggggtagcaagcaccaggaatctctctcccaaccgagacaacatttgcactggcagaatctgccagatgtaactattttggaaacctggggtctattgaagccttccaggagagcccttagatagtaattgtagtcaattttggtcggtttcagctcttagctcagcagtggctatccatccctgattctccagcttcatggcaggcagtcatgtaggtgttcctggaatagcttgcacagagcttgtagaagccaaggtgggaaataaggaccttatctttcaaatatccgaaatttgttctcttattgctgattgctgcctctgatacagaagtgcaggcaaagaggtggtggccattgttgctgtacttccctctttttggtgtaagcccctgtctgctcttgctgattgaagtgacttccgggggacttaaagggcaagcaccttttgtttttctcttcatttatctctttttccccttttgggagacaggcattgaagactagactattcaaaagcaaccatatatataggggaaattatgaagtcactgtgtttgtccagggaaaggcacaggtacagaaaagacctgagatgattttagtttgtacctcagactaatcctcagtacaggaaccacctacaattttttttaagcacaaacaaataacaggtggggaaagggaagaatctgatttctagaagggaataatgacttttagagttatcacattattagattccaatgtctgttttttaatgaaaagtcataaagcatacaaacaaacagaaaattgtggcccattcaaaggaaagaaaccaagaggaactgtacctgagaaagatctaatgtcagatctactacacaaagactctaaagtagtgttctaaaagacactcaaagtactgaacatatggagagaattttataaaaagagatacctgaaccaaatggaaatattaataaagaaaaaactttaaaagaaatgaaaaaaattctggaactgaaaagtacaataactgaaacaaaaaaatattcactagagggattcaaaggcatatttgagcaggcagaagagagaatcataggacaataaaagttaaggttgaagaaaagggaacacagcctaaagtacctgtgagacaccatcaactaaaccaacatacacattttgggattcccgggagtggaaaagacagagaaagggagagataatatttgaagagataatggctaaaacttcccaaatttcatgaaagacatgaatgtaaacatctaagattaacaagttccaagtaggatgaactcaaaaagtcctacactaaaactcattataatcattcaacactgttgaatgacaaagagaattttgaaagcagcaagagagaagtgactcatcagaaaggatcctcatatcagcagatttctcatcagtaacttttgagaccagaaggcagtagactgatatgatatattcaaactgctaaaagacaaaaaaactgccaaccaagaatcctatatctgaaaaaaactgcccttcaaaaatgagggagaaattaagacattctcagattaaccaaagctaagggaatgtattacaactaggtttgccctgcaagaagtgctaaatggaatcctaaatgttgaaatgaaagggtattagtaacccaaagacatgtaaaataataaagatcccagaaaaggtagataggtgggcaattataaaagctggtgttattgtaacaatggtgtaaacataatttaagagatgaatgcattaatttaagagattcaggcatattctgattaatcatattttttttttctttttttgagacagagtctctctgtgtcacctggggtagagtgcaatgacgtgatttctgctcactgcaacctctgccttctgggttcaggcaattctcctgcctcagccttccgagtagctgcgattacaggcatataccaccatgcctggctaatttttgtggggtttttttaagtagagttgggttttcaccatgttggccaggctggtctcgaattcctgacctcaaatgatctgcctgccttggcctcccacagttcttagattacaggcatgagccactgcgcctggcctgattaatcataattagattaattaatgcaaaattctgtttggataaacagtgtgtaaagatgtaattttgatatcaacagctaaaaggttattgatggagctattagaagagaagctgttagaagttactgaagttaaactggtatgaattcaaattacagtgttataattttaggatgttaaatgtaatccaaagctgggcatggtggctcatgcctgtaatcccagcactttgggaggctgaggcgggcggatcacttgagctcacaagtttgagaccagcctgggcaacatagcgaaaccccatctttacaaaaaatacaaaaatttgtcaggcatggtgcatgtgcctgtagccccagctgctcaggaggctgaggtaggaggatggctttagcctgggaggcagaggttgcagtgagccaagattgcaccactgcactccagcctaggagacagagccagaccttgtctcaaaaaagaaaaaaaaaaaagtaatccccatgataaccacaaagaaaataacaaaagaacatacgctaaaggaaatgagaaagaaattttaaaatttcactctggaaaaaaaaaatacacacaaaagaaggcaataatgtaggaaatgaaggacaaaaaagactatgaggcatacagaaaacaactagcaaaatgatggaagtaagtcccttcttatcacaaattacagtagaccactcgacaatgtagggattagggataccaacccccatgcagttgaaaatttgtgtgtagcttttgtccccatgtaaacttaattactaattatctactcttgaccagaacagacccataacataaatagtcaaggaatacattttgtatgttttatgtatgtatactttattcttacagttaaatgagctagagaaaagaagatggtaagaaaatctgccaggcgtggtggctcacgcctgtaatgccagcacttcgggaggctgagacaggtgtatcatgaggtcaggagttcaagaccagcctggccaagatggtgaaaacccgtgtttactaaaactgcaaaaattagccaggcatggtggcaggcacctgtaatcccagctactcaggaggctgaggcaggagaatcgcttgcacctgggaggtggaggttgcagtgagcggagatcgcaccactgcactccagcctgagcgacagagcaagactccgtctcaaagaaaaaaaatcataatgaagagaaaatatattcagtattaaaggtctttgtccttttcatctttatgttgagtaagctgaggacaaagaagggttggtcttgctgtcttggggtggcagaggcaaaagaaagttcaagtattagtggacccacacagctcaaacccatgttgttcaagagtcatctgtacttcaaatggattaaaccctccaaaggtagactttggtggaatgggtgaaaacacgtgatctaataattgctgtctacaggagactcactttgtatccaaagacacaaatacgttgaaagtgaaaagacagaaaagaataatccacgtaaatagtaaccaggatgcttatactaatatcagacaaaatggactaaatttaaaaaggttatagggaagatgcaggaatgacatcagcaagatggcagactagagacacctggcattcatcttccctacaagaaagaataaatacaaggaataaatagccaagatttgacaggagtgtcaaagaaagagcagtggagtacagcagtggagtggagaaacacctatggtgataggaagtccaggagggcagcatgaaggcagccagtctctgcagtcctgtctcccttccattccttaggatttaatcaacctggagtcaggagagaacttcttgttgtgggtaacaggtaagcagaagatctccattaacccccattgccactgcaaacaccttacaacagtatagttgttacaacaggagaatcccacagtctccatttggatagctaccaggaaatcatgcagctgcattgccccagttaagagcataaggtgtgcactccccatacttcacccacctcctatgagccaagctcctgaagcatggtgacatcttgagaccagggacacctctgaagtgtgcccttctctgggggcacatagtcactgcacctgtctaacactggggctccatcttcattcctccaaacctacaccagtggctgaacaccacaacctcagcaatacaaaatctggacccaagattggctatgacattggtcctgcaaagcatgaaaaccaactctcactaccctcacttccagccagaggaacagcctggcagtcttgcccagggtgaacctacccatgagctggccaaatagccacatgcccatcttcataggggagaggccctcaagcctctgaacagctgacattctcaggctggcagagcagctatgtgattgcaccctgagaaataacactgaggtgccccaccctctacagaaaagtccctgacctgccaattggccccatgcccacagcaagagcctgagaaacatctctgcaggctggccctggcagaaacactcccaggtcatccaagcagctttgcacccatgccccaggagtgagaagtagctctacatgctgcctctggcaaggagctcccaggctgcctacacagctatgtgccagcatcccaggcctgagaggcaatcttaggagcataaggtgtgcagtccccataacccaccaaccctctatgacccaagaaacactccgaggcctaagaagcaactttgcagttcacccctggcaggcatgccccagaccaaccaaatagccttgcacctgtgtactaggactgcaaaacagtcctgtgggccacacctggcaaacacacccccaaaccagctgactgcatcatggccctgagaagcaactctgcgatccacctccagtggacacatcaacaggccaactgagcagctatgtgtctgtgtctcaagtctgagaaacagcctcatgggtccctacccagtagacacaacctaaggccagctgaacagcttgtacccatatcccaagcctgagaaacagccatcctgtggatcgcccccagcaaacatgcctttaggccagctgaggagccatgtaccagcatatcatgcctgagaaacagccccacaggcaacccctggtgggcatacccccaggttcaatgaacagccctatgcttgttctcccagccaaagtaacctatggccacaggagaagcagtagtaaatggcaagtttatagcaataaatgcctacatcaaaaaatgaggaagagttctaataaacaacctaacaatgcactagaaaagcaagagcaaaccaaaacattgtaaaagaaataataaagatcagagcagagataaatgaaattgagactgaaaaaatacagaagttcaatgaaacaaaaagttgattttttgaaaagataaacgaaatcaacacaccattagctagactgggaaaaaagagagaagacccaaataaatcagaaatgaaaaaggagacatcacaacagataccacagaaatacagaagattattagagacaactatgaatgactttatgacaataaatttgaaaacctagaggaaatggataaattcctggacacatatctaccaagatcaaaccaagaagaaatagaaaaccttgaatagaccaataagtaaaaagattgaatcagtaatataaagtattccaacaatgtaaagttcaggaccagatggcttcgttgctgaattctacccaacccttaaagaagaattaataccaattcctctcaaactactccaaagaatggaagcaaagggaatcctttccaattctttctatgaggccagcataacattgacatcaaaaccagccaaggatacaacaataaaaacccactacagaccagtatccctgatgaacgtggacacaaaaatcttcaacaaaatactaacaaattgagcgcaacagtgcatcaacgatggcaatagaaactccaccatgaccaagtggaatttagcccaaaaatgcaagaatggttcagtatacacaagtcaataaatgtcatacatcacatccatagaataaaggatgaaaaccatatgatcatctcaataggtatagaaaaagcttttgataaaatttgacattgttcatgataaaactcttaataattaggtatagaaggttaatacctaaatatataaaggccacatatgacaaacccacagctaacatcttactgaatgagggtgaaagctttttctgtcagaagtggaacaagacaagagtgtctactcttaccacttctattcagcatactactagaagttctaaggagagcaattaggcaagaaaaaaaaaaaggcatccaaattggaaacaagtcaaattgtccctgtttgcagatgacataatcttatatgtagaaaaaccagaagcatatattcaggggaagttgaatctgtgctctcaggaaataaaatgttattattaaaaaaagacataagaaaaatctaaagactgtaccaaattactcttataactgataaacgagttcagtaaagttgcaggatacaaaatttgtatattaaaatcagtagtagtttatacatgaacaataaaactagctgaaaaagaaatcaagacagcaatcccatttacaatagctccccagaattaatttaaccaaggaggtgaaagactctacatggaaaactgcaaaacactgatgaaagaaattgaagaggatacacaaaaatggaaagtcatcccaacctcatggatcagatgaatatcattaaaatgaccatgtagcccaaagcgatctacagattaaatgcaatatctatcaaaataccaattacattcttcacagaaatagaaaataaaaaacagaatttatatgaacccacaaaagacctcaaatagctaaagcaatcatgagcaaaaataaccaagctggacgtataacactaccagacctcaaagtgtatgacaaaactattcttaccaaaacagcatggtactagcataaaagcagacacatagaccaatgaaatagaatagagaacccagaaattaattcacatatccacagtgaactgatttgtgacaaagacaccaaggacactcattggggaaagatagtctcttcaattaattgtgctgggaaaactggatattctggaactagactgccacctctcaaaatggatcaaagacttaaatgtaagacctgaagcattgaaactactagtagaagacatagtggaaacacttcaagacctcaaacgcataggcagcaaaagcataaataaacaaatgggattacatcaaaccaaaaagcttctgcacagcaaagaaaacagcagagtgaaaagacaacctacagaatggaagaaaatatttgcaaactactcattcgatggaggattaatacccagaatataaaagaaactgaaacatcccaatagccaaaaaacaattgaactcaaatatgggcaaatgacctgaacagatatttctcaatagaagacatacaaatgaccaaaaaatatattttttacatgtccaacattactaatcatgagggaaatgcaaatcaaaatcacaaagagatatctctttccagttaagatggctattatcaaaaagacaaaaacaacaacaacaaaaaaacaaatgctggagaggatgcagagaaaaggaaactcttagatactgttggtgggaatgcaagccactatagccgctatggagaacactatggaggtctcacaaaaaataaatagaactaccatatgatccagcagtcctcctactactgagtatttatccacagagaaataaattattatattggagatatctacacccccgtgtttattgcagcactggtcatgttagccaagatatagactcaacctatttgtccaaaaacagatgaatggttaaagaaaatgtggtgtatatacgtcatggaatactatttagctagaaaaaaaagaatgaaatcctgccattcatggcaatacagatggaattggatgatattatgttatctgtaataagccaggaaaagaaagttaaacactgcatgttctcactcaaatgtggaagctaaaagtaaaagttgatctcatagaagtaaaatgtagaacagaggatactagaggctgggaaggcaggggaggtggtggggagaggagcatatggagagatttgttaaaggatacaaaattacagctagataggattactcaattcttgtgttatataccactgtagaatggctataagtaacaataatatagctacttaaagctatatattattaggaggatattgaatgttcccagcacaaagaaataataaatgtttgagatgatggatatgtgaaataccctgatctgattagtatacattatatgtatcaaaacatcaccatgttccccttgaaaataaacaattattatttgtcaattaaaaaataaagttacaagagacaaaggacattatatattaagaaaattttcaatacatcaagaagatataacagttaaaagtatttgcacacctaataactgaccatcaaaatatctgaagcaaaaatggccagaatcggaagtagacatacacatacttgtacaataatagttggaaacttctataccccactcacaataatggatagaagaatcaggtaaaattaggaaagtagaggacttggacaacacagtatgtgaactagatctaacaaacatacaaaaaactgcgcaacaacagaatgcacattttcccaaatgcacatgggacatttcctggatatatgttaagccacaaattaagttacaataaaatttaaaagaagaaaccatgcaaagtatcttttctgataacaacatatgaagttagaaatcaataacagatggaaaactgaaaaaaaatcacaaatatgtggattttaaactacacacttgtaaataaacaatggatcaaagaagaaatcacaaaagacttagagaaaaatgaaaataaaaacacagcataccaaaacttctgggacacaatgaaagcagtgtttagggggaaatttttagcaattaacactcacattcaaatacaagaaagggaacacccctgtggttagaggttgctggggtagtgtagagggctgagaacaacctctgaacctgaaagtgtcatgcctgttagatagtactctgttttcttacctgtctccagccctcatgctttatctgtgctaacccgatggcctagcttttcctagggaggcgttgtcctctgccctaaggtgaccaaaaactttattctgcttgtaaggctgtgtggtgggaatcaaaaagtaagtactcaccctccaagtcctttctggtggcctctagaaaagactggccttaattttatcaacactacctccaagtttgacaatggctgcttgtagactataacaaagaggacagcattcatggaaccacttaggaaagagcaaattgtaatggaagatgcagcttaatgtcaagaacatgttgtatagctgatgggatcttattaatattattttccagtgggaaaaaaataaaaataaacaagaaagatcccaaattcagctacctaatgttacaacttaaggaactggaagaacaaactaaacccaaagctagaaaaaggaaggaaataataaagattagagcagagataaacaaaatggagactagaaaaacaattgagaaaattaatgaacccagatgttgattctttgaagagatcaacaaaattgacaaacttcagctagatagactaagaacaaaaaaaaaaaaaaaagagaaaaggctcactttagtaaaattagaaattaaataaagtggggacattactacctattccacagaaacaaaaaggattataagaaagtactaagtaattctacaccaacaaattgggtaacctaggtgaaatagacaaattcctagaaacagaagacctaccaaaatgaaaccatgtggaaatagaaaatatgcatagagctctaattcgtaagaagaatgaatcagtaatcaaaaatctcccaaaaaagaaaagctctgaacctaatggcttcaccagtgaactctatcaaacacttaaagaagaaccaacactaattcttctcaaacgtttccaaaacattggagagggaatactccttacctcattatttgaggccagcattatcctgataccaaagccagacaaacactacaagaaaacaaaactgcagactaatatccctatgaactttgcaaaaaatcctcaatgtcatactagcaaactaaattcagcaacatattaaaagaattacataccacaaccaagtgggatttatgcctggagtgcaaggatgattagacatatgtaatcagtgtaatacactacattagcagaatgaaggagatagtacatgtaatcatctcagtcaatccagaaaaagcatttgatagaattctataccctttcatgattaaaaaaaaattaaacatactaggaattaaaagaaattacctaaacatgataaaagtcatatatgaaaaacccacagaaaatatcatattcaatagtgaaagacttctatgatcaagaacaaggcaaggatgccctctcttgccagttgtcttcaacatagtattgaaagtcctagccatcacacttaggcaagtaaaagatgtaaaaggtattcaaatcagaaaggaaggcataagattatctctgtttgctgatgagaagatcctgtatataaaaaacactataaagattctacaaaaaaaaaaactgttgtaactaataaattcagcaacgtagcatgatacaaaaaccaatccgttgtatttctatataccaacaatgagcaatccacgaaggaaattaagaaagtactttcattaacaatagcatcagccagacacagaagctaacacctgtaatcctagcactttgggaggccaaggcaggaggattgcttgagctcaggagttcaagaccagcctggaaaacatggcgaaacccccatctctacaaaacattttaacaattagccaagcatggtggcatgcactcatagtcccactacttgagaggctgaggtgggaggattgcttgcgcccagaatgtcaaggctgcagtgagttgtgaccatgctgctgcacttcagcctgggcagcagagcaagaccctgtctcaagacaaaacaaaacaaaaaaacaaaaacagtagcatcaaaaagaattaaatatttaggaattaacttgatcaggaaggtaaaagacttgcacactgaaaactataaaacatttctgaaagaaactgaaaaaggcagaaataaatggaaagatatcccgtgttcttggcttagaaaacttaatattgttaacatatcaataccacccaaagatatctaaagatttaatgcaattcttataaagatcccaataatgttttttgtaaaaatacaaaaatccatgttaatattcatttggaattttaaagaacccagaataaccaaaaacaagcctcgaaaagaacaagagtggaagactcacactttctgattttaaaacttactgcacagctacagtaatcaagacagtatggtactggcatgaagacatatagaccaacaatggaatagagagtccagaaacaaacctctgcatataataaggtcagtgattttcaacaagagagtcaggactatggagaaaaatggagaaaagaccattttttcaacaaataatattggaaaattagatgtcacatgcaaaagaatgaagttggacccttacctaacaccatatacaaaaagcaacccaaaatggattgaagacttcaatgtaagggctaagaccataaatctcttagaataaaacatagggcaaaaacaaaacattggatttgggagtgatttcttgggtagacaccaaaggcacagacagcaaaagaaagaagacaaattagacttcatgaaaatttaaaacttttgtgcctcaaagaacacaatcaacagagggaaaatatttcttgcctacaaaatgggaggatattttaaaataacatatctgttaagaagggatttatatccagcatatataggaaactcttaaaacttaaccaaaaaccaaacaacccagttcaaaaataggcaaaggccttgaatagatatttatccaaagaacacatacagatagccaactagtatatgaaaagatgctcgacatcactaattattgggaaatacaaatcaaaaccataatgagataccatctcacacccattaggatggctactatcttcaatccccaaagaaaaatcagaaaataacaagtattggtgaggatgtagaagaattagtacccttgtgcactgatggtgtgaatttaaaatgatacagtgctgtggaaaacagtatcatgattcctcaaaaaaattaaaaatagagttaccatatgattcagcgatttcacttctgagtatacagtagcacctccaccccattatttgtggcttcagtttctgaagtttcagttgcccatagtcaaccgtcatccaaaaatattaaatggaaagttccagaaataattcataagttttaaattgtgcctcattctaagtaatgtgatgaaatctcacagcatccctcttcttccgtgcaggatgtgaatcatccccttgtccaatgtatccatgctgtatatgccacctgttagtcacttagtagtggctgttgggataacatctcagttatccagttgaaaaagcgaagtatgatatatagacagctcaatactatccacagtttcaagtgtcccctgggggtcttagaacatattcccatcaggtgcagtggttcacacctgtaatcctagcactttgggaggccaaggtgggagcatcagtcagtcaggagttcaagaccagcctggccaacatggtggaatcccatctctactaaaaatataaaaattacccagggatggtgatatgcacctgtggtcccagctacttgggagggtaaggaaggagagtcacttgagcccgggaggtggaggttgcagtgggccaagattgtgccactgtactctagcctgggtggcagagcgagacggcatctaaaaaaaaaaaaaaagaacatattcccacagagaagagaagactactctgtacccaaaataattgaaaacagagtctagaagggatatttgcacacccatgttcatagcagcagtatacacaaaatccaagaggtggaagcattccaaatgtccattgatgaatgaatggagaaacaaaatgtggtatatatctgcagtggaatattattcagcctgaaaaggaaggaaatcttgtcacatgctatgacatggattaatcttgaggacataatgctaaatgaaatgaatttatcacaaaaagacaaatactgtatgatttcacttatatgaaatcaagatcacagaaacagaaaataggatggcagttactaggggcagagacttgtttaatggatatagagtttcagttttacaaaatcagaaagttctggagatctgtttcaaaacaatgtgaatatactaatactattaactgcatacttaaaaatggttaagggctgggcatggtggctcacacctgtaatctcagcactttgggaggccgaggagggcggatcacttgagatcaggagtttgagaccagcctgggcaacgtggcggaatcccgtctctactaaaaatacaaaaattagctgggcatgatggcatgagcctgtaatcccagctacttcggaggctgaggaaggaaaattgcttgaacccaggaaagggaggttgcagtgagccagtcatgccactgcactccaacctgggtgacagagtgagactccatctcaaaaaaaaaaaaaaaaaaaggttaagatggtaaatattatgtgtattttactacaataaaaagaaattattaaaaagttattgaggagcccaaataacttctgtttatgtgagttatacctattgctatttacaatattagaaattaacactgagaagtttttaaattttattaatttatttaaaattatattaaactatatcacatattaacataaataatatagtattttcatgaaaaatgactatatttttcaaaacaaaaacagtttattgagaagactgacattgtttttcattttttccagggtctaatatctggcttaattgaaaacagctttctgcattcaatatgttgtaatgtgttttggttgtactctatgaagaaaatttgaccttatcaaatatataatgttaaagagaatttaaatacttctcaaatgattagagattataatttttgatactacaccaaaactcacaaatgatagtttcttaagttagtttcagtgtggaatcaaaccatacattggcctatgtggtattttcaactgcatcttttattgatgtgtgattttgtaacatcatgcattatttctttggaaaacattgattcccgtactcatgtagatcttccaaatgttgtcacatttgattacacaatattgaaaaataacatttgttaatataaccaccgattatagggaagaggaaagagattgggataagaaagaagcataaaagtgggctagtttctgaaatgttggcaaagttccaattcttgtggtatcatgattttatagtaatcagtttgttctttgctttattgttttaagtatgacccccctaaacaatatggtttacttttgactgattttaaatttacataaatggaatcatatgatatatgcatgtttgtacctgttttcttttgttcaatattatgttttaggatgtatttcttttgtgcgtgtgtctagtatttcactatctgaatagatcacaatttttaaatccattttattgttgccgaacatttacattattttcagatttggaaaattttaaagtgctgctgtgaacatttttgcatatgtattctattctgtgctatataagcatgcatttctataggatataaacctaggaattgctgggtcataggatatgcacattttcaattttagcataatagatgatgccaaacttttttcatcagccctgtaagaaagctccctttgctccacatccttgccaatacttggtatttttaatttcactaaaatttaatctcaattaagagacttcttaaaatttcggcctttctggggagaagtgtgcagtagtaccttgtgtaattctctgaatactgatgtgacggagcaagttttcacatttactgaatatttgaatttcttcttttataaagtgcacattcaatttttgccccttttcctattgattaactttccttttcttactgatctgtggatattctttgtaattctagctacaaacccttttttgacggaaaatgtatacaattaatttggcaccaggtttacttaactttcaggacaggaaacatagcatattagcattacagcatcaggtatgctaggccatattttagttcctcatgtcagttctaaggtgaaagatcaggtgggtaagtgtggaccactctgccttacaaaacacaggatcttgtagcagcccatacacacaactgtcagattcccaagggacatgcttggttacgtgaatcacactaagcatagggaagctgctgcctttgtttttcaatagggatatgtagtttattcataggccttcgagttagatacagttcaccaaactggggtcagttttacagtaaataatgttgcctggaaacacagctgacttctcactttttagcataatcctatatatttccatggaattcatgttaggagaaggtaaacttgagagcatttcttcatggagaaagagtttagttaaccctttctgttggttagccgtttctctctggaaaaataattgatatcattacaaaattgagtcttctaagccatgaataaatatctccatcttggccgggcacggtggctcatgcctgtaatcccagcactttgggaggctgaggtgggtggatcacgaggtcaagagatggagaccatcctggccaacatggtgaaaccgtgtctctactaaaaatacaaaaaattagctgcgtgtggtggcgtgcacctatagtcccagctactcgggaggctgaggcaggagaatccggtgaacccgggagacagaggttgtagttagccaagatcgtgccagtgcactccagcctgggcgacagagcgagactccatctcaaaaaaaaaaaaaaaaatatatatatatatatatatatccatctctttagattttctttactttttcgcaataaagcttgatagttttttatagcagtcatgcatattgtttttggatttgtgccaagtacttgacatttttatgccactatgaatggttttcaaatttttagtttctgtttttgttagtttataggaatacagttggttttgtacattgattttgtatccaacaccttgctaaattctcttattaattctaataaactgtaacttcttgtggatgttctacatactcaattatattatttgtaaataacgttttacaattttgtttcttttttaatacattttgatgtctttttctgaccttaatgtaccagctgggacattgttgaataaaagtgatgatagatgctcaatctcaaatatttcacccttgcaatatttgctggggcctttttagcaagtgaaagaagattctgtattacaggttgctaagactattttttagaatataaatggacattattttattaagtgctcttctgcatctgtttagatgattatattatatagctttcccccaaatctgttaattggtcaagttacctcaatagatatgctaacattaagccaaatatgtgttcttgggataagtctaatttgttcaagacgtgttatccttttttaataaattaatattttcattaaaacttttgcctctatattcatgagaattttctttaattttgcctttgcctattgagttttggtgtaaaggcccatgaaatgagttagagaataagctcatttttccagttttctataatttgtgtaatattggagattttttttccttgaataaatgtttggtggaacttattagtgaagccaactggaatattctttgtgagaaggtttttaattacaaagtcagtttctttaacagttatagaactctctgggttttctatttcttcttgtgtctgttgcagtaagctatacttttctaggaatttgcttctctctttcttggtcagtcacactacaggtttaatttagtcttttcaaagaagcaattttggctttgctgatcctctctattatatgcttaggtactatattattatttttgcttttacctttttattttactgtttctacttttgaggggaggggatgaggctcatattgctatttgggagtccaccaaaagtgcaactctacctctcaactcactcttctagactaccattataaaaacagcagagagtttcacttactctctagttttcctgtctctccatgtcttggcttggagaaagttggttgatgttttgtagaagattaaaaaaaaaatttaattatggcacaatctttctagcagtagaataacaaggcctaacttcagttttaccatgagaataaagtgaagtgatttaaatgaaaacactttgaaaaaaaaataataagaccaatataaatgtaagtgttctcattctcactgttgatagtttttgggttcaccaaatgcttagatatattcaaagttccctcaaccatgatttgcaataactggggaaagtctccaagaattagtagttgagagaccaaaatgtgctacaactttagcaatgttagtatatgtctcgttacactggacttaattagctcttgttctagttctagccagtaatttgaaatccaacagaatggacaggtttattaacagaaagactcttgaagttgaaattgtttgggttaattgccttttttgaatcaactaattaaacatatagagggcagcgatctaacctctgaagacaataagaagttgactgagatgtttgttaggattgaaaaatttacaacttctgctgaagtgctacagcagtattttcttgaaatgtgaaatgcatgttgtttaaaagcacaggctttggagtgggaattccttggtataggaactcctctgcttcctgagtaacctcactttctccaactgtaaattggaagtaagagtacctatctcaaacgagttgtgaggattaaattagctaatctgtgtaaaggtcttaactttgtggggcataataggtgctcagtatatagtttatgaattaatgaaaaattaataagcctttttgtagagagaagaactgaatatattatagtaaaatgaaaatctattaagtgccataggaaggacacaaagagtcaaaggaacactgaaaagggcttcctactgaatggcaattgcgaggagatttcgtgtaagagatgacatttgaactaaatcttgaagatttgaagatagagtggaattgcagcagttgtgcttgggacggaagatatttcatgtagaggtgatgatgtgtatgatccaagactgggtggaggtgggagacctggggtttaggcaggaaagcatagggattttaaaggatggtgagtaatactagagagtaaatacattgaaaaagatttgggattcaatacttcgaagtattttgacatcattttgtgtgttcttgagaaccattagagactttaagccgtgctttaaggagaacgatgctatgacatgggttggttaccgaggggggatttggaagaagaaagacctattaggaagattttgcagtggtgaaaggagatagattacaaaaaccttacaaaatatgagcaaaactgcctgcaaaattaactagtaagagatgatacatgaaggaagaattcaaaggtgattctgacattaaaaatctaaacagttgggacaatagctgtatcatttgcaaacacaatgaaaatgagcaggttgtaaagaaagatcaccattatggttttgaacacattgagtttgaattttgtatgatagaaaggacagccaactggaaatgtcaacttgagatagtttgaactataaatatttgggaatcatctgcatggaagtaatagttggaatcctgggaatgaatcagctcaaagtgtggtggaaaactatttagagcaatgcctagaggaatatgtggctgtatccgtggaagaagggcagacagcaaaagagaaggaaactatagttagagggatagagcagaaaaaatagaactgacatttcttattaaaatttaagaaaatttgcaagttatttgactaggttttctgaaagaaagctattaccattgttaggaagaataactaggtagctttattaccgttcacatgtaatctgctatgttaaacagaaataatgcattaaaattcattatatttgcaagtgtagttttaccttttatggacagatttttgtgtctttcttcctttggaaagcaataaattacaaagtcagttagagcttcttttttcacccaccttatagaaatagatacattgccaagcattacaagtaccatattttccacatagaatatctaggtgtcaagattatctctagtgaaagctttgtttgtgggggaaaaaaaaaagaagaagaagaagaaaaggaaaaaactttttatgatcttgaagaaattcatggcctttgaaatttctagaagagcctcaaaaaataggaattcctgctgataatgcattggtggtggtaataataattgcaattaatatttactgaatggtactgtttgccatacattgttctaagtgttttacatgcatttttttcatataacagtatttactgagtgcctatgctgtaccaggcactgttctgggcatttgatttaggttaataaatgaaacaaactaaaattcttgctcttgtggacattttatttagtgagagcagacagataataaccagtaagcataacaaataaagtatatggactctaagaagatgataagtccgtggaaaaagtagagcagggtaagtggattcaggagtgctgaattggggttggatgatggaaatggattgcttttttttcttccttttcttcttgagatggagtctcgctctgtcgcccaggctggagtgcagtggtgcaatctcagctcactgcaacctctgcctgctggttcaagcaattctcctgcctcagcctccctagtagctgggactacaggcacgcatcaccatgcccagctatttttttgtatttttagtacaggtggggtttcaccatgctggccaggccagtctcgaactcctgacctcatgatctgcccgcctcagcctcccaaagtgttgagattacaggtgtgaaccgccacgctcggccaaattgcattattaagtaggatggtgagaataggcctaatggagaagattgcattggagttaaccatgcagatatctgagagagtaccagggaaatggagcaatctgagagagtaccagggaaatggagcaatctgagagagtaccagggaaatggagcaatctgagagagtaccagggaaatgtgcaaaggccccaaggtagaaacatgtctgcgatatccaaggaacaacaaagagattaatatgatgccattttgaggaagatatggtttcaggcatgatggaaccacagtccattggctcctactcctgactcatggctgttggctctctccaaggaacatgtaggttaggaaactgtatcacagccatgggtttaagcactggaggaaccagaggtggtgattcactgaattagaattcccctaaccagctgcagtataaaaatccctgaagaagtgtgtgctgacttgatcagaggcacaaaggaaaagaatctcaaagtgaaaggaccagttgggatgcctaccaagactttgagaatcactacaagaaaaacgcctgtggtaaaggttctaagacatggaatcactcccagaagagcatccgcaagcagtttattgacttgcacagtccttctgagattgttaaatagatttattcggtcagtattgagccaagagttgaggttgaagtcaccattgcagatgcttaggtcagctattttaataaattgattatcagttgtttttttctttttaagaggtcagtatggttcaaagtgtttaagggagagagcagtggttaagatcagagaggaaatggacatggggagagtgaggcagatcttgttactacaaccctatgagatatgtaccgttataatctgcactttacagatgaggaaactgagatgcaaacaagtcaagtaacctgccacatctgtaaaatcaagagccagctgtaacaacaaacagtttcatccaattatgtactgaaggtttcaaaatgatttaattgctaattcctttatggctttctgtaaaatattaggtaaaaggtcagttctggagtagatgatttcatttaacaacggctctatgattttctttctttgtaaaccaccgtgaccatttatagggcttgtaatttcatcaaagtttcttcaattgcatgtgacttctttttgttggaagtacagtaagcatcccttaatacaaggcttttatattagaaccaatttaaattttggtttagttcttctagccttttcatattgagccttcttagaaacagaggtacagtcataatcataatgatgtaatatgttttctttagttcttacatacagaaagccatctagatcataatatagtgctaatgtcatttatacattacctatggacatgctactgataattgaatcgatgtaatgatagttacagattatctggcccatgtatgtattacccatgcttggactgaatcaataccttaataatataatttgatatagaaaaacattttaataaagacaattatttaaatgatagaaagtctaagaaaaaaatgtttatgcctacctagttcagtgctcccctaactcatccataaaccactcttcactttacttccaggttaaatgcctagagggatttgaaggtcacagtggatcattacatgaaaagatatttaatagttcatttttacactagattgctagttagctattattttttctaaagtaaatgtagtatattgggattccttttttatctacttcattatattaagtcgaattgatccaaaccgttgatttttatgacctgtgagcttttcagcattgactttgtagagatgatcatttaaagaacagtattttgctagatttatggttgtttacataatattttgttaatccgactgttaataaaaaatgagaagttattttagtggtgtttcttagtagtattctcacaaaagcagtgaatgcataaatcataattatgtggggttgatgattttaattgtttggtactaacatgcttttgtcaagtgggggcatcattgatctttcttaggtaagcagtgtagtaagaatgctttgctttttaaacttaaatggtattaggagtaaatacttgttctcttttcattttactttagagggcctgtatttaatatgtaaggtttcttataatagctagcacttttaattagtagcaagatttaaagtccggaaacatttagcagttttctttgtagttttcaattgtactagcctctaaagttaccatcacaaattgcagttgttattcagtaaaagaaaatgatatggttttaataataataaaactttagaataaaattgttaatatataatcttaggtttgttattattattgatgttttaagtatatgaacaagggtaaaagtatatacttaccatttaaaacacacacactactaactcacctggtattcaaaagtagctctcaatgataattagaaagtattttgagcatatccaaaatacatactgttgtgtgctgttgctaccaacacctgactgttgctaataactctaaaactgttttgccatcattaaatttatataagaagcatgtttgaatatggttatcattgtgctatttacttaaaatgcatatatgattactgtatttttaaaactaatgataattttaatctttccactgttaaaaatttgtgttacatttggacctcgaaatacattatttttaacctagtcaaaaagaaaccgtatttgtacatgattgcatttgggggaaattttgagggtgtgagaattacataggtatttagccttaagtatttcaaaactttaacgtgatgtttccatcagcaaagctcttggcctgttcttatgtataagtttaaaatcttgcatatctgcatccttgtcaggcaaatgccaagggctaaaactgaagataatttaagatttatgtctccctcttggaggttacagttgtcgtgaattgacagttgtgaaggatctaaactgacatcaaagggttcaaatgatctgattaggtcaattaatgttaattttcatcttccattaaattcttttaatgttttccccttttcatttttttctagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaatgtaagtagaaacattttccattccctatattttgtaagtgatagacatttttgaaaagaacataaaataatttcttagcacatcctgaaataatttatatttgttttattaccccacctcttgcttttgagagatatatgtcagaaagcttttcctttttcatacctaaaaacaatcttttctctttttaaaagtggtggctgggcgtggcggctcacgcctataatctcagcactttgggaggccaaggcgggtggatcacctgaggtcaggagtttgagaccagcctgaccaacatggagaaacaccgtctctactaaaaatacaaaattagccaggtgtggtggcgcatgcctgaaatcccagctacttgggaggctgaggtaggagaatcgcttgaacccaggaggcagaggttgcgatgagccaagatcgtgccattgcactccagcctgggcaacaagagcgaaactccgtctcaaaaaaaaaaaaaaaaaaaaaaaatggtttttctccttaatctcaaagaactgacttcaaattattatgaaaattgtgttagtgttaaaatgagatgagacaaataagcctgtaattctttacattgacaacaagggattacctcatactaaatttggttgtcaaggctagtctttggtcccctgccttaacctctcttttagatggaaagcttcaggcagcgaaacgtgtaatcactgtttttattcatttatttatttatttctttaattttccacactattagttttgttgattgaattgctgtgaaattgctggttactctttagtattattgaatgtcaaatttttagattcagtttgttttaaaaacagctgtttttatcaaatactatatgtacccactgtgctattttctccctcagtgactacaagtctctgaatcctcaagatattaaagagaacaacaaaaaggtaagaattgatgagcaagaaaaatacgtagtttcaattttggcttctctgcaggtctttattaatttggagaaagtgaggcagttttatgaggtcataactacaactcacagagggttgtctgcttactgcggttcattaggatacatggtttactctggtttatcatggacttttaaagaccacaagtgccaggttggcatcatattataatatgcatattatctttttaactgttgaatatttgttaaagcatagtgctttttttctaagatttagctttttaaaaatgcacccaaaactgttgtgccatagttgttatgtaagtttagaaaatatgctggttggggatgagaacgagagcctaatggtaagcaagagagaatacttaggttctgagaggcaaaaatatataaaccttggttcttttcattttctggtaaaccgtatacagttattgcgctgcaaaacaacattttggtcaaaaacagaccacatagatggtgatgtaccgtaagattataatacctcatttttactgtaccttttctatgtttagatacacaaataccattgtgttacaattacctacactattcagtataggaatatgctgtgcagctttgtagcttaggtatagcctaggtatgtagtaggctgtaccatctaggtttgtgtaagtacccactgtgatgtttgcacaacaacaaaatctcctgacaatgcatttctcagcatatatccccattgttaagcaacacatgactatattttcccacataattaatcaatatattgagatcagaacttcccaactggtatggggcaaggggatatcgatcctttcagctttcagggcatctgtgtaaggctgagttgctggagccctgggccagctaactgtggccacaggctgacttatctgtttaccccagcacacagtatgtgcattctgtgtgcaaagagggaagcacctaactcagcacacagtaggcactgaatgcttttttctactgaattgaattcttcaactgaaaaattaatgaaatttattattgtcttagaacaggagttcttaacctgtgaactgtgggtagaaatcagggtgtccttgaacatggttgagggaaaaaatacattttactttcataattcctcatctgaaatttagcatttccttcaattatgaatttaggcaataaaccaccatagtgttaaccatgcctgagactttgtcacctttagaaatcacagatattttcgatattttcatgtcatgctatagttgttgctgcagatatctgcaaataccttttacacttataacttcttcaaaataattagtgcagtcataaaaagcacatatattactacttcccaaattcattttaagtaatactttcataggtgtatttttcagtataattgatgtcttttgtaattctatgtattttatccatgtaaaacattattctgagaagggacccattgccaaaagggttcatgagacaaagtggttaataacctctagtctaaagtttttaacatactttaaattaaataattaaaattactagtgatacaaagtcttgggaccttgatagaagttcaattaacaagtctttaaatcaaaacaatttttcacttgtattgctctctaaaaccaaaaatgtgtattgctatcaaaaagattttgtttcttcagcctggggaatgtagcaagaccccatctctacaaaaaatgaaaatgttagctcagcatggtggcatgcacctgtagtcccagctacttgggaggatgaggtgggagaatcgctggagcctaggagcccgaggctgcagtgagctagcatcatgccactgctttccagcctgggtgacagagcaagaccctgtgtccaaaaacaaacaaacaaacaaaaaaatggttgttttttcacaaatgcataatgctggccgtagagcaataaaaacctggcagtctctattgaaatatgccaccaaaaaaaagataatctttaaaaatcagtatagttttcttacagaaattaccctttggatgggcatgttacaaagtaaactgttctcatgaattaattcttgtataattttggagagcctgtgtctattaaagtgaaatgcttctttttcattaattacaattaaattatatctttgggtgtggcagtgctttacctccattttcttacatttgaacaaagtggtaagccaatttaaatacagacatgagcattataaaataaaccattttttaaagtggatgtttcaacttactgttcaaaattttgaaaaagaaatattgttgattttacctcattataaatgtgtaaagaatatagggaatctcagtaaggcttaagtcacacttctttacattagcttttcattaacttaataatggtaagcatactttggatttacatattactccatacagaagactgtcccattaaaattttttttcaattaaatcttccagtacagacaatcatggcttttgaaaggctttatctttgatgattctattcattgtattattcaataaataattgtttttacatagtctttcctttcatcatttgctacttcttacctgatagctacattgagttgctacctgcaaattacttctagcttcacacatttcttcccaataacccatgtgcccttgaatggacttaaagcaccataggaaaacaatgcctgtgtcttaaatttcatacagatgcataacataactggcagtaactcctccttaccaatttaataacatctacaaatgaataagataattttcttagaaagacctcttttttcacctcacacaaacaggtgaaaaacagtaggtagttagttgaccatggcagaagaggttaacctatgggaaaagtcctttataaagccttaaccttgcttaaaagaaacctagtttgtttttaaatgtttttttagtgtaattagtgtacataaaatgaattgctacatgaagcaaaacaccagcaggagtttccccacaaggaagctaatcattttcctgggtctgtaaaaagtgctgaataaaaaaaggcattttcctgtgacatctgatcttaaccaatatgtcagtgtttttagataatttgggaatgtttagaatactgcctgtggtgctttccctgatggcctgcaattgatgcctgtcagtcaagttgtcaagacacatgaaaaggaaaatgacttcaattttcctaaaacatgtaaaataacaaaccaagcctatacatgcacaccaactgagtcattctctctagtaaatattttgaggtacctatattatgaagcctagtgctgtgaaaattgaagaggttttaatatcacaatttatttttcattttctttcttacttgttccataatgtttgttaaactacaagaatatgagacaaagattaaattcaaacatagcaatgtactttaacaagtaagtacagaagactgattcattctcaattgttacataatttcctaacatgtcttttaagaaaaactttgaattataatccttaatctaggttgctaaaaagagtaaacattttacatcccagagcaagaatatatctagacggttcttactttctctgagagtatatctaaacctttagccatacttttaatgcttcctagcaacacaatgctgttttcaagggttagttcaggatagtaataattaattgtaaattgagaaacagcttagattattcaaaactagaaaaacctgatgtgccacagtcatttaaaggctaacaaaaataatacaatgcagcctcacattctcaactaggttgtagtactcaaaacatttcattctttccaaaatgaatgaattaaatgaagtcactcttttcattatgaaaatcagtcttaattgagcatttaaaaatgtttctgtttctaggcttaaattgcatttatttgtattttatatcaggtaatctagtagttcttttgacttatctagctgtgcttttcttcacaaatcactgcaattacatgactgtggaaaagagaggttgatagaaatgataaagctcaatatggattagtctaatgtttctttatactttagttccttatcttaaaaatccattctcagagttttaaaaaatttaactctcatttttgcttgtttcatttattggaaaaaatattttaattcttatttattacacttttttctcttgcctctccccccacttttacacatgtctgacttttggaaatttgttcttttcatgtgacataatgtcgataacatgtacccaaacaacaaaaattaaaaatgtgctctttttaaaatgtgtgaattatatgaactgttcaatatatcttttgtttttccttcctttgaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccaggtaagtgagttagaatgctgaatactatatttagtaattagttattctctgtttttgtttctttttgcattcatagatgctacaaatgattaaaggtgaagtgtaatttctattataaaaactcctgaggcatgtagtaatgtgtgcctaagtccccactatttgggaggctgaggaaagaggattgctttggcctaggagtttgaaaccagcctgggtaacatagcgagtccctgtctcaagaaaagaaaaacctgaaatatacctgctgtatatttaaggtttatgatataatattttaagcctaaaaatcccaatttcaacactgaaggatattgtgtaataaggctatgagaaaaaaattgaaggataaagaatgtcaacttttcaaataaaaatattacttataaaaacaatattctactataaaataaatcaaagatgtttcaatattccatttaataagaacatcattctaaaaatgtataatgccaaattaaatatttcccatttaaaacattttccttaggtattttagttggtttatttagtcccatcattacttgtggttaaaaatccctgcagcatccaaatttctcctcatgaagggaatactgtacggttttaacctttctcttactgatgatattaataatttactgtttttacttgtatctctggtaccatcagttataagatatactaatattttatgtaccacaacaaaaaagaacaacattgtcaataaagttatgatacctggttttcctatcactcagaatttttatagctattgaaagagctcttttagacttatttaggcatagattatttgatcagataacactcgtgtatatataaggaggaaattttaggcaaaataaattgattaaggtattcctaaaagtttttcacatttagaatccagctcttctgaatcactttttgatttagagttgttggtattccttttttttttttctgcacagttatcctctgtgccatcaaaagcattgttacagtaaatggttctcaaagccagatttgggggcctctgaagttctccaagtccctttcagagagcccccaaagttaaagctattttcataataatactagggcattgtttgcctttatcactctcattctctcacaagagtatgatggcattttctggaagttacatgatttgtgatatctcaacagattgaatacaaaagtagatataggaattcagctgctttcttttatattgagatttacaaaatatgtaaaatactgccacccttctcaatttttgtttttaaagtaattattttctattaaaatgtgttaacatctaatgagttcattgtggctacttctaaatgaaaaaaatattttaaaaatatatcagttttaatatcaaaaatgacaaatatcagtagatacaatctgtataagcaagagttttttgggatcctcaataatttttaagcatatatggggatttcgagaccaaaaaattgggaaatctctgagttgttttttctttttttttgaaacagagtttcactcttgttgcccaggctggagtgcaatggtgccatcttggcttaccacaacctgtgcctcccaggttcaagcaattcttctgcctcagcctcccgagaagctgggatcacgggcatgtgccaccacacccggctaattttgtatttttagtagagacggtgtttctccatgttggtcaggctggtctcaaactcctgacctcaggtgatccacccgccttggcctcccaaagtgctgagattacaggtgtgagccaccgcgcccggcccgaacctctgaatttatagcatttctccacaactgtctctgggattttcttccaagtcagtatactgattgataatggcactttcttggctttaccagaaggtttcaacagaagatttttagacagtaatctggagttatgtttctttctcaaatagtcctcaagtggtgttgactgaaacatcaaggaattgccatcatgccaactgaaatatcaaacaatatacgtataggtagacaaccatgtcttaactgccacctggatgacagagagtgtaagattctgccatttataagttttcagaggtgtcaagaaagaatttatatcttagaattaaagaaatataatagctgccaaagcaagcccctgttctcctaatcataaacctcaaatcaaaagtcctaagtagctaaatctctctgaaagctttcaggacagcatatgtccacacatagtagataatcaataaacatctagtgattgacaatttcaagaacttgatgaccctaaattgtcatattcaatacaaatttttcttttttttttttttggggggggggggtggagtcttgccctgtcacccaggctagagtgcagtggcgtgatctcacctcactgcaaccttctcctcccgggttcaagtgattctcctgcctcagcctcccgagtagctgagactacaggtgtgtaccaccatgcccagttaatttttgtatttttagtagagatggggtttcaccacattggccaggctggtctcgaactcctgacctcaggtgatcctcctgcctcagtctcccaaagtactgggattacaggtgtgagccaccgcgcctggccagatttttcttgaaaaccagatttttaaggcaaatatgtttagttaaaactaggaattgattgatgtttaaaattttaaaataccctggactgggaatcagtaagcctggaatctcgttttgactctcccaataaattagtagtgtgacatgttaactagccatttagcctctctcgatcttattttccatgtatgttaaatgaagcaatctttaagaacccctttagctgtgaaactatcattctgtgattctattcagatgattaaagtgtactggatgatagaagcaatgtctattcatagctccatgtatgttttctctttggccattggcttattcagaatttttcttggggtaagtttaaaggtttttattgacactggattggcaaaagtaatgtctaacaataaacactgtaatataggtgctgacatttggtaggcttttaaaattgtatatagcagctgaattttggacaattaaaaatctgtttctcttttgtacaaagtatttcaattctcagatacacatctttttacattttaacttctccgaaatcaatatattatttataatagatagtgtattagagtttaattgacagcgtttgttctttcttagtagttcataaaataatagtaactcttacaattaagaccattggattagaggaaatttagtaactttaatatggctttatatacttaacaaagtcataatgttgtccatttgggtgcctaatacatgtgatgacagttatatatcttacacctatctcttagactttacaactcataaggtaagtagtcaaattctatattatatgtgggaaatctgaggtttgcagagttacttaagattacatgataaatgttaaagtttgaattcaaaagcaaccttgtcttcaaagtctgtgcttctccacttgatgcttataacatctttatttaccataatagcattaaaaaataatcgtagcccaaatataatgtggtcaacattactgaagggcaatttaacaatgtgaatcaaattccttaaaaatctttatctcattacatcctactttcaggaatttttcctaaggaaataattagaattgtataatatggccgggtaccatggctcactcctgtaatcccagcactttgggaggccaaggcgggtggatcacctgaggtcgggagtttgagaccagcctgaccaacatggagaaaccctgtctctactaaaaatatgaaattagccagggtggtggcacatgcctgtaatcccagctactcgggaggctgaggcaggagaattgcttgaacccgggaggcggaggttgcggtgagccgagctggcgccattgtactccggcctgggcaacaagagcgaaagtccgtctcaaaaaaaaaaaaaaaaaaaaaaaaggtataataaaaatttacttctaaagatattcataaaagcattatttatgatagtaaaaaattgtgtgcaacctaaatgttcagcaaaataagacaagttaactaacgtatgatgcatctatacaatataatgttaggtagccaattaaaaatcaagttttaggctgggcatggtggctcacctgtaatcccagtactttgggaggctgaggtaagaggatcgcttgggcctgagaggtcaaggctgcagtgagctgtgatcatgccattggactccagcctcggtgacagagtgagaccctgtctcaaaaaagtaaaataataaaataaaataataaaaaaattatgtttaaaaaacatttaagaccatgagaaaatgctcaaaatagaataagtgaaaaaaaaagcatgattctacagttattatctctgggtaccaggactactactaatgtttatttttttctttttaacttgtatttattttctgaaatctctgtagtgaattgcatttctagccaggaaaattaaaaaaaaactgtgtttatgtgctgttaaacacaattggtgattttataatcttttggtgatttgattttggtcttaagaccaaaacatcttttcactgtccatgtagctggttggaattaccaaaagactataaaatcacagaatttagagctagtgagatcttaaagatgatccctcatttcaaagattaggaaatcaagggattaaaacaagtagttaatgtttattcagtgcttgccatgtgccagtgctcagtacattatgctattatttaatctttgccctgtccttctgagagttggtctatttctatccttattttataaatgaggaaactgaggcttagagaaattaacttgcccataattaagtggtggaactgatatttgaacccaggtctgtctgactccacatcatgtaatggaatgcagtaagtttttaactgacctgctcaatgttacattgcttattattagtgggagagggattaacagcctgatgtcttgactgaaaattcagtgttcatttaattaattttgtctgtttttgagacactgttgatattgtaactaaattctattgtgtcctattcaacatgaacttagacttatcgttatcacttatacattttatttgtatctattaagttaagaatttttgtttaatcctcttaaaaatctttgggtgatgaaaatgtcctggaattaggtagtggtgatagttcataaccttatgaaatactaaaaaccactgaattgtacactttaagaaaaatcttttcttctttaagtttatagaaaaaaaggctttaaaaaatagttgtagtaaaatataaagaccacaaagaagcccaaaaatgctgaactaatcttaaaaaagatggtttcacataatatgaaataaagtaatagctacacttattttcttttccttgacagtgatacttatgattgaaccaaaactatgcaatgaaagggaagtaaaagaaattaagtatctgataatagtaatagacatctaaagccagaagttggttacttagtagaaaaaaaaggaatttggactataaggagtatgaatatttgtgcttttggtttaagaactgatctctgttgatggacagtatctgttgttctccaaaattacattgtaaaattacagattaatccaggagaatactttttcaattctaatattttcaattgttttgttataaggatagtgagcaatggggaagactagttttacttttttttaatgaaatataatagctttgaattttctataaacattctcaaggatttaaaggattatcgccacagatatttaatatttatcaacattcaaatttggaagacatgttgttatcaattctataagactaaaaataaaactctgaactttaaaaaatgtctttgtcagattatactgtgtttatgagcaaatactgagaatatatagaatatatattagcctcatacctaatgagaatatgttctaataaaattataattaaatttaatccagttttagacagtaaagatgtatttccctcatgtcaagatttatatatttgttccacagtttctagtcaacattaatattctctataggtaatctcatgaagctacaatcttattcataatctctattatttcagcagattgtctaacctttcattagtttacaaatgtagattacccgttttttttttggcttctaattctgtatctttgcttttaagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatgtgaggagcattggttaaaaaagaccataagttgttcattgtaatcatggggaggagggaagtaatttgcttgtatttctgctatgttatttttctacggactgtacattgtgaatacttggtgcacttactgaactgataaagataaattcatacttgtaggaccatttgatcattattcctacagagcagtgttagtgatgaggaaaagtaagatctgggaatataatttccacatatacatgaataatctgttttttgttaatttatattttataactgtagttgtactctaagattgtattttgtcaatggaagttaattttgttggaaatgtttgaatataatactgatgtctattatttattgaatacctactaagtatttcaggaacaataattttgttttacttaactccatggagactgaggccaataggcaaggtaacttgtacaaggtcacagagtcaataaatggtgaatccaggatttgaacctgagccttattagattccagagtcagtccactttcctatcatatactgccatccttgtactaaaccacatttttatatatatttttgtgtagtgcttcacagataataatgaatgtataataacaggagcccttaaaatttaggaggacacaaacatcttcatgaatgagaaaactgtgacagtctcaccacagcaccatcatgtgttagtagttgtttttcccagaaagagcagctctgtgccatatagctaggtagctacatgccaggttggtcaccttgttgcatgtgtttcacgtttacccaaagaagtaccctattgcttatgagactatgctttgaatagtcccaagatattttcccacccttcctctttcaagttatctattcctgcattaaaaaccactgcagggctaggcatggtgacttatgcctgtacccaacactttgagaggctgaggtgggaggatcacttgagcccaggagtctgagaccagcctaggcaacagtgacaccccatctctacttacagaaaaaaaaaaaaaaaaaaaaccaccgcaaaacttactggcaaaaaacaaccatcttattaggttaatagattctgtgagttaagaattcagataggacacagtggtagtggcttgtttatgttccatgacgtctggggctggctttcagctaataagacctctgccagactgtcagttggaacacctacatgtggcctctccatatggtctctctacttctctagtgtgggcttcctcatagcatggtggctgacttccaagaacaagtgtcccaatggaataaggcataaatatgtggcattcttatgatctagcttttcttaaaaacaaaatcactttaagtttattgtaagaaaggaaaattagtggcaaatttcagttatgaacatagatgtaaaaatcctatagaaaatattaacaaattcaacccagaagttatttttaaaagttaacataccatggtcaatttggatttattctaggaatgcaagattgtttaatttttcaaaactcaagcaatgtaattgacaacattaacagaataaagaaaaatcaagcagatatagaaaaaggttggaaaaatatcaacatccattcatgatccacagagagaaaagaatcacatttcttagcctctagggatagaaaggaactttattactttattaatgtgctaaaatgtacatataaaaagcctatagcaaacatacttaattgtgaaatattgaaagctttccatttgtgacagattaaaagacaggaaagtccactatcacttctgttcaatatcataatggggaacctaagacaaggaaaagaaataaaaaggtataacatatgaaaagagaccaataaaattaccattattcaccagaagtatgattcgtacatagaaaattcccccaaaattacaagattactggacataaaattaatatttgaaaataaatgcttttttttttttttttttttttgagatggagtctcgccatgtcacccaggctggagcgcagtggtgcgatctcggctcactgcaagcttcgcctcccgggttcacaccattctcctgcctcagcttcccaagtagctgggattacaggcgcccaccaccatgcctggctaatgtttttgtatttttagtagagacagggtttcaccgtgatagccaggatggtcttgatctcctgacctcgtgatccgcccgcctcggcctcccaaaatgtgaaaataaattatatttcaataagatacacaaatggccaacaagcacataagaaataagaaatatctttagtctcattagttatcaagcaaatgaaactcaaagccgcagtgagataccactatgagaatgactagaatttaaaagactgacagtaacaagtgtggaaggaatctggagcaactagaactctcacattttgccagtaggaatgtaaaatggtacaaccatcttgaaaaacaggccattgcttatgaagctaaacatacacttacatgaccccagcaattccattttaaggtatataaccaaaaaaactaaaaacacatggttattcgaagacttttacacaaaatttcatggcagttttgtttgtagtacccagaaacaggacaaaatttaaatgtccatcaccagacaaatgaataaacacatcctgatatagccatgcaatataatattacccagcaatacaaaggaacaggacactgagatgcacaataatgtaaatgaatcttggagatattatgctgcgaacacaaaagaggacatgtataattacattcacatgaaattctacaacaggcaaaactaacgtagcatgacagaaagccaattggtggttgcctgatgccagggtaggtgggatatcatgagcaaactttctagagggatagaaaagatttatagctttattgtgtctgattacacaggtatatacatttgttaaaacatcaaatttaaaatgggtgcatattactagatgtaaattacatctttatctttttaaattattacaagcaaaagttttaaaatatttacaagaacattaaaaatacgtagtatgctaagaataaagctaacaagaaatatgtagacctttaggcagaaaactaaaacattctgaaagatataaaagagtaaataaatggaagggcatattatgttcatagattagaagactcaattttttaaacattttattgtggtaagaacagttaacatgagagctactcttttttaaaaaatttgagtggatacaatgttttattgcaggtctgcattacttattcatgttgctcaaatgaaactttattcctgtagattagtaactgcccatttctccctccctccagtccctgtctaccactgtttcgctctttgattccatgaatccgactattttagatgcttcatataagtggaatcgcgcagtatttgtctttctataactggcttatttcacttagcataatgtcatcaaggctcatctatgttgtagaatgtgacaggactttctgcttttttaaagctgaatggtattccactgtatatgtaccacattcattttatccgttcatctgtcaatagacatttaggtggttttcacatcttggctattgtgaataatgctgcagtgaacataggagtgctaaaatctcttcaagatcttgatttcagctttttctgataagtaccccgaagtgggattgctggatcatatggtagttctgtttttaattttttgaggcaccttcatattgtttttccataacagttgcactattttatattaccaccaacagtgtgcaaagattccactttctccacattctcaccaacacttgctactttagttttttaaataatagccattgaacaagcatggagtgacatctcattgtgatcttgatttgcactttcctgatgactagtgacattgaacatcttttcatgtacctgtacctgttgtccatttgtatgtcttctttgaagaaatgtctattcaagttcttagcccactttttaatcgggttaacagtttgttttggtgaggggtggctaatgagttataggagttcttatttattacttaaaggaccactggtttactttagcagtttctttattttattcctctgtactttatttctgtacaagtaaacttaagtccttctgatgaataccaaaaataatgagaagagctattttaataattgctgttgtagtacttaaatagaagcatgtagtgcatgggacaatgtccatgtactcagtacagttagctacttgtgagacttttgtatttagttctgggtgagagaaagtgagaatttacaggggattcagaaaagggttaaaggattgaaaggaaaggtctacttgtaagaaataaagccttataaaatgtaaagaagagataactgggaaatagcttaagtgatcatttgaatatatgaagcctcaaaatccatctggtaaccccacttacctaagagaataaacttcccaactactcagcatggcctcatgtccttgcaaatcctgtcccctccctttacagcctcatttcttacctctctcatttttttcattctacagtccagttataagttgcttactgtatctaaaatgtgccatactctttcattcttgtgtcaagcatttgctgttgttgccttgaaatacccatcttcccttattagtttctagtgaaatagcacttctataaacactgtcctcatggctccttgcagtgaagttaattctctttcctatatcttttgctgttattctctaccgtagcatgcattcatcccaatataattatctaattacaaatctcttcctctcattcaactgtgaactatttcaaagtacaaggaccttgtatccccagcaccaagtagtagtatttggtaaatgttcattgaatgaataaatgaagggaatagtgacaggctatttttcatatcctctgagtgtcacctaataaaaaattagcttaaacatgaaaactttgctataaggaggttcttagtaggtttgtaaacaggaaaaataaatgtttctctgaagttgtttaaagcagaattgagcagaggaagttagtgttcccttgtctgaagtcagttacagataagattacttttgccacttgggtacttaagcttatatcattctttccttgctattctcgaatcgtacattatgatacctttctttgttgttatgatgtgtgtatgccaaatccttacacacaccagcttttcccatatcctgggactctgattagagttcagctttcagttctgccttgaatcacaacactacaaaacattcccttccaaaatgagtatagctttaggctgctagcctggaaagctgtttctaagacactgaaaacaactctcgatattcttattgggtggacccttacgtacagactccacttaagttatcctcaggaaagatataagctgtaatttcccttaaaggacaactcacaaacacagataccataaaccttttaatttttctaaatttttggcaggactaccattgcatattttagtgaatacttggtaaaactacttattgcctttcaagtcttttttcatgaaagtcatttatatgcttcattcatacctttgtgcctttagaaactcctttaacctgtttcatttgctccctgaaattatgtctatgggagacagatttcattgctctgggtctgtattttatgtttcttttcttcctgttccttttgttctatgaagattttcaaaggttgaattttactaatgtaagttttaggtgtgatatttgtgtttttcatttttttccacatgtgctttaaatgatttttttaagtacaactcaggagtttggtagcttcagcagtccacccagtatgtaattcaaaggagacgtcttgatcatgtaatatataagcacagacttgaagaaaatgtaattttttcaagaaaatatttctttttttattatttttctttattactccatttccccatacacttttcatccagatatgtacaaatagaattttaaaaagctaatctggcctgtaatcccagcactttgggaggctgaggcaggcagatcacctgaggtcaggaccagcgtgaccaacatggtgaaacccatctctgctaaaaacagaaaaattagtcaggcatgacagcaccgcctatagtcccagctactcaggaggctgaggcaggagaattgcttgaactcgggaggcgaacgttgcaatgagtggagattgcgccactacactccagcctgggcaacagagcaagactctgtctcaaaaaaataaaaatagactgggtgtggtggcccacgcctgtaatcccaatgctttgggaggccaaggtgagcagataacttgagttcaggagttcgagactagcctggctaacatggcgaaaccccatctctaccaaaaatacaaaaaattacccaggcacggtggctcacgcctctagtcccagctactcgggaggctgaggcacaggaatcgcttgaacccaggaggcagaggttgcagtgagccaagattgtgccactgcactctaccctgggcaacggactccatctcaaaaaataataaaataaaaataaaaaataaaagctaatctgtttcagatgcttttgctaattattttgcattggaatataattgctttttaaaaaatgcatttaataagcccaccattacatttaatgatacttatatacttgtataggtatctgaaagggatgtttgcatttgatgtgcttaagtttagaattcatacactctaagcaaaataaaggatgatagtcctgctacccacagtccttggaatttttgttagcatattagtgaagcattttgaacatatcagaagaatgatgctatatatgtttaattataacttttttaacagaataaaatctattttataagtggaaaatctaaacaaatctaaaaagagaatcaggatgaaacttcagtctaattagtctaatcataatgatcagtgaatttataaatatgtttgtttttgttttgtttaagcagtaattacgtagcataagagtatggtttgcagatagttgttaggtatctggatgcgttttagaaagaactatcaggaagtaattacaatgctattataaaacagacttgaagtttttctcctaacatttaatctgttagcataatggcccatccattacactcaactggtttaggagccttttctcacataacaggtagcaggatgaaactgcaggttagcagcaagtcctggaaggtttgcagtatccatctttaaagacctgaaggaacgtttgaatcctctagagaaaacagtatacgtgggaaaggattttagtttggtcagctcttagttaactgctaagaccagtaaccacacagtgactttttttaagctcgcctttggaagtgaatccaaatggcttaagagaactaagagaatgcaagttgctcttttgcaaattaaacctttgacgggtattttattgccatgaagggtgagacatcaaccgcgtacttttgatgttgattggaaattattgatttaaatggcactagtctgtcatgccgataattgtagcagatttagataagatcactagatcttctccaaataataaaagaagcatttaccattcaattggtaaaaaacactaaactttttttgataatctctaatagtaaccttttccgtagttttcatatatatgtgttctaagtatatatcatcataaaaatatgtatgagattatacttacatatttatgaatattggctgtgttagttaaatagatagcttcttaggaatcaaagctttaaaattaagttcaagttaaaatttcgtatttttcctaattacacatattatcaattctactgttaggaagaagtacgttaactttacatttgtaattttgtgtgaaaggacatcaattatcacttattaaaaaatctaagacctttaataacatatagagtgagtttttagttaaaaaatctaaaacctttaataacatacagattttatttaggaatttttattctcctatgagctggaatgtctatgcccagggcactgaaatgaaaatacatccttactttttacttcaacacaatcaccaaaagatttaatgtacaaaatccatttcagaccagtgagacactttgagtgtagagctgatctttttatagttgcgttttagaggagaagaatgctggcgtacttctatgttcagcataaatagctctatacaaagcagcggtttttattccgtattattttaaataatagtttatctattatgtctaaatgtaagttgatttcaagtctgctatcctaacaatagttactagacttcttagaaaacatactgttagcttgctagcatatcttcaaagtcaaacaaaataccagcattgttgtggaggaaaaaaaaacctcaagcatcttttctattatgtggccacgaacccctagcctcaaaagtcttatttgaggttgccatgaatgcatgaagctagggctaggtgtcttagcatcagaaacactccttttatgcaagtaataatggctgtggacattttccatatggctgttcagtgccgtgttgaacatcccaggatgaatatcaccattactaaagctgtattttatattgcctattttgttattgctcagcatgcacaagagtttaaatctttattcatttcattttttaatgtttcttttgttcttcttatcatattctgctttcccaaggatatatgccttgaacgaaaagtcacatgtgcattactaattgtgtgctattgtatttacagttcctattggtggcactgtgaagctactaattcctttgcttcacttgatgtaaaataatctgagtgtctttgatagcagtgaaacagtattaattgttttgtacatttcttggtcactcttcttaggtggtcttcataatctattagaactttcagccagatttttgtaatgtcatgcctccagcagtgattaaattggtaattaatgaacagtccttggcaatgtaaaccacatcccgttaattttccctttcgagtttttagaagttgtcttctgtgtcagaaatcattgcgccaccttgctatggccccttggcatgaaaccacaacgacttgattttttcagccattagtagatcagagcagtaatttcacagtattttggtcaaggtaattataataccacgaactgagtagatttgaaaattcacgaaagaagtccagaaataccaggtgagcttccttgtgttcactggaacgttatgattagtttaattggtctttgtttgattttagccgcagaaactgtttgtgccacagtagtgcagtgactttatacttgagtgtttctgaccttctttgacagggtgggtgcaaaaatgagccctttgaaacaatcccctttctaaaagggggttaaactgcaattaaaaaattaactatagaaaagaaagccctctaattaatttcttaacatcttactctattttgtgaaatgtttagcaagtttattttcctctctcttcattaagaaatatgcacgactattttagtgctattttaaactattctgcctgtgagatattaatgacgtagagttttgatactgtataagaatcttacaatgccttaatgagagtgaaattgaaatgtggctttcctttttgtcacaaagtagatattcccatacttgactgattgcttatatgtgtgttagcccttggtcatacattgtgcacattagaatttaaagagtcacttgcatgttgccttctgaaaggattgtcttggtcaccttttctggaagcccttaatgaaactaaatagtttgcttggagtttggacctaaccatcagggtgtttcatgcagtcttgtcagttgatgttcatgaattgacttgaacaaagatcaaagtgtttctccaaaccaagaatctgtgagacagctccttcagttgtgccacaagagctaatcaagccatcagttctttatgcactctacgtgtctttagaatttagtaccaaatgatttgtcagtacaaattgatattctgattttttgcttttctccttcctggctctctttccctatttcctccaaaatgagggaaaatacagtgtctttttacaactagattttgttaagaagcttagattataattttgaaatggaatatttaaagtttacaaatacaaacaagccaagaacaagttaaaagttttaaatcagtgatattcatataccacaatactaaatatacagccaagcttttcagttgaacaaattaacttagagtctgattcttttatttttcttgtcacttcactgttttgataatagaactttgtcttgaagtatttcagttgcatcagagtactgtatttgttttccatgcttagattaaaaggaagttatctgaaaatacctcttagaggggggagttttataatttgaggaaagggaatagttagattttttccccctatttcagaagcaatttttaaaggatttagccctatttagcctgaaggtcttagcactaatgagagcacttaagttacatcaaggctgttgattagacagctcatctatcaactgaagcatgagaatttgtgtttggggtaccttttatacattttaaatgtatatgcatctccattactttataccttttcccgagtgctttaattggtctctggcatgacagtggttgctgtgcagtagaagtgtaactgaaagagagttatgtattatttgtgtcattaaagtttgtatttgaaaatcagtaaattttaaatttctgctttggcatgaaaattcaggcacttattttcataatattaaaaatttagtgtacataaaatattcttttataagatacatttgattcttttctattttaataggaactatcatttcccagcatttttaaaggatacaatctcctaattaaatttaaatgatataatatcctaattaaacagttattataaaaagtatagtgtgctccctaacttttgacatttcaaatttttaaaagaaatttaaaacatcaccactagcctgcactaggagcagcctgtaataacagtttttaaaagctttctgaactatttgacaagatttcttagtgctgaggccatatgctgtagcctttaagctatttcttcctatcagtttcattatcacctgcctctgagtctccaatatcatcagtaagcacatgcagaatcataattatgccatgtacaagttctttgataacatgtacagttttcttcttaattctttatcaaatgcattgatcgtggcatgtgtgcattgatccaggtccgccatctggctgtgtgtgataagcacagtggcatctttgcatttccactgtcattcattgcgctacaatttggctgcaggggagtagtggctgggattagccctgttctgctacttacttgcattttaagttgacacctctacagcggctcagaccacattacaaactgaaacacatacgcacgacttagtgatgtgacacttctcaataagcttactccactagctactcaacaatctgtaattggatttgtaggaataacagcaaaagatttcctaagaattgctagggacagaaggtgaagttttctcattattggcaaaaggctaggtatagatcctagacgattggtattttccattaaaaacaagctgccaacagtttgcaggacatttttttctttttaaaaaggacatggaaaaggatgtggttttcacttgtgctttacattttgatcacttgtatcttacgggatttttccagtaaaattgagaggaggaaaatctttcaagtacatctcaggaatgtggttctctgtattgtttcagaaatataaaatgatgaaaagacaatgtataggtattttctttgtaggagaggaaaaattccaaaacatagttaactaagaatagaactttcctgaatctctaatctggcaaggtaaagaacacttcttcctatgttgcatatacatctggtcggcttgccaaaaatctttgttttataatattacttcttttttttttcatctcaaatgtcaagtttacgcaggagaaaagcccttaagtgaagcactgtgaaacttagctgctacagatgaataagctgttttgagcactctttatagtatagcttttgagagatataggatacatcgtattttgagcaaaagtactgatcgtaatggatacagtgtgttttctttaaacactaaggtatttctgagctctgcccaccccatcactgttgtcaaactgatattaactgtcagcagtttttttgggtcttattctgagtacaatccaaaggagttcataaataaatagtttataagtaatactactagcatagaactatgacttacatagaagttacaaagattaggaagatcattaacactttagaacaaaagccagtgttggtggagtgttaaattcatcataaagggttctttgggtggctttattaagagacaacttgtagaatcatgtataccaaataccaatagagtatgtcatttcagtacctgaacaggaaacgaagtaagaagttacataagcacatatatatctgtatatacacatacagagagagacaagagagaagatgaacttggattcttagaggtttttctagtgaaaaatatcacaatataaaacagtaattttttttaatatgatacatagatgtcatacttttgaagggttaagtcttatttatctgaatggaactgcaggacagttttgcagaacactttaacacaaatacctatggtttactttgacgttacatttttttgttgttggtttctttactttaaatacttgaactgttagaccttctacttttttgctgagaaagatgtatttgtaccagattagaaaagctaaactgtttctttacattgaataatcagcctgtcatgacaaatctatctccttctgcatgagtaggtgccagtctgactggcttcttttaggctcacactgggttttaagctagatccatgtgcatgactggcagtgcatttgttgggccagatctaaggagccagagagcgttcagctcctttttgcctacaaaagagcagccagacaaccagcaagaggccttggatgtaacacaaggtgatacttacttagtcagccattcttcttttattcttataatttttttaaactaagaagttatcaatttcacaaagaaaagaggaattaaattatcaaagggtcctttttttggaggctcaaactatttctgttagttctactaatgcaaattgaagttttcagaaacacaaaataattgcttttataatcttaaaataattatttttggagaaatatagtacctactaggaattcatatgtattaagtaaatgaatgaaagaaaatgattatttatttagaatataaaactttctatcccagaatgcttaaaggaaagcctcatttagcaacattaacttgatctcatgtattcttttgtttaggattctttatttgtatagcatggtataacactgcaaaacaaatgctacaattaaaaagaatacttgctgtatcttgaaacaaagagatatattttaaaaactagagtatgatatattcattttcatgaattaaatacgttagatgaaatctaaattcttaaaatgtgtctattttttctgaattagtccttttatattttctactcatatattaaaaactatctcaaatttaagttcatattctgtttactatttttcctatgtatcttaaacaaatccaaaatttagtagttaccacaaaaataaatgtaatccccagggttgatcaaagatttaatctgaccagatggggcaaacttgagaaagattttgactttccactctgttttgcaacaagaaaggctgatttttttctttctttctttctttgttagagaagcagagatcaggccatccccagagaaatgagcaggtgtggccatttataagcatgtctgcttatattacaaaccagcataagaaaagtttgaaatgggttgaaaagatctgctaaacagttttaatgtttcaccctaaatcctatttattcagtcaggagctgatcaagctggcagtaaaatatctagtctacctaaaccttctaaaatcttgtaattttattttttatttaattctatctttcatagtaagtgagtgggcacactttggtaatccttgcctctggacaaacacagaattctttttttttttttttcggtccattctgaatgcctaataacagagtcttgctccctgtctaatgatgaaagggtgacagtcaagttctttcagtttactacaaaattgaggaatttcatggaccattttgagaacagaacactgttaaatattagcagctctaagtaaaactttttttaaaaaaatttagataggttaaaatttatttagctcaattaattaaagttcaattactaaggctgtatgaaacaccgaagacaaaacaaataagcacaggatgttcttgagggaggtaaaagatgaaatgtgggttttttttggtagaaacagagtgcttttttatgttataaacacaattttacgaagagtatggatacaaactacattgtttgaaataatatgtttttaaagttttgttaaggcttatttcatgaaaatgtgtgtagacatgtttcttaatgatctcagcagctacactgacagtttctcatgttctaattcaccttcacaaatccatggcatcattttttggctaaagtaatgtcagttggtgacatttgcggcaagtgtaaaaaggaccccccatggcagccatttttatttgattcttaagatccaaaggctgctgaaagaacaattgaataaagttggggattggagaagcttgattttcttgttctctgtgaaatgaaactccagcctttttcttccccttcccctcaaaagcaaaagtctgctagggggttgtagctgtgtcaaagccgctgggatgccactgctgatcactttaattactacgactaaggaggataaaattaaaagtagcaccattgaagcagtggaagaaagcttgcctagatgtcggtgaactgtgaaatataaaaattgcataccaatacatttttatggaaaggaaacaaggaattacattacttattcttgaagagtttgtccttaaattgtcaagttttactagtgcatctatctatggcagattgtagaccatttcagaatgataaggaaaatagtaacttgaagacatgctgtgaaagggctaaatattatttaagtttgtgtccaaagtggttagttctgatccatctttatttgaatatttcaaatccattggattgaaacagggctctttttgcaccataacaggacttttgccttatcctgaagatgttagcaaagagaaaagcaaagcttaaatacatttatcacttttctaaaggcttataatttaaggttgggaacgtaagttttaagtgaatgtaaacaaattagttgctgggaacgtaagttttaagtgaatgtaaacaaattagttgctcatcatctctctgtattcattgacacaaagggaaatgtaaactgatttgtatagcccaagtatacataaagaactgggactttaaaaaatcgtaatcactgtagggcctcagaaaatgctctgaatagcagttatgtaatagatagggccagtgctttgatatcaaacagacactgattttaattcttactatgccatttacaagatatatgaccttgggcggtatatttaagtgagattcagtttttgtcaaattggaatgatagcagctatctcagagttgtaaggagtaaatgagacaacacatatacatgtgtgagcacacagggcacagaactagtatttactcaaaaatttgttacaaattgtaaaaagatagtcatagggagggagacctcccaaaactacggcttctatgaaaccctccaaagagtacacatctatcttacaaaagcaagactatcctttataactcagtctaactctaaataataccatataggaaaaggtgaatgtcatcagaccctttctcagaaacaggaagtctaactacttcaatttatttaagtctatctagactacataagtaaatgaaagacataggggtttcctatgtattggatttttgaagtatacttatcttttaagtaacagcagttttctaagttgccttacctctgcaacccagtgaaaagattttttttcccagcacacatggtaaacatgatttacttacagctatgagccactgtctttttttgaaagaggaatggtcaaagcagataccaaaaccacatttcttaggtttaggcaaactcattgtcagaaatattatgaacgtatttgagcagtttgtgctgaacgctatacagaaataataagataatcattgtccctactctctagtcattttatccttagacataaacagtgtggctattttgagtaaaaaagaaaaaatgcatagattttattgctatctattctttcaatattattgcaaaaaagtcttttaatggagcctacatataaaaattaaaatgaactagttttacttatgatgaacctggagactaataaactgaaaattagtgctatcaaactaaaattgatggcataatcaattactataattacaagcttttccttcatgaccttaacaattaacttttattttctcagttggttttttgtcttaagggaagttaaagggtgagaaaacaaacaacacagatatgccatcccactggagagcttcaggcccaagcaaaattgtctctgtggtgttaggacattagtagaaaagtaaattaaggcaatctgatagggaactagaattctgtcaatcaggctcaagattttgtgctgtgtccataaactttgtttactgtagggttttatgagttgtaacctgcccttgcagtctgttaatgaggctaaatcttgctacttgagaattgaattacagcacacctctgggctaatggttataaacagaaagtcccattagggctacattctgatttgttcatttgcatttttttctattgtgtagagaacaatgatgagtaaataagtacaaacaaacaatttacatggaaattgataaagttcctaattagtatttagagttggttttattaaggattgactactttaaattgcactcttggtaagctctcagaaaaatttgcagatgggagtattatggggggtagaggaggtgatagcttgcaagaaaaaaattaggttgccatttcatattcagaaaactagaatcatttatttcatcttaactcagtaaaaatgacccttcattttagtttgaatcaccaaattccagctatgtaagaagttattattcactcagtgaaatacacttaaacttagttgcctgaggcatattaaataatggtttttgttagtactcttaacttttcttaagtttggaagatgaaagtttagtaaaagttccattttcctcatttgatcatataatttgatactttgggaatcatatagtttagtggttaagagcaagggctctggagtgaaacagacctgagctgaacacctggctctgacatcaggtctagctgtggaatgttgtgactctaaacttaagtattcttactggtaaaaataaagatgtgaaaattaaatattatgcacataaagcacatagcacataaatgctcaggagatagcagcagccatcatcaaactcaccattatcaatcctgtaatttcttttattcctagcatattttttaagtttagaaacactgatagtggtccagatgtggtggctcatgcctgtaatccctacactttgggaggccaaggtgcgtggatcactggagcccatgagtttgagaccagcctgggcaacatgacgaaaccccatctctccaaaattacaaaaattagccaggcatggtggcacacacctgtggtcccagctactcggggtggtggcagggctgaggtaggagaatcacctgagcctggggaggtcacggttgcggttagctatgattgcaccattgcactccagcccaggtaacagagtgagatcctgtctcagatttaaaaaagaaaaaaagaaatactgatagtaaacaggatttttttatgattttcttgcatcttcactctcactatgcctattgcatactattcctcacctatgaataagcttgtgtctccagatactaataaaatttcacttgaatgttagacctctcttcttttgcccctaccacaatatacacttcaggaagcataccatcacattgctttgcttttttgaggcagggtcttgctatgtagcccagttgctcaggctggtcttgaactcctggacccaagcagtcctcctgagtagcagggattataggtatgtgccatcatgactagtcgagattgttttttaaaataatgttgattataagagtagtacatgtgtattatagaaaattagaaaatgagtcaaaagaaaataaaaatatcaaattttgatacccagaaatcttcaccatgacaactttgcgtatacccttccaaatctctttctatgcatatgttttcttaactctgacttattaaaattaccaggtcagttgtctaggatatcctaccttctggatctattttgttgttttcttgctgtgtcatttgtcatgcttctctatcccctgtgcttatgataaacaggaaattatatctaaaggttgagtggattcactttaaatatttttggtagaatattataggtggtgtgcagttcatgtgcttcatatcaaaaaacatatagcgtatgattgacccaacattaatgctgctagattcgtggtccctaatctctgatctagttcttatctctctttttacaaataaggttttccccttgcaactaaaagtagtctgtgtggtgttacttaagcatatgttccagttattattgctgtgtaagaggccaccccaaacttagtgacgtaaaaaaaaaatgtcttgctattatgctctacaaattctgtaggtcaggagttcagacagggcacagtgggcatgctttgtctctgttccacattgtctgagacatcagctaggaagacttttaacagttgggggtggctcaaaatggcgagagtctgaggtcatctaaagccttcttcattcacatgtcttggaacctatgccagaatgactgaaggctgaatttggctagaatggtcaactgaagcacctacatgtaacttagtcctctcgctatatgactgctgggttcccagaaagaggacagaatataagaatttcaagacagcttaggcagaaagggtatggccttttctgacctagccttggaaatcacctgcaacacttctgcattctatttcttacatacaagtcactaaagctggctcagaagaattaaactcttcctcttattgagggaatggcaaggtcacattgcagaagagcatgtgggatgagcgataactgttgtggccatctttggaaaatacagttggctgcagcatgactatctggttccccatcggacatttacctaagagctttaattacagttgatgatccttgccagaatcattcattatgatttgcaaagtgattttttttataattctaccttttaggggcattattaaatgatattttataaagtagagctaggccaggcatggtggctcaaacctgtaatcccagtgggaggatgacttgagcctaggagtttgagaccaacatgggcaacacagggagaccctgtctctacaaaaattaaaaagaaaaaaaaattttttttaaactacagctaccatgcctgtagttccagctactcaggaggctgaggtgggaggatcgcttgagcctgggaggtcaaggctgcggtgagctgtgattgcaccactgcatttcagcctggatgggtttactgtatgtacacacacacacacacacacacacacacacacacacacacacacacacatatatagtagagctttctgttattgactgagaatattttgttactccaaaattcatttcccactggaaatacaaaataattcttttcctttaattactactttttaggagttatttcaaaagctgccttaaatggtaacaaatgagttttatatccttctatgttttgaatatcatattggactcgaattttccttgattcagtgtgtgacctcactgattcaattcattgcagtcatttttgtttttgaaagtgaaattgtctctctactgggttcttctaattggttctctactgggagcttcaagctcgtccctggctccattggacatccacattaacctacccccattaattttgatggcttacttgatttctcaagaaatttgtgaaaaaaaaattgcctgggcttgagttctacccattggtttctacccttgtccctaatgatatgtcaccaagttttgttttgttttttaaggcaacagactatttaatgtggtttaaaatacatcaatgtctcaccaagtttcattgcccttttaaaattttcagactcattaacctctaacttggctgcaattgatactcctttttcttgaaagcctcttctactttgattttctggatacttcagtgttctaattttctcctttctgtgtcctcttttcctcttatgtacgtatagatagatgttttacatgttttagtcagtgtccctcctttttctctagggtacctcttcaaatgctttcatggattcctataactcatcagctctctagtcatagtctgacctcacatcctagtatccattttatttctcaactacctactaacatctactcagatgtcctgccagcttctcaaacccagtatgtcttagcacagactttctctccctcccttcttatagttccttttagtttttctatttctattatgagcatcacagttctactagtggcctaagtttaaaatttctgagttttttttccctccctctgcatctattatgttaccaagaattggtgcctctaattctaatatattacagttttctctttctattcccattgccactgtcttagttttgtatctcactacagtttccttggactcttataagagcctcctaagtagtccattgccatccttctatgtcagtctattttatgcaccattgcctgattaatctttctcaaatacacctctaattgatgattcccctagacttaaaaaaaaaaaaagacatatgcataaaaacaaagcccggcagtggtcctgctgtctttagaataaaattaaagcacctctccctgttggacagggcctttaaagtatctcctcaaatttatttttcttgccttgtctgtcactgtttttgccctatgttcaggaaaactaggttatatttccccgtatactttcttgtctctatgtttttgtactgttcctacctccttgtctctcttgcactgacctacctaaccaccaacttcgatctctacccattccaaatcctactcattcttcagacccaacttgaaatccatgatggtatgatacattctgtttgcccctcagccaaaaatgttctcttttttctgaacccttatgttattttgatcatactgccttaacattgttactttctctttctctatataagttttttgagagtataaatagtatatagtatattctcctgcttgaaatggttacagcacctagcacaaattatgtgctaaagaccagagatacaaaggtaaatcagctatagttcaactctaatgtgaaggaggcatccctacaaagttataatgtaaattgacaagtattgtttaaaaaaataacatatacacgtagacacacatgaagtactgaagtaacatagaggaaggattactttatttcatagggaaatggttggggggatagtcaggggaggtttggtggatttaaactgaatctggaagaatgagtagaaattaaataaggtgagagaagctcattccaagaaaaagaaatgacacactcagagccacaagtacatgaagctacatgatacaaacaattctgtatgaatagatgtgaagatttatggaggttcggagatgttaaggggagataaccctgcaaagatatgttggggccagattatttcagtctttgttttatcataataatgccatattttatatgcttttcaatttacaaagcagtttcacattgattatttgcgattcataatattaataatccttttttttttttttttgtgagacagagtgttgctctgtcgccaggctggagtgcagtggcgtgatctcagctcactgcaacctccgcctcctgggttcaagtgattctcctgcctcagcttcccgagtagctgggactacaggcacgtgccaccatgcccagctaattcttttgcatttttagtagagacgaggtttcaccatgttggccaggatggtctcaatctcttgaccttgtgatccatccgctttggcctcccaaagtgctgggattacaggtgtgagccaccgtgcccagccaataatcctttttttagtagtcaacaactctcttatttgtcttgttattttaaataccagaaaccacattagattttaatttttcttctcagtatacatttggggagagggggagttaccaaaaagaatttcacatcactatgggattattcttgttgatagtttttaaatcaaattatgtactgataaactatccctactcttactctagccccctaaatatgccatttcctatatagtatttgatcagcatagtataccagcattttctgctatcaaagacgtcttttagccactgctctgtgcctttattcaaaaatagcaagttaaattatattcttaaaaaacatgaattaaaattctgttcagtattgtgacttttttctgtaagctggattcttttattaataataatttctgatattttctcagtaatatgtattaccaaacattctttaacttgtatttttaatggacattttaatacaataatttgtaaatgtttttaaaaatctgattctaagatgtcttttaaaaatggtgtgacatccaactgatatagagcatcctatttataatgtgggccaagcaccatgctgtaaaccagttactatcatgatgatcagattgaaaatgaaattgcatttctgtcaattactgagttggcaactgttcaatatatcttagcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggaggtgagttaaagaatcttctatcattctacagacaacccagaaatccacagtggaccttttgggactttttattcttacttcaaaatgttgcttcaaaaatataaagcttctaacctattgatatgttgcaaaacacctaaaggaagcatagtaaattagaagataactgttgctgctttccacatcaactttttggcttcatttaaaaatactcaagaagtactctcttagaatatgcttttgtaaaaaactcataccttggtttgtgataccccatgattcctcattaatagtattaggagtatgtaaaatgtaattgaatccctaacatctaaatcagcacaattagtgatgagctttgtcatgaaagattttcacttaaaacaagatctttagaaagtaactttaacaatattctggcattatagcctgagatgtgagaagtttatataagtcccatctcagtttcttcttagtctcctcactctgagagggtcttcttcaatatctgcagagattaatctaagcttgatgttgggacaagggctatatatatataaaattaaagaaaattttaattttaacttcagagatgctcaatttggacatctttggaacattttacatttttaagagaggtatattcacaaggcttgtgagcttcttatttcaaaggtatataacctacttatctactaaaacatgccagatacttgccctgagttaatcttagaatgcaaagatcactctgaagagtaggcaagtgaagactcgaataagaccttagagcagccatccccaacgtttttggcaccaggaactggttttatggaagacagtttttccacggaccaggagggtaaggagggatagtttcaggacaaaactgtttcacctcagatcatcaggcattagttagattctcataaggagcatgtaacctagatccctcacatgtgcagttcacaatagggttcgtgctcctgtgagaatctaatgccgctgctgatctgacaggaggccgaactcaggaggtaatgctcattcgccctgttaggccaggttcttaataggccacagactagtactggtccatggccctgggtttgaggacccctgcctaagagggccaaaacaaaggtaagctatttctaggtcaatgataagtttcctcaaagtaaactgaaacttattgctgttatttcttattgtttccttatattaaaagcttactgtagaaaattctaatgcttataacatctaatcttccatctcataaatttgaaagcttcttccccacacagctgtgtatctgtccctctggtcttctcagaatgtctgtatcttagttaaacccatcttgccaggtacagtgcctcacgcctgtaatcccaacactctgggaggccaaggtgggaggatcacttgaacccaggagttcgagatcagcctgggcaacatcacaggaccctattgctaccaaatatatatatatatatattttaattttttttcacgtgtcttttttttttttaaatcattgccttcaaccaactcacgcccactaaaaaaaaaattttttttaattaaccagacatggtggcacacacctgcagtcccacctactcaagaggctgaatcgggaggatcacttgagttcaggaagttgaggctgcagtgagcttgatcatgccactgtcctccagcctgggtgacagagtgagatgctgtctcaaaaaaaaaaaaaaaaaaaaagaattcttcatcttcccttttcgactcctatcatgcagctatcatgcaggatttttattgcaatttctacattctctactacagctttatagtaagatcagtaattatgcacagctacatttgtgtaatactatgacaatttgctgtcatttatcattaataattagatgcttcttttatcgtaaaaatcttccagatattctaagtaaatcttaataaatctttgcctccttatatctttgagtcatggaaaaacaccatattcttatgctccagataggcttcctgaagctattaatgccaccttcctgtggcatcataaagccatgtaggagaacaaataataataggatgaaggggcagttggtatctattttttgtttttcccagtagtgagcagataacaatgctaaatgacttgtaagtgctgggaaggctaaggattaaaaatcctattaatgatatgggatgtgtcagctatacagttggtcctatctttataatccaactacacttgaggctaagccaggactagactaggcaaggagactgtcagtgttacaacccaaagtgtggttgctgcctggtaatgagggacagtaaagatctgaatttgccatcattcaacagtcaaagtaaataaagtaaacaaaggacaagtgaggactggatctatagagttggcaaggaaatggagactagaacaaggaaagccaggtgaaatgaagaaggggcagggtttgacaaatgacttatgagaacctcctgaggagtcaggtttcttattcctgaaggagaccaaagtgaccagggtctattttccccataggacacagcatatcttggatgttggaagcagctacataccaaatggtagtctgtttgtgagaactaaggttgacctaagacaaatgacgcaggcctatttcctgtcctcggtggtgggtcttggcctgtcttcataaagggatacggaatagactaggtctcctctggcctcaaggtctaagccctagctattgagagtgagagttgtgtagagaactttaggacaaggaagaaggtaaaattcctcttgaaattcaatgattcatatacatttatttatcaaacagtaccagcgattgtgctttgccaggatttggcagacatcctggaaagggccagagcactgtaggttttgtaagccatgtgctgtctgtcccagctactcagttctgcccttggtagcctgaacttccctttgcagtcttgaacaatatatgaatgaatgagcctggttgttatttaccttcaaaagacagtaggctggatgttgcccctggcctgtagtttgctcacccttgcatagcaaattcaaaattcacttgagttcacaagagtctactttctaagtaaaaatgaccctgatgaggttgttaagtcaggggaaagaattaacaaattagtgtccactcttctagggtctagtaggaatcctcaggtctgaaaaaagttttgctaaggagtagtgtgaaaggaagagagagaaataacttgagaccagcctagatggagaactagggtaggaagattttcgaagcagtagtccagagtgataaaagagggtagtgaagagctgacataacaaggtggatgcacagcctggggaatgtattgaacatgatcatcactcatacccactgcctgaactcacctgcgaaagcctactttttctgttctcaagcagcaaccagcctcggtgagaaaaggaaacttactaaatttgaggtgaggtgtcttcagcttcatggtgtccacagaaaatacatacaaggtattttaggtcacctgtaactgtatattcaggcaatcaagagacctatatcctattgcaaccagaaatagcctaattcttgtgtaaataacagaatcacacctctcctagcagccatagcctagctttcacttaccctctgtttgacatacttgtggggcttatgagaaaaccaggtagtgtattacacatgtttttttcatttttgcatcattttgtaattgtagacatgcgatggcctcattttaaattcctcattctatgtaacaaacgatgtgggttgtatgaatctttcctgacaaggtacagatgttgataaagtttagtatttttggttttagttatgtagtattgtggtcagggaatagggcctaaatttctgctttgggaatttattaatgttttattttggccaaatacgtattaaatttttgttaatggtctatggatacatttgcaaggaaggtgactaccttgttttaagatgatattacatatcatgtcatatagcacatgtatatatattataaagtatattatatatgatacatattttgttattatttattccatagcttatcactttggtttagttagattagattagatttgcttaactttaaactgacatttttgcctctgtttattttttgagacagagtctcactctgttgcccaagctggagtgcaatggcgctatctcagctcactgcaacctccgtctcccgggttctagcagttctcctgcttcagcctcccgagtagctggaattacaggcacccggccaccatgcccagctaatttttgtatttttagtagatacggggtttcaccatgttggccaggctggtctggaattcctgacctcaggtgatccgtctgccttagcctcccaaaatgctgggattacaggcgtgagccactgcgcccggcctttgcctcctttttatgtagacaaagtagtatattttgttttgcattttggatgaatgaagaaatttttttaaattttgcccatgagaatgtctgcatgatccttattatttcagttatggaaaataaatttgttgagctgaaataatatcttaggtcttcaataatttttatttttagcttctattaataacataatatctgtattgtgtttcccatcttttgtttgatttctgtagaataacttcaaaaataatgaattttatggggacctttgttgagaattttaaaaatcataagtgagaaatttttttggaatttttaagtatgtttttaatgataacttcactttctgtttaaaaaatgcagatattctctctctctctcttttttaactgtcaccagatatcttggtttcattcaatttatctataaataaaaagtataagactggccttattgaccacacggttgggttatctattttacttatagtgctgtgcagtgtcaactggaatgcatttttacattcagtgcatatctaatctccttttaccttttcctgcacacacagtacatagcatacttgcaaaccagcttctgttgtataatggatctctagtttactttctgccttgttcacctactgggttttcagtgtttaaccataaagatatatttatacatttatgtagtatctttaaacacacacatgcacatgcacttcagttctgtaagaatacagttagagcatttcttacaggtgttaggaaatatgtaacattaactgttcagaagaattcgaagttgattgtaaaactgaagtcaatgaatcaaaagaaagtagaaacccattcttaagaagacctgagctgtatagatcactttttactcttgccatcccaaatagtaatccttttatctaaggttagcagtacctatatgaacattgagttaacccactcagcattactggggagtggtagtgtaaatggcacctgtttaacatcatacaggaacctagcactgtataagtgggtaaagaaagtaggtgccatttcctgggtatccctggaatctgaaagaacccatatacaaccacatttccagacttacctattttttttcatggcaatgccatcattctgtttactcgggctggagagttgattgtgatggtggcctcacccttactctcctcagtatcccttctcccacagcccaacatccagttgatttccaagttacatcatacctactcccaattctttcatcctaggttaggctctccatagtgcttgcctgggggttataacagtctccaacctgcatttattgactccagcctttgtgttctccagtccaacatttaggtcagcaattttgcatgacagatggtgtcacgtgcatagggctgtcttatgcacagtccctagaccacttttgctttcacataagaaggcatatgagattgtgagcaagagtgatattatagaaataataattgacgctgctctaacttataaaagacataagcttcagtacttatattactactaataagttatacctacttcacaactgatgacaataaggtacttccgttgaaaactgcttatggagattgctgttaaattaatcttctaaagcacagtactgatcatgttgaccaccagtatctctgcattcctaccaagtaaaagttaaacttcccattctgtccttcaagactctctgtaggctctctatagttttgcctttcaagtcttaccttctgttatttctctttaagtatgcttgagccaaataggactttacaccattctctgaacataacctacccattcctcctttcatgcctgtaaagccctcccctcaattgtacctcttgaaattctatacatttctcaagacctaatttaaaggttagcgtttccaagaaagaattcctggtgtcattggcaaagaataatctctttatcttttgaatttgctctgtaccttatttttatccagtaacccccaccatacatggtattatagtcccttgaatatgcctttaaggtagaataaatgtctcatacaacttggtatctcctcaacatctagcacagtgtttttcatattgtgtatacagtacacagtagaagtttctagaataaatgaaagaatattgaattctatactctccctctagattaattatattcagtaatcatcagtggaggcttattggcagcaaaaaagtactacattagatccctaaaaactattaatagaagctatctctgacatagaataatgctgaggaagtattctgaacactttttgacacacaggaaatatttgttagcttatttgctaaactacaaattttgaggatagtgaaattgaagatgcccacttctgtgaaatgagtcaaatagttgataagctgagcatagttgattagaaaagatctcacaggtgattgtgcttaaataatgaagccatgtataataccttagctagttctctgaaagcatttaacaatgtttttatctctatgcttttttgcccccctggtgtggggggtgcatttctcaatcttgtttcttttttcctttttttttttttttttgagactgagttttgctctttcacccaggctggagtgcagtggcgcgatctcggctcactgcaatctccaccttctggttttaagccattctcctgcctcagcctcgtagctgggactacaggcgcacaccaccacacccggctaatttttttattttcagtggtgatggggtttcaccatgttggccaggctggtcttgaactcctgaccttgtgatccacctgcctcagcctcccaaagtgctggtattacaggcgtgagccaccgcacccagtcaatcttttttctttattgttttcttcttccaaatggtttacatagtagatgggaagtcttcaataaatgtaaactattgttattaatattaatgctcatagtaagcatttacttaggaagccaaaaatcaagcctaaggatgtactttttcagaaagggacagatgttgagggattaagccaaactgtagaattatcaattggaaaaaaatcttcggaatacctcactactaataaaagttgcccaattgaaaaaaaatgagttgcagggtagtaggggtattcttcaaatcccagggctacagagctatttcttcaaaaggtacattgcctgtctgttggatagaaattaaagttaaacctctaatatgcaactaaaattgctgctgtgccttttcaaatgtatagaattcaaaattactgtaacaattttatcactaggatttggagaggaaaaaatatctactaaaaatccttaatgtcaaaaattgactccattaattaattatgacccaaaacattttactagggatataaaaaattatgtaagactttctcattcccgtatatttaattttggttgacaatttttcccagattttgctctaccaagatttattgtcttagttgtttttgaattttccattgtataaaggcattgtatatgctagtctcactcttaatctatccataatgtttttatgataatatttcattaatagcataaaagtatttaagccttcatgaaaatgacaaatatatatatgaggaatgtgtgcttatttatgcatttaaatcgaataatctgataaaagtgtaaaatttagaaatatttgatgactttgtcaccaaactaactttatttttgtgtgccattgttagagttacttatagattacactttaaaatacagggactcaatgagctcagtgattcagagacagcgtgtggcaaattgtcaaaacctttgcatctgctttgatgtgataattcatgtttgacataggaatgtaaaatataaatgttaatccaatagtgaaagagtgacttaaaactgatttcttaacttgcttatctgtgtcagacctgaatttgaataactatactaaaatactggtttttcttctttagtgttttggatgaatgatataaaatataaataatatactaacattattgctacatgttcctacagatgaaaatgataatattgagatagatactaacgaggagatccctgaaggctttgttgtaggaggtggagatgaacttactaacttagaaaatgaccttgatactcccggtaatttcaaattataaatgttttgtgtcctgctgcatggcaaactttatggttatatttttattatctcatcaataataataataattttgtagttttattacatcttatggcctcataaaccatttagcttagtccaccttccatcaattttatgttattttgttttaggttggatgttaaaattagcaataacattggaatagcaaattgtagtttgtgttctcttgttactaagattcactattgtattttatgttatgtgagataatctgtaggttttcaatagctggttcccttctcagcttaaatattttggtgtgatgtcagaaggtatatattccacatgtaaatccaaaccatgggatcagattttctgatttagtttagaattatagtcttagttataatattattttgcagattttctgcttaccttacttaaatattactctagtaaatgattttacatatacttaactgattacaataagacactttgaaaactatatagactgctgttaaattaaccttatgtcttatatcaataaattgctttggcaatggacctttgtaagttcttatttaaaatacaaagatatttgctggtggtttttaataggtgaatgttccaaatgcattgcctttataagccagcagcaagtagcaatccaaagttttgtatatctgaggggttccataaatgcttgttgagttgaattcttatggcaataaaaagtctttggtgatttctttagactcaaaggagggaggcaaagtctctaatatttatcttttcctgtaaaaagctaaagggagtgagagcaagcatactttttcctatccatggcatgcacctgcaatgctaatctgctccatttctttccctgttggaaatactattattacttcaataaacaggtgaccagggttttcctgactataacgaacactcaagaaaactcatgcccttttgtcagtagctccttcatggccgggtgttaaattatactattgctaaatagaagtcagtatacttataattgtgcaagtccaaaagaatgctgatatttaaggaaaacttttaaatgtttaacccaaaattagaactacattttacttctttctgtttaaaatactacagaacttggttaggtttgatttttttttaaaaaaacatttttgttgcttactcaccttcccaccataaccaccaccaaaggctttatcggaaaccaatcacatctttttaatgctgaggaggacatccataagtactggatttaattttttaatactcaatttatggaagtataaaagcataaaatcagtaacaatatgtgatgcatatgtcctgattctacagtaggttagtaacacaggaaaaaatagccatttcttaggtaaaataaggggagaattttctagtttcagctgtagcaactttgggggatactttaaagatgggttaattttaatcctaacaggcttgactcttgtcatttttaaaaactctcctcctacttaatgttttccaaaacgaacacacatctcagccttcctgtttggagttaactaataaattgtttacggctctcaagcatgccagttaagtgttggcatggaagtagacaggcctcccagttcagatttatggtttattttgtggcaataagaaataggaatgcaaactagaatctggaagcccttagaatatattatgatttttatccttgctttattttccccccaaatttttttcatatgtatataagtcataaggttttaataataaattgtttaatctttatcttgatttgaccatagttcatcagatattgtttaaaagagaagccttgcaatataaactgaccaatttgcatgaaagtaatgacaatagcatttattaagagtcttataattagaaaagttattaatctttatgaaaaatatcatccagcaaatggtggacatatctattgcgaccattttattgaggagttgccttttattaatttaagaattagttgtgtttctactcattttgaactattgtattatgaaagattaatgtacattaatacattccaaaaatgtaataatctgtattgtatttctgctatctaagtagagggtatttgtaaacatataccctgtttcaatgctggttatataggtacatatataaacactggattctaatagtatgtacatgatgatgatctgagataatgttaagaatttgttttaatatggcattatatttataaatctgatatactaaaagaaaactacaaaataatattcaaaatgaaatgtatctcttcttttaaatatctagtttgttataacagcttgttttattatgtataacatacagtgcttatataaatgtatacatcacatacaggcataggtttttaggtaagcattagctactatttaactatagtataactaagttctctttagatatgttgactgtattctttaaggggaatgattttggtgggggaatatatatatgtaaaggatttttcatgtgtctaatctactaatatccttttcttctttcttttaaaatatagtaatacttttctgagctcacataaaattgacagcctacatatctaaatgcatctcactcagttattcatggtatttgcatatttaacagaacaaaacagtaagttggtggacttgaagctgaagaagctcctagaagttcagccacaggtggcaaattcaccctccagtgctgcccagaaagctgtaactgagagctcagagcaggacatgaaagtaagtcttacttgtttaaaacatttggcttagtatctgtgtcttctagtttctgccaggagtttgtaattccaaaaacaattttttacctaatttttcaccaatattaagattagggtataagaaatttttactggtgaggtgtggtggctcatgcctgcaagtccagcactttgggaggccaaggcaggagaatcagtagttcaagaccagcctgggcaacatattgagactttgctactaaaagtaaaacaattagccaggcatggtggtgcatgactgtagtcccagctactcaggaggctgaggcgggaggattgcctgagcccaggagttcaaggctgcagtgagtggtgatcatgtcactgcactccagcagcggagacagggtgagaccttgtctaaaaaaaaaaaaaaaaaattaattaattaaaaaaattgtattaaatagccaataagtaaatatcaatatggtaatcagtattcatatactatttttcagggaaactactactttaaactgctatttcaagtaaaaatagaggcaatatggaaactattcttgagttctatatgtatgtatattttgctaagacaaatactgttaagagaattctagcgcatttttcaataatcctcaagcttctgcctatatagatgaactaaatgtatgttatttgtaagaatcatcacacctgaaaatggtaatgtgattgaatataaatgtttaagataacttgcatgtgttttgtgccattatgcatcttaccttgtgtaacattttagtcaaaaatgccacattataagactattattagactgtttatattattcccacccacatgtttccctgctttcctcacagtgattagtatttctgtagctttagggcacttccagtcctgtataacttttcacccacctgcggactatggggactgccctgctgactgaaaggatttccttcccctgacacagagatgctttgaagtcccaaaacaatgactttcattgcttttcccctatattgtcagtttctataaattggtgatgaaagtgtgtggcagcaccagaggacttttggtctctatctttgaacaaaaggaagcctggatcgggtctgattttttgcgttcaatttagctttctgcagtggatttaatgcagaatgaagctggcctaagaataatacaatagattgaaaaggctaactgaattagtgggtttagaggaatacatttgtaaagtggcagaagtccctagtcataaaaaggtttcttaagatgggatttgctggctaatcgcactgatattttagcatgttgccaggcctaaaaaaatttagctgtgtttgtttattttggtaaagacttgagtattagactattggatagttatataacagtagaactctatttttctttaaaaaaatagaataaaagccaaaactgttgctatcataactatatggctaggatattataagcatgatattaatgataaattcattagataactttaaaaaaataaaatagtgttattttcattattatggtttatctgtatagataaaattggttttgctttccaaaacactcttatatagtagtctttaaagttattccaacaaaaggtgtgctttaaacagcttgcctttgtatgattccttttagttaagattttgaaaatggtgtttataaagaacatatagagtccatctgttctcttgaagctttcagcgttgacttgggttttaattttttttaataaaatgcagtttacacatttataaatgaggcattctgtgtttgtggaaaagaataaactgttaccttcccctgaggattctgtatcccaggcctccttgaggctagagaataggccattggagggctccctcattactgattgtctcaatgcagaggaagggcaaagtcttggtagcttttgataaccagtttcagcattcagcaggcttagctattagtcatgcatcttagcctttccctatttactttcaaaacacttaataaaaataataaaagattaggtataaaatgaaatatttgtttggtacacagcacctcggtatctgcagcttccacacactgcagtggttcagtcttctgggatatttcttgttgatagaaccatttgaatttgttaccagtattaacataggaagctccggaaaagataattgtagtttccttagctgtaaagggcttacttacaaatctggctttggaaagttatagctgatgaaatgcagttcagtagggtagtattataatcctaccttttagccttcatccagcattagtggtttatctcaatgggcataaaattagaaactagttcttgttgtcatacaagtctgtggggctgtacaaactgatgacacagaatagtgggggaaataggaggcaacatggcttttaaatgatatgtatcactggtggaagacacattcgtatcaaagttatcaagagttaaaccatgtgtcccaaagtttgtgattacaggcaacagaacttgcagttgagctctttaaagtgctttaaaatccttttcttgcaaaaagtttctaaatcagtgttatcttaaatcagtaaaaattgccttactaatgtgtaattttatgtttatgagatcaggactctcttaccatgtgttgttttacgtttagagtggcacagaagatctccggactgaacgattacaaaaaacaacagaacgttttagaaatcctgttgtgttcagcaaagattctacagtcagaaaaactcaacttcagtctttcagccaatatattgagaatagaccaggtagaacactttttaaaatgtttttccatgttatggtttaactatatatagatatctatatatagtatatatatatagtatatatatatagcatatatatatagtatatatgtatataatctggtaatgtaaattcacatttcaatacacaaatatcaagctttacaataattttacatgtctttcctcttttttttttaagagatgaaaaggcagagatcaatacaggaagatacaaagaaaggaaatgaggagaaggcagcgataactgaaactcagaggaagccatcagaagatgaagtgcttaatgtatattaattttttgtgtggtttcatgattgctgataattccaaactgtatgtggaaatagtgcctttatttgttaaaatgagatgttaggttttttaagatgtcaatctccagtgcattcaaagcagagtgagaggggtgcactgttgaattagtctgcagtgtggtgataattgtcagataaaaaaaaatgaatttttcagagttccacagccccagtttccttgagacatttccatcagggcacttcccataaagagattccagtattgatctactgggaggattttaattattacaatagcagataccgcagagctgcagttagagggaaaagtcacatgagacctgctagaatttctcagccaacccattttgttggcttgggttaatgggtgttcaacctttccattatccagatcagccgtgaattactagctgaatgatgtttgcattaatataatatatatggtaatttcttcacttaattaacagggaggttcagctcagtaggggtatgggctgatcatgtgtaaaattgatttgtgagggaaatatttgatagaccgcagggagaaagctgcttttgatggacagctgcgggacagaagcaggaagaacaagttttaacttgaatttttgtctggaagcatagctctctttaatagtactactttttaaattatctacagtttttctaggtattttctcttgttttcagtgttaaaatagttggattttaaaatccttatacaagtacactcagagtcaccaactacattttaggactctaaaatcttctcattttaagttgtttactttagaagacctggaaagggatgagctagaaaagaacagctcactaataatcctgatgaagtatttggtataacttttaagttacagaatacttaactatactatgtactcacactacagaaatctgattatgaaatttctttctatttttaactgaaccaatcagtaagagcaatgaagtttgtgtgttgcttatcacttctgcttccttatgtatttgttttttgtattatctttgcaaactactatatttgttttgtctgtctgtatgggaatgagaaaataaaatatcccttttgaaaatgatctgctatctggcagataggttcaagaagcattcaccagattatcccagattttaaagttaccattagcatttattctattattttatttttttctgttatattttgtattgagatggaagaatatccattttgcataaattttttaaaaatacagtgacttttaaaatcaaactatcctgagaaatttagttttatgatttcttaaaatattttaactttaaatttgtcaactgccataatcaatttaataataagttggtataaattgaggtcacatatgagtacaaattacttaccagttcaaaaggtatgtaagttacacatatagttagacatatttattaatcatgagaattctaaaatatgctcataattaacataattctttattttatttcctgtttaaggagtagtgaaatataattctttatagcttctaagagattcacatgctaggaagggaagggattttacagaagaagtttgttcacatttatttctctgaataaataatgttataagtgcttatgataggagtggtggtggtaagaataatcacttaatcagttcttcaatatttcttagctaattagatctcttagccccaaaaatgtcaaaaggtaaacaggtaatccaaagggagccataattaatcagtttttatgactataccataaataaccctgactttgatgatttaaatttgtaatatgattgtaaaaattaaaggtaaactggcacacatatataaaaaatatatttttttaaacatggatggttcaaaaagtaaattttcaaattaaaatccaaacttggctaaatggaagattaaccaaatcaatatatgagttttcttagatcctatgtagcaaggtttgaaaccacctgtcaggttagtatttacaactgtaataattactaatacatcaacagaatggcatattaaagtacaggagccagctggagggaaaattggagatattgtgaacttccctttttatcatttttaaagtattttaaataatgtaatcattttgaaaaaaaatgtatctctttaattttgtatttccatagaacaaatttatctgactctctcaggttggatactttcatggtcaattccttactagaactccatttttgtgtattacacttttgagttaaaagtgccattggtgtttgttttgataatcacaaaggggaaaattatcttctttgtccatgcttaaataactctgacttaactctaaggagaattttttttttaacttagcattaacttttaaaatctggcaaatctgcctgtgaaattctaaacataatagtaaacagctgaagatctctctatttataaaagtttggtatatgtaatacatatgaaaattttttgaatcacagagagttgctttttggtactaagggtgatactaacggtgtatttggttctctaggtaagtgctttactaagtgtttgtagaaaggaaaaatgcaacttacaagtgatttttttttccttcctgtttgttcttgttaacagaaagggttcaaagacaccagtcagtatgtagtaggagaattggcagcactagagaatgagcaaaagcaaattgacacccgtgccgcgctggtggagaagcgccttcgctatctcatggacacaggtacggtgcccaattacactgtaaacagttttggcaaattgagcgttcacaaactcttatagagttttggaagtgtgaatctttgaagcctgaatgttcagcaaaactgccttgaaaataaaaaggctgcgatttgcagccacctctctgggccctggtgataagagtgccttcatgggaagtgataactcgccctgataccgtgtgagccagcactattgaacagtgtgctcatccatgcagagttggaatacacatctgtgcctcattgatatgccactgcttaaaaaaaaagtaagatctttactgttctactgattcattggggaaaaaaaagatttggccagctaaagccatgtactgcatgaaacagagcactgtgcataggggacggctccatggactagatcactgaaatttgagaatactatctggttactgatgctccacaatttttttttcaagagaacaggtttttaaaagtctgtaatactttgtgtcacagttgcatttgaaaggattacagtatatagcaaggtttgtaaagataggttagagcaccaagttagctcctaaccagagggcagattggctttcaatgctgattgccaatggtgattgaatagatctaagagcacaataagcaattggaaaggaactcatgtgtgtgtgtgtgtgtgtgtgtgtgtgtgtgtgtgtgtgtgtgtgtgtaaaatgctgcccctacaaagagattaaaatgtgaaataaattaaatcattcataccaaattataagttatattaagaaaaaaagtcaaaaaatacaagtggaaaatttattcctgtaatctaattaattgctttaattttatggcagtgttaaaatacagtagattagcatgatttaggattggaaagctttcctgaactttttcttctctattttccaaaaatatatttaaaataaaagaacttctccaaaaataagcatttatatgggacatttgaaaatgcatagattagtgaaatcagagcatattagaacaggaaggaaccttaggctttatctgggacagtgggtttcatactgtgttctctgaagtcctaaatcatcttcagaggcacctcaggggcttgccaggagaataagggagcagaaagtagacaggcatctggattccttaccttacttcaaatagagtggctctgagtttatttatctgaaatagtgggcttttggggacagtttatttgaaaaaaaggttctactgcttaaaatttaaaaccaaaaatactttttaaaaaaaactattacttaatcttctcattatataggtgaggagacaggcataggaaatgtttaagaaggtcaaacagatcaccacatggtagaccttagattggaattcaggctaccagagccctatcatacgggacccttcttgctacaccagaatatgtagaccatgtatatcattcccctaataagttgcatgcatgctcagtcttatacctatatacttgtgtggattcagcatgattccataaaccaatgtattgttttatatttgcattttttcttgggtttcttagggattttgaaaatattagctatgttagctatattaaacatataattactagactgaataatatttgtaatatatttttaactatttcctgtaaatattttaaggagacagatttcctttttttccaaacaaatggaacttaaccaccttccctgattgtgttggataaattcaatgttactatacaagaagacttgtgccactagtgaaaaagctataaatcctgtttcctctccctctttagcacttggagcctgatttgttgagggttctaactgaaatagactcaatttctccttcctacccaacatatcactagtcaagctttgaaatggccccattccaaccatagatgctttataatctgaaagacagtcatagaatacaggttgaatctagaatccttttgagcttattatatttcttacttcacaggacagaatctgatcctaactggatctgctactgcagatttagaccaaaactgagttggtctcccaagttcataagctccaagaatcatcctagactgttttaaacctcctccaacacaaataatgttttaagatttgcctaaaacctagtatctgaagtaagagataagatgttagaaagtgaaagggtacattcatccttttctcttttgggttccagtttattccaactttttatttattataatacctttttttggtatgttagacatttcagtgtactttctgattctcagcctagaattaagcagagcagatagtacccatgttttttatatgatgagactgaggctcagacaggggaaatgactcacttaagatgatctcattaggaatggtggagttacggcttgaacccaggttttcaggttttctagctcttgactcagtcctctttccccactacatcttctttacagaacaaatatactttatctgctatttcagtttttatatacttgtagatactgactatattcaggttttttttgctgatttgaaattcacataatataaaattaaccatttgaaaatgcataattctgtagcgtttggtacattcacagtgttgtatagtcatcaccattgtgtattttcagaagtttttcatcaccctaaacatgaattctgtactcactaagcaataactttctatttccttctcccccaatcccctgggaatctttaatctactttttctatgaatttgctttattgcagttatttcctgtaagtggaatcaaacgatatttgtccttttgtgtttggcttctttcacttaacatatcttcaaggttcatccatgttgtagcatgtaccagtacttcattcttttttatggttgaataatattctattgtatgtttataccacatttgtttattcattcatctgttgatggatatttgggttgtttccacttttagctactatgaacatttgtgtacaagtatctgtctgaatctctgttttcatttcttttgggtatataccgaggattggaatttctgaatcatatggtaatattgtactcaattttaaatgagttgtgaggttaaggtagaattcagaaaacattttccaaaagaaacactgttgtaagtgtctacaagccagacaaacccacaaaaacctgttaattccaaatataactaaataatactaatagttattttagacctgagtcctaggctcccagagcttgagcaacattggattttaagcaccacccctgtgatgctgaagctacttacatcctggggggaggcaggatgggtggggcctggatggtggcccagattgctgggcatttctcctggcatgttggcagaaggccttagcaagaaagtaggaaaggaatgtaaaaggctcatacaacaagatggggaggtgccagggataagaatggcaggagctgggaaagggcaccaacgacacagatagaacaactatgggatttatatgtctggttccttctaaaattgttcagtaatcctaaatcagtgatagtttgaatactgagcagccatgctgtgtatgtgagtgtgtgtgtttttttttttcttttaaactatatttcaggccgggtgtagtggctcacgcctgtaatcccagcactttgggaggccgagacaggtggatcacctgaggtctggagttcgagaccagcctggctaacatggtgaaaccccatttctactaaaaatacaaaaaattagcaggatgtggtggtggatgcctgtaatcccagctactcgggaagctgaggcaggataatctcttgaacctgggtagcggaggttgtagtgagagccaagatcacaccattgcactctggcctgggcaacaagagcaaaactctgtctcaaaacaacaacaacaacaaaaactatatttcaaggcatagtattttctgccattttaccttggggtctataaaatccctatgcaaatacaagtgaatttttttctcctcagctcttaatggtgtgtgtgtgtgtgtacgtctgtgtataactgtttttgaggaggaatattttagtttctagtactttaactttgtaatgatttcttatttgggaagagcaaaacttattagttagaaatatcatgtattccaagctgacacttcttatgtaagtttagtgctaatggatctgtgccagcaatgttgtaacccatgaaaaatggagtttataatggaaatgctgatgggcccttttactatagtgctacagatagtgttgctataatgaatggtgtttcttttccattcccaatctgttttcttttaatggttatcaaactttttaactgcagtgttttaatttaatctaatgatttgagttttttaaaagttacagtgttttatttacattttgagagtaaaagttaaaacattcctgagcggagaataacaataaaattgcatcttgcaagtttataacctttaagcactgagtaaaaggatcatgagccttctcaaaaatactgatactgtagcttttcgtagagtatctgttccaaaaacctaactggccatttaaaaatatgaaatatacttagagaagaaaataaattaaaagaacttttttctatacattcttcagaatgtttctttacctcctcctttgaggaatcaaatgtagtattaaagctgctttaaagcagggaatagggcccacaaaaaataaaaatcaagatgacagtaatggccaatattttttgcatgcttattagatatttggctctgtggaaagtgctttacacatattttgttgtttctaacaaaggccctatgagatagggtctagtaataattgggactattaataaacacctttttcagatgaggaaactgaggcctagagacagaagtaacttagttgcccaattcatacagtttacaagtgggagagcaggagttagacccagtctgatggctctggagcctgactcccagataccacctgacatgatccctgcttcatctctcatcttcttagaggtgaacttctgattttcctggggttctactagtaattctctggacactgtcattaccattttatgatttataattagtaagtcagaagaaacagatcaatattcacttatgcaaaaagatacctagccaacctatttggctcatttgagacccaacaagctcatgtgcctcttaacagtatttctttaccctggtcatcacaatgtaatatgcatgaaaatcagactgtaaaacatccccatttgggataataaaaaggatacaaacaaggttcccttcaaaagaagcatctcactctttactaatctttagaaggttctcaaatttgaacattataaccttcagagggtagttttcagtctgggactagctacttaggaatacccgaaaatgtttttttgagttatgttaaaaataaaactagttaatatttcagtgactgacttctaaattaaggtagttatttttatattagcagcttacaatttatgacagtagatatatatgtacacttcctatgttaaagccctttagttttacttttaaaagggaaaatgtgatcttgatctttttcaatacaaaaatgtaatctcagctatttaaaaaagtatagtttctcagtgtattagaagaacttatagaaaattagtacctcggtggcatgaatgctggttcagtcaatgtcacttctcttcattaaaatctaaatactcaaaatttttccatttctggagggtttacttatggttgttacttatattcctgaaatgctatatatgatcataaaagatttgctctgtgaatgagtaagagaaaagggatgtgcagaagatataaaaaaagaaaaagcatttgtatgatcaaagtacagagtagtctaattttactctcagtgatttattttctctccatgatgaccaacattaactgatcacagatacagacttatcttgttattataacaatgtaacttctattgctgagctagttcattccatgaataaagtagatggatttttatgatccaactcatagatactgagttagtacaaaattcaaaatgaaaccaagacattaaaaatgtagggatcatgtaactattttatactatgtgtatctttctctgatttacttttatctcattttctcatttcttatcctacaagttgcattctgaactttattataattacgaatttggtccatatgattttttaaaaatgtttttaatgattatacctagacttataagtttggtaagatataaattctgttagtgaatagtcactagtcaccatttcagaccatgtaggtattatcagataatgaacatgtttatggtgctatataagtattaattaaataacaaaaactctattgaccaccaatggtaaacgtaattgaattagcagagcagtaaaataaatgtagacaaaataaatatagacaagcgcatatgagaaagcttgtgtaatgttttagattaataggcatgcagaattcttcacattttttattacgtagtccctagatgaattcaaagtaattggggtggttaattttatttacacagagccgttcacagcgcattaaataatagagataattgaacaagaattgtcaagtgtgtactgatatcagacatattacagaagggaatgtgcataaaacttcatttctatgcagccattgtttatggtaattaagtacacagatttatcccttggttgccttccaagcttatggcaactgctattgttgtgctccattaatatgtaatcaggaaatagtttaattttctaatctgcagtttgagaattcactttctaacaactcttaattactgcattgccctgatgatgctcatggttatgaaaattgaaccaataaactcagcggaagaagccagaggggattataattccagaggtggtgcttacttaataaacttgttatgccttcaccagagggagctcagtgtccttcaaaagcatttaattttatagtttagaatttacatttccactatgtaaggagttaaaatatttaggagagatagtattctaaaatctgtttatgaaaagtgagacaataccatcttgatgctgttaaagcattgtagtcttttagaaattatttagggacatgtatctgttgttttaaactgactctttaaaattttctataaagtattattttgctaatccatcttaattcataaaattatatctgggagctatatctgtgacatatttgataagcttttttgttttgacttccacttttctgtacataacttctttttttcctcttcttttttccttctgtacaaatttaaagactggcatgccatccaattattaaatggtggatacatggattttctttggtaacagttcagttcacaatttaagcaaaaggccaatcacaaagcaaaatggctcataaaaattttgttagtcttatcttctgggatgaaagatcttatggaagtgtaagttcttttaactacatcttaagaaaatgacatgtcatatatcatcctgataagatagggcatatgggaaggtcctcttctctatcatgatccttttttcccccacaatatggtctaataccaaatgacagtgattggtaacaacacacctatcaagtatatgaaaataatttatatttattaacaagaaaaaagtaaatactttgggaacattctccaatgtagactggctttcattcaatgaaggtagataataacttcaataaaataagagaacaaatggtttttaatagcttgagtcattttcaacctaatgaaatttatgtcacagtattcattaaatttgtaattttagcatacagctccaattacttttcttatattttccaatttcttgacatttattgtaattttgtggtgctagaattagtaatggatccccttaatattatttctgaaattacatgtacaccaaaatattgttctcaaacttcaatatgcatcagaattacctggtgagtttgtaaattctctgttcccacccccttacccacattctgattcaggacatgggaagtgggatctaagaatctgcatttttacaacaattttattttattctgaagcaggtggtccacagagttcccctttgagaacagtgctttaaaaactttacctacactaataatgagttggcacagaaaatgatccaatttctgaatatacttaaatacttcatccattattcttccattgttcctgatatgaatctccttccagatggagagttatctatttaatctcttggtaatccagagtcatcatgtatttttctcgtagaaggccatgggtagtattaataattatgcagggaatttgctactttgaaggaaatctgaattcgttttgcccatgctataaatgtagctgttctttattatcttcagtgaagtctgcagttgtggagaaaagatgcctgatggctatattaccaagaagccagatccccagatatatgacttactgcaggagagaatgtggctagcgtggatagcaacagcaccggctggcttactgaagtgttaccttcctgcctgggaagctgttctagagttctctcagggtcagaatgccaaataaatcgagttccacttgtgcctttggataatattatttctccacaatttttgaatagtgaatagtatgcttcctgtaagcttaaagaataagaacatatgcatatcactcataattatccataatttattttgaaactaaattaacaaagcctattttcagtaatgttttctttttcgattaccaagccactctacattagatgtgtggccaatattgtagttctttgctatttgactttattaaaagttatctataattggtattaataataaggctactcacaaatgtggcttaccacattattatatttattcagtattttaaaaacaatcactatgtattaatttctctaaaccatatagcaaaccatctatggtccctgctttagaggaggtaaaatatcattctaacatgcctaaaatacttggtaacatatagtaattattcataattatttgaggttttttcatgtttattttatataattgagtataggagctgagtaggggtataagagaatacatttgacttgttctggaattatttaaaactgccttaaggaagctttcctagatcatcccaccagccagaattatcctctccttctcttataacacttttgcgtatctttccagtagcttataaaactttggactagggaggctaagatggtatcttacattcatcttttggctccctcaaggagtcaacagtgctttgcacataaatgtcagtcagtgaaacatttgtccttttgtggtaagttgattttttttttaaatcccatcatcccattctatgccactcattgacatctaggaataaatggaataaaaaggaataaattaaacaaaagaactacaccaaatgttctctcagtttgtcagataaagaatctagttgatggcagctacactgagttaacaggtagtttcttagagttttatttttctgttcttgcctgttttttccacttctacttcattcatacaactattagatagaaaaaaacctttaaccaatgaaaacagtactgacaggctttctctgcattcatatgctattttggtaccctgttgcttaaacgtgatatattttttattccaaagaaagtacagacactgtaagttaaatacattttaagtaaaagttaaattttccattttcattcagagtggagattttcttaaaagataagtgttatttataatgttaaaagatgactctgtaaaaatgctaaagatcataatagaatacgtgccatttttcctgaaaaattttatttaataagacttttgaaagagttcagtacatttgttagtttagaattaataaatattggaaattatatatatatatatgtcaggatctcctgcatacttaatttctgtatatttaaatattatgtctgttcataagtcaaactactcatcatcatcctagtttgactaaagatttaagctgaagtacgtgagtagcatagaatacatttattgcacagaaacacaaacagctagccaggctgtaagtatattatcaggcaagttctttcagaaacgtattgctaaagaagcttaacattaattattgtaactttgggaagattacatccacactagccttgtaagaagcagcatacacttcttgacctccaatgctagagctttaagacacaagaatggcattttaccaactttaatgggataaccagtataatctttcagcagtaagggaagaaaaagtgtttagagtataatacccttctgattctaatagaggctgcctgttatgtgtattgcaatcataattcatttgtttattttgttttagttttagttgtaactatttaagggaaacagaacttttataaaaatttagcaggttgcttgttgactttttcattctttctgtttgcatgccagcttctttttgtggcatgcatagatagatacacagcaaatatatatgtaggtatgtgtgtgtataaaatatttgccacagttttgagatctctgaagtataatctgtacaaagacatggtatgaatttgggcatgcctgttcacctactttccctttaaatgcagtttcttatttcctagttataatcctacagtgccatgtacagtataaataccagctgaaacacctcccctgtcctccgtgtatatcgcattgtgcctaagaataccaaatatattaattcactcaaataaatagaaagtgtatattatggttcctctacccacacataagttaaaagcgtattgatgatattcttgaaaattattttttctaaattaaagaaattcagcagggtttttagtacatctctattgacttagttcagtgcatgagattggtggattatgattaattttaatagctacattaaaaaatacatctaacattcttaattagaataatctccaaagccagttaaatgttttagaagacaaacagtttaattagctaacctcagaggttcccctcccccatatgtgcagtggtcttaggcttggtgtgagcctttcaagcattcttaaacaattggatgaaaagggattttaggcagattagactaggggatcctttatttgttgttcctaatcatgagatatgccacatctacaaagttttacaaagaaatgaaaatttaaataaattttactttgactatctagttagcatgaattacaagctaaaacatccagtgataagactacttaataaatgtattcttttaattgtagataggagcaaaagtacatgctggggtggactagcaagtgatatggcagattaacattctaaaagggtcaatgctttttcccagaaagcatgcttttgttgtacactcctgtggtgccactaaatttttggaaattaattcagaaagttgaaatagaattgtcagatttcagtcttgtttttttcatttttttaatttctttcttgttcttgtctgctttatgccctctctaatgaaaaaaatgaaaagtttagtgtatctgttttttatttttctattacaaaacgctgaggaacttaggaatttgcaacttttagtgatatataaatcactgctttttttttaatttgtaaggagcaaaagatatctttttgtacctagaggtttttttttctttttttttttcttatttggctttctgccttttagttttccgtttgcctaaaaataataaatgttatttgtagttttaaattttttaaattataactggattgcaagattattaaagtaataaaccagaaataaaaatatataaggttagattggaaagattgatttcaccaattgcatatgcagataatattctatatttacattatattaaattctgtgatctaagtgttgaatgaataagcccattaaaactaaaaaattaatttcttgtatgcaaattttgtataaatatgttgtaaggtggcatttgaagttcagatagcttaattgagtttgaagggggaaaggtcatttaattggcctattgaaatgttaacagaaacagatataccgtggaatggactttaatggcagcagtgttgcactaatgtctgtattcacttgcaaaattgttaattagtgcactttggtagttcatttgtttttgtattgatgtgattagtccaatggggaaatcaattttataggagaaattgcatgacttgctagcaccctaaaatgcatgtttatttttgattcccaagagaatactttacactgtaaaactcaagtacatttccagttggagacctctgcttctcttctggatagtggaatgtctgatcatttttctgttttactcttttgataaagttcagatgtcctgtatgaacatttgaatgtctgaatctatatgaaacttttcttagctgaacatttctagaaactaatgtcatgtttccaggataaacatgctgagaagaaaaaggaaggaatggggtatgggtgggattgctgatttcaccctctttaggttaaggtgtaaataacattctgggtgaggtatttttctcaccataagtgctcattgctttaactagggaaaactgctaagaaacagtattccaaataattttaagatatccttataagccttatgtgattcatttactgtagatggagtaattggagtatatggagtaaagtccatagtaaagatggactttattatgaagttctattactgttagtcttatgcaatctatgtatacatagtacaatttgtactgctgtacagtagtccctccttatcctcaggggatccccagtggatgcctgaaacctcagactgtactgtggattctatacatacaatgtatatatactatgttttttcctatacatacatacctatgataaagtttaatttataaattaggcacagtaagagattaatagcaataactaataatcaaatagaacaattataacaatatactgtaataaaagtcatgtaaatgtaatctctcccctctatgttcccctccccccaaaattttgtactatactcacctatttttggacctcagtaagtgataaggggggactactgtattcaatttttaaagccacttggagcaaggaaggctaagagtcaacttttgaatacaaattcctaatattagcttctaatattatggtactttgttttgtatataatactaccacgtaactataaatgtttgcaaatatgacaagtcttagagatcatctagtatagaccttttagtttactgataaaaacactgaatccagaattagaggttggctcaaagctataattagagcaggtattttctgactcacattccagcctcattcccttctcttaatccatactcttacatagtttgtttaaaaagaaataaagaaagaaaaatcaatacctaaatgtctcaaggagaaaccatctagatttttaaaacctattaaaaaaattatactggattattttccatagtgtgttcacagctaaatgaatccctaatttgagtctcctaagtaaactaaaaaaatcgtagtctaccttactcatgtggagtaaaccttttgtaatttagactctaaatgttatagaatgtaaatatgtgtaataaaacaattgtaaaacatttatttaggaaaatataacacattttaatgtagcaatttgacactgactttgtgaaaatagagtaagtttcctaggttccagtggttttagggtttttaaaaatagatgtccatatattgttaaaatattgttagaaataattacattagtcttgtaccatgaacattatacgttcattccaatatgtcttaaaatccttagtaggattattaacctatgtcttgattcttttcacttatttcttcaaactacttaagtacacaaccccaatttagctttctaaggtaaccaaattctagaacatttctttgtaccagtatgcaaatgtatttacataggaataaatctaggtttccttaaagagggcaacagaattgaaaactgaggccaacaaataaatgaaagtttctctaaatccattggataatagaggcagtgttaaggctaaccatagtgttgaactaaacagagggattactcctgggttttgcatcagttgttttctgccgggtggcctcacttgtcaaaaaaaaaaaaaaaaaaaaaagtttaacaggcaaacattcacatgggcacgttgagaaaagaagtttgcttaattccatcaaagcttaaaaaaatcaatcattaatttattctaactacaattgttggtcatttgtgaaaaacatctggcctttaagtcataggaacctaaacaccagtataatgtgaacacttgtgaagaagcttcaagtttggtttagcataaaaaagcaatgttagtgtgtgtgtagctttatctaaccatacaacagaatttgtttacttataatactttaactccacttagtttttttggactttgacagtattataaatccaagtgtaatgtgctttaaagattagaaaattgttaatttgcagctttaagaagttcagcctttttacatctttttgtggttgtttaacagaataacattacagcaatcttggtattacaagtcaaaaatggtttctaatgtagtctaaattcaagatagaaaatatattttaaacatggtttcaggagggacattccctattttgcatatgtctaagtaattcttaaaatatttgttttaaagctggacttaaacattcctgactgctctctaatttgatatagctagtcaaaatgattttattcaagaaattttggcaggagaattcagtgaaggagataaataattttgcagctatactcatattgcaaagtatagaactaattcagtcattatgactgtagtaacatctgttctttagctttaaagtgagcagtagaacaactcaatgttgggatacatttaaatattaagctttgttagtcaagtttcaagttctaacaaaatataagtagccacatcatagccacaaaataatacatagtaggtctgtagttttgttgttaccgttgttgtttttttaatgaacttttaaacatagaaaaggctaaccaaagctgtagggggtgaaaattagaacctaaattagaaataaaagttgcatcattttaatttcatgctctaatataatatgaacagttaatattgtaaaacctgccttgatgatgacatactagtctagtggtttcctgtcatacaaaggaaataaaacatgatataaccaaatgctactgtgtcatatagaaatgatccaatctcttactgttaaactaccttcaccagattattcatatactatatctcactcactgctctttagcttcccctaggcttttaataattataaattaagaaagactgtagatacttgtcataaattaggtttgattctaagcaaaatatataatagctaataataaaaaagcactttttctgcagtgataaaaaatactaatcttcagtttagacttttttttcatttatgccacaaatatgttattgtaacaaaagctaaccatgtttctaaaatgtacactaagtaaatctcaaaatgtgtgtgccatatgtagaagtctcgtaaaattttggccctcatttcagaggcactaatgtccaaagtactgttaggatactggagatgagaggaaaataacttaaaacagcttgtgaaatataatgtttgaaatggttctttgagaatgtgcagattatggcttgcatagggactccttccagctctctgggaaaatgagctgttgacattcttttgggtcatcattcaagatacaagggcaaccacaaggatttagcagataaattcatccccaaagacctttatccatttcactgcaacttggaaacattcatgttgaatagtagcattaatgtagcctacttagctcttcaaagtgagtcttatgtttaaaaaaagaagaggaaaaaagaaaagaaaatgaagaagatgatgaagaaaatcaaacgagtagggtaataacttatttaagtcttctaagaggtatttatttacatgattctaaagcacagaccatttctgttctctacacagtttcaaaaatagaatcgggtcttacatagtgagcaataagcctttaaattgtaactaagtgaatcagtcctgtgttacttgttagttgtttataacaaagagcagaaagtaaattaatgttttaatgttatattctgaaatgactggcagcatttataaacaattgaaaataatctactttaggttctgactctctttggactttatgattcaggcaaaaggaaaagtcagagctgtgatgaacatattaaaggtatgcattaagattcacacacagtcctttcctataaagagtgaaaaaaactttttgactcaaactggaatgatactatgtagggctgaatgtgcaggaaagtttcccacaatgcattgtgcaaacctagggctaacaaataccctgctgcttgaaacccccccaaaagacaaaggcacaatgaaatagaaagcttaccaccggtagctttcaaaacgacaaactaggcaaactatacatctccaccactccaattttgtcagaatgctaatgagcttgctctgatctttactcggcttcccgtgttttctacatcttcaaggaccacatggcgctagcaaaataaagacaactaaatgagaatttcgaatgctttttgtgttaggacctggtgcttttcagtggacgcactcgttgaatattctcaacttaaaagagtacaacagggggttgggtatgaactttttaacaggaggaaatttgaacaaaagtaaattagtgagatgaggaaaatatgagaaaaatttctgattaatttccactccataatatcaatgacaccttcagccccactcatactcttctaacaagagatgctgataaaagatgaatgattctgtgttgttcacagtgaatgtttagtggttttttaatagcagcattctacataaaaggcaccaggaagtactccgcattagcagttgagatcactagttaataggatgatgtcttttagcttttgtcacaagattattagaaaggatgggtttctgttctcatcattgcatagtttggagtgcctgttgagtacaagtgctaaaatacaggtttctcagtattgtttcacatgtaaagcaaaaagccttttaatgcaacacctttttcctttttaccaggtgattttgttattgatctctaatctgcccctttagctgtattaaatgcttaaagtgttctgcttttccatgtagccttgatgctagctatttgtgtctataaattcattaacattaaaacaggatctatatagactattagagtctatgagttagaaaatggcatattacatacttgtttagggcataaataacaacataaatttaagattatctgcataaatgttataaaaatatgttcgttgataatatgttatgagattttaattatgtatttataaggaacatatttttcacaatctctcttttctttagcaatcactgtacacttaccaggagaataagagtagtcaactccatttcttaccatatccatccatacctagaaagaagaaaaaaccaaaactgggtacatttttatatataaagatatttgaacacggctgggcacaggctcacgcctgtaatcccagtactttgggaggccgaagcaggtggatcacctgaggtcgggagttcaagaccagcctgaccaacatggagaaaccccgtctctactaaagatacaaaaattagccgagtgtggtggcgcatgcctgtaatcccagctactcgggaggctgaggcaggagaatcgcttgagcccgggaggtggaggttacagtgagccgagatcacgccattgcactccaaccggggcaacaagagtgaaactctgtctcaaaaaaaaaagatatttgagcttagagttaaattaattctgtacaactaataaataaccaggaaaggaaggaaaagatgttgatataataactctttccgaattttatatgaggaaaaattttgccagtgtttctcacatttaacacatatatttgatgtttctatatactgttctttaaatgttctcttatcctgaaaaattatatttttgtacattgtacttggttcacatgacttaaatattgcctcttaagatattataatttatacacccttctagcaaaatggaggttaaaaatcctgtgttaatgggagtaacttggacaaccatagtttttaatgtcaggaaaaagtagagactatcttctaaatataacaacagtttttaaaaatatgctaattctttactttttattatttagtgtgctatttctatgttcctcgtaagtatggattatatgggaattaggattcgtgtaataacatgtctccattttgtaaagttcctgggtttttgtggttttgtgtttgtttgtttgtttgtttgtttagagacagggtcttgctatgttgcccaggctggactgggcctcctgggttcaagcaattacgttgcctcatcctaccaagcagctgggactacaggcaagtgccaccctgcttggctagagattctgttttaatagacattaatatgtctattttcatacagattataatgagaaaagagaccatgtcattaaaaatatatacattaaactaagtgagatatctcttttggcattttaattacagaactgaaaaaaatttaaaaagtgaaggtgtgtcattaaaaattgttttctaatatgatataccgtgataaaatagaaaataaagttttctaggttattaaagttgaatacccagttgacatctactcatataaaatataagatggacagacaaggctttaatatttcctctgcaaaggaacttttcataaacagaaacaaaataaatgagggaatttgatgttataaagcaaataaaatgattactaaggttctgaagtagtatagagttaccctattcttctctactaaaatttatagagtactgaatctgtaataataaagaaaccagaaaaaatgatactttatatctgaaaattttctacaaagtgaatttttaacacaattttcagaggcaataagccacatctgttgatagactctaagagttgatagtattgttcctttctggaagcaaaatgctgacatgattttgataaatatggtgttatagttctgttttgtatatatgtgtttttaactgtgtcaagattttagttactttatgttacctaactccaagaatgcaaaataatacagcatcattttctaattacaagaagtgataaaacttcatgcaattatgtggggttttggggggttttttgtttgtttttctgttttggggggttgggggaatggagtctcgttcttgtcgcccaggctggagtgcaatggtgtcatctcggctcccagcaacctctgcctcccaggttcaagtgattctcccacctcagccccccgagtacctgggattacaggtacccaccaccacgcccgactaatttttgtatttttagtagagatggggtttcatcatgttggccaggctggtctcgaactcctgagctcaggtgatccacccgtctcagcctcccaaagtgctgggattacaggcatgagccatcgcgcccagcctgaaattatgttttaattcaatatgcagaaggtaaaaaagcatataagaacatgtcaaacaattgattctgccacatcttgatggaatcacagccaggcagaagaacagtgctccaaggcccagctctccaaggtcttcatgtgaaccattgctcctatgctcctgtccattaggacccagggcccataggtcttttactgttgttagcataactacaggagaggctgttcttcaatatttaatccatatcataccttcatctgaaaacatggacttatcccttgcagcagtgaggtgggaccctgactgggggaatgataactgcttactaactcatcttcacagctgggaccctcagtttgtacactaatagaatgaggacactatggctttagaaataaaaattggagtaaagaactcaactttaattcccataaaggatgaaatttgtttccattctttcatgtcctgtgatagagatggggtttcaccatgttggccaggctggtcttgaactcccaaccttcagtgacctgcctgcctcggcctcccaaagtgctgggattacaggcatgagccaccgtccccggcccagccaatatacttggatccctcattatgcctgaggttttgatccttggtatgcttatactgaatgtagaaccttaaccctggttagtgaacctaattagtttacatatagtcacactaagtcaaagttgatgtagtatggcaactaagagaaatgtgagaattaaattagatactttatatcaagcatttgcaaccaaacacttggagtataacatttgcaaccaagtacttggtatttgcaaccaagcacttggagctccataaatgttagctattattatttatataatctttttaatacttaaatttctcaacatctcctttgaaataaaagatgaaaaacaccaatatgctgggaattttacctatcatcatcaagcactaaaaaaaggtataatgaattaatattgttctcttctcacatttctacattttatttattattctgtattacatatgtagtatagaggcatttgattattgggaataatcaataatgaacagacatatagtttaaagaaaatagtaaattttgttttaaaaggagagtttagggagctgagtgtggtggcacccacctgtaatcccagcactttgggaggcttaggcaggaggattgcttgaagccaagagttgaagacaagcctgggcaacaaagcaagaccttgtctctacaaaaactaaaaaatttagctggttgtggtggcacatgactgtagttcccagctactcaagaggctgaggcaggagaattgcttgagcccaagagtttgcagctacagtgagctatgattgcactccagcctgagcaacagaatgagaccttgtctctaaaactgaaataaaataaataaaaggagagtttatatttaaggtgcttatagtacttttgttttttactttttctactttcaattttaaaaactggtaatttaattcttgtctttctatagtttttttctgtagttacaaggaaaattaaaatatcatactttcaagtcttctttattctcacaatttgttcagctaattcaagcttctgttgctatctgtatttcattatttagaccatttaagaaggaaaatataaattatatatagaagcactagcacttaattgttgaatcattctggttcatgcgataggttctggatcataggatttctagaaaggaaccttgctgattcagaaatgcagagggcttcctaaggttctcatttctaacatttatttcttcttctctccttggcactcactggatgccccaactttttactatatacagtattaagttgactttctcatctgctgactcatgtttattcatttatccagaaaaacaaatgtatacagtttctacccgtgatatttagaaagtattttccactactagaaattttgaattggaaatgtaaagtataatttttgaacctaaagaattaacacatcaccataattttcaatttggaacatgtctgttgcttgaagtgaggaacatccttattctagattgcaataaaattttttaacatttaaaaaagtagaaattccaggaaaatgtgtttttcctcaacaactatctatgaaacaaaatttaggcatttgaactgacttggcagcaacgtgtttttcttctgaatgtgaaattaaatttgtgtaatgtcatgccaatgctaaaataacatgttatacatggaatatcaccctttctttttttaagaaaaattaatctcagtgacttctttgtgaaagggccaagacagtgattctcaaacttttatatccattaaaaaaatgcctgagaaatttgttaaaaacatagattcccaagccttacttagaagattttgattcactggacctggtatggagccagtcttctaggcaattctaatacaggtgatccacagaccacatttgagaaacacagagtgaagatgtgctaaactcatagtgttacaagcgctaagagaagtagcacagcatagagatttaagagtatagactttaaaatcagtaagatcccagctagaatctgggtgttcttagacaagttagttaatctctccgagcctctgtttgatcatatgttttaaaaaagataaaggcagcagtggctcacgtctgtaatcccagcactgggaggcccaggcgggcagatcacgaggttatgagtttgagaccagcctggccaatatggtgaaaccccgtctctactaaaaatacaaaaattagccgggtgtggtggcacacacctgtagtcccagctactcgggaggctgaggcagaagaatcacttgaacccagaaggtggaggttgcaatgaaccaagagcatgccattgcactccagcctgggcaacagagcgagactccatctcaaaaaaagaaaaagaaagaaagggaagggaagaggaggggagggaagaggaggggaggggagaggaggggaggagaagggaaagggggagggaaaggaaaggatagggaagggaagagggggagggaaggaaggaaggaaggaaggaaggaaggaaggaaggaaggaaggaaggaaggaaggaaggaaaaaaaaatgctgggctgggtgcggtggctcatgcctgtaattctagcactttgggaggccgaggcaggcggattgcctgaggtcaggaattggagaccggcctggccaacatggtgaaaccctgtctctactaaaagtacgaaaattaaggccgggcgaggtggctcatgcctgtaattctagcactttgggaggccaaggcaagcagatcacgaggtcaggagtttgagaccagcgtggtcaacatggtgaagcccatctgtactaaaaatacaaaaaattagccaggcgtgttggcaggtgcctgtaatcccagctacttgagaggctgagtcaggagaatcacttgaacctgggtggtggaggttgcagtgagccgaaatcatgccattgcacgccagcctgtgcaacagagtgagactctgtctcaaaaaaaaaaaaaaaaaaaaaaagaaaacattagctgggtgtggtggcaggcgcctataatcccagctatttgggagactgagtcaggagaatcgcttgaacccaggaggtggaggttgcaatgacccgagattgtaccactgcactcaagcctgcacaacagaatgagactacatctcaaaaaaaaaaaagaaagaaaaaagaaagaaaagaaaaggctgataatacctacttcagaaagttatgagtacttagcacagaacttggcagaggatgagcactcaatacgatagtagctactgctatcagtcagagtagtttaattatttattattgtttctgccttttttctttctttttttttttgttttttgagatggagtcttgctcagtcgcctaggctggagtgcagtagcgcgatctcggctcactgcaacatttgcctcccaggttcaagccattctcctgcctcagcctcctgagtagctgggattacagacacgtgccaccatgcccagctaatttttgtatttttagtagagacaggtttcaccatgttggccaggatggtcttgaactcctgatctcaggtgatccacctgccttggcctcccaaagtgctgggattacaggtatgagccaccgtgcctggcctcattttttttttttttttttttttttttgagacaaggtctctctatgttgcccaagctgttctcaaactcctggactcgtgatcctcccacctcagccttccaagtagctgggatcacaggcatgcaccaccacacccagctgtttctacatttactttaaattttccttagcttctaatatacacatctcgttctatcataactctcctcttctctgcaactcacatacacccacttatactctctccgtctctccctctgtctctcccccagccccccagaaaagccaaaagtactggtttaggaatttgacataaggctagagaattatttttgttgttattgtgttgtttttcaacccttaggttatatgtaaaaagtaactttaatgaatgttttgtgaacgccataattttcacagatagattaataactaggaggaagccttaggaattgtgctagtccctttatctgaattcctacacttattatatgagtgttaggcacttacagaagcaaactgaacttagacattgtattttgagaaatctattttaggacatcaggtaagagtcaactttgcaaatgcatttatcctcctctgtttcatcctgacttcatcccctaagaagattaaccaacatttcataatttgttttgacagagaatgacatcagagatggataagtatgtatgcgttggcccctgagtcccgaaccaaaatcaaggtactttatagaagggtgcaagctctgttccgacacctttctcccagtttccccaaatggaaactttttttttttttaaaacggagtctcacactgtcgcccgggctagagtgtagtggctcgatatctgctcactacaacctccgcctcccaggttcaagcaattatcctgcctcagccttctgagtagttgggattacaggcacctgccaccacgcacagctaattttttgtatttttagtagagacggggtttcactatgttggccaggctgctctcaaactcctgacttcgttatccgcccacctcggcctcccaaagtgctggcattacaggagtgagccaccgcgcccggcattcgaaacatttttacttaaaaatacggatgctaatgtatagaaacaactggatgcattactgacccttgttaggtccttcatcttggagacagagctgtccaactgaatagtcgtgaaccttactttcattgttatgcaggcttacaaagttgtgttttcacatcattggccattctattgtggagacattgccagttcctcctctcctccttcctccttcctctttcctccttcctcctcctcctcctctttcttctttttctttttgacagaatctcactctgtcgcacaggctggagtgcaatggcgcaatctcagctcactgcaacctccacctcccaggttcaagtgattctcttgcctcagcctcccgagtagctgggactacagacatgcaccaccacactcaggttatttttgtatttttagtagagatggggtttcaccatgttggccaggctgatctcgaactcctgacctcaggtgatccgcctgcctccgcctcccaaagtgctgggatcacagacatgagccaccgcacctggccaacattgccagttcttccagtggatggtagattattaagtctttcttttagttactcattatgtttttaacacttttcataggcctgtaggtggtttgcataagaaaactgaacttatatagtcattgtatctgttccctatccgcacttgtcacttctgagctgaaatgtgaaaagtattcatgcactcaaaggagctatctcatcagaaaaagtttacagtgtaagttaaagaaaacctgttgagttgatacctattttttttaaaaacattagaggccgggcacagtggctcacgcctgtaatcctagcattttgggaggctgaggcaggcagatcacctgaggtcaggaattcgagaccagcctggccaatatgtcagaaccctatctctactaaatattcaataattagctgggcgtggtggtgtgcacctgtaatcctagccacagaagaggctgaggcaagagaatcgctggaaccctgggcagtgaaggttgcagtgagccgagatgacaccactgcactccagcctggacaacatagcaagactctgtatcaaataaaaatagtaataaatcagatatttttagatgcttaatattactaattaatgtttgtaatgtttgcttaatagtttggttttctttaaccgttttttgttttgttttaatggaatttggaggaattttttagagaaacaaagattaatcaaaatagtgtgattatttttacagctgtgtagctttacaggatcagatttgatacaaatatatatacataaacggttattttcctaaggaaagacagtggactttacctgtaaaaatgaaagtatgtaagttagttttatcctctgtgtttaaactagtgacattgatacatgaattcacagtatacagagttgcaaacatctggcttgtcagtgtcccttgtacttactgactggttgtagactgctcttctactctttacccaccccaaagccaaccaatcccatgcccccagtgccagttcactctgaattaatagcaccacttggtggccaaaactaggaattgtgtcaagcactaacgtttcttccctactagcatgttgtcctccacattagacacttctgaactggaacctgacagatctcttcatggctatatctgttgtgcttttgaaggatctagctccataaggaaagttaaagatacaagtcaaggaagacatttagattgatataattgtttattttaaaaatgagtttattacaaattttagtgctttaaaaaattagagatagttttatatttcaggtataaaaattttctagagaattgaatttttaaaagtcataaatattttattttcttatgagaataaaattagagggagccaatgcaaggtctggtggttcatacctgtaatccaagcactttgggaggccaaagtgggaggatcagccaggcgcggtggctcacacctgtaatcccaacactttgggaggccaaggtgggcggatcatgaggtcaggagttcgagaccagcctggccaacatggtgaaaccccatctctactaaaaacacaaaaattagccaggcgtggtggcaggtgcctgtaatcccagctacttgggaggctgaggcacgagaatcacttgaactcgggaggtggagattgcagtgagccaagactgcacaattgcactgccgcctggatgacaagagcgagactccgtctcaaaaagaacaaaaaacaaaacaaaaaagatgggaagattacttgcgcctaggtgttcaagaccagctgggcaacacagcaataccctgtctctacaaataacttaaaatgagctcagcatggtggcatgtgtttgtggtcccagctactcaggagcctgaggcaggaggattgcctgaacccaggaggtcaaggctatagtgagctgtgatgatgccactgtattcctgccttggcaacacagcaagaccctgtctcaaaaaaaaaaaaaaaaaaaaaattagatggagtcaaaatttaacacttttaagaccatttgtttttactcaaatgcttattttgaatcaaagttatactgaacattgctattcaaaagtagaatactggttgggcatggtggttcacacctgtaatcccagtgctttggaaggctgaggtaggaggattgcttgagcccagcctgggcaacagagtgaaaccccatgtctacaaaaaaattaaaattagccagacatggtggtgtgcacctgtagtctcagctactcaggaggctgaggcaggaggattgcttgaccccaggagttcaaggttacagtgagctatgattgctctcccgaattctagcctgggcaacagagcgagatccactctgggaaaaaaaaaaaagtagaatgccattctagaaaaaagtactaaacattcataaagccaacaaagtttggttttagataatggaatttcattaaaagattagtttccatcatttatagatgataaaaatgttttctttaaaatcatcctacaaaattattagtgtagattaggtagatattttgctaagctctgaaatacgtaatttgatttgatggcgacaagtatgggaaatgaaaatgaagtactgtgtcaacaggtgtattgtgaggactaaacagattttagacagggttttgatctgtcacccaggctggattgctttgatgcagtcatagctcgctgcagcctccatctgttgggctcgggcaatcctcccgcctcaggctctgagtggctggtactgcaggtgcacaccaccacacccagctaactaacttttttgatttttagtagagacaaagccttgctatattcaggctggtcttgaactcctgagcttaaatgatcctgtcacttcggccatccaaagtgctaggattataggcgtgaggctctggccctttttaaatgggctgtagctttggagagaagggaaaggacattacaacacaaggacataaagctaactgcttgagattgacgcataagatttatgccagaatctgaggtgaactattggggtaccatgatattcttcactctatggggtattttaaaatttatatcatgataaaaggggcaactgaacatatcctggggattaagttgagaagaaatatgaaagtaacttaatccttgggaattttagagattctgggagtcacacattagattttctctagacttctaactgaacaaaatggcaattagcacaaggattttggaatacacttaacagaacatgtgtaaccttggaaaggggaatgtctaatggagggtttgcaattgagtagctgctttaagaaaagaaaaatgggtaatgcgtagttgatgggtttgggtgcattgaggggatttaaaaaggccgaatgatgttaggatgcattttggttgattggtgcagtaaaatgaatacataaagacattagaaatatactcaatgaaactaacaacttcagacttgcactgagttgcccaacatatttacttctgtggatagtcctttctaatgcttgcataggcagtcagaaaaactctgacactctgctgggaggaatcaccatgccttgctctatcaataattctaggaatcaagagaggataccgaagtttgagtaatgaatatggctctctaccttgtgtgtgtgtgtgtgtgtgtgtgtgtgtgtgtgtgtgtgtgtgtgtgtgtctgtgtgtatagagagtgagagaaagaaagaaacaataatagcaatatcatattacttacatagcatttatttaccatgagcctggcactattctaagtgctttacatatttgaattcatttagtcttcacagaactctatgaaatagtaccattgtttcctttttacagatgaggaaactgagtcttagggagaataaataacttacacaagttcatatagctcttaaagagcatagctggacttgaatgtatcctgataatccagtgctaggcagagtattcttgcttggccattttcattgaatggccatttccattgcctcaattggaatcacaggtaacttgtggttacccaagaagtgaacaggtctcgtctaggcatcccatttctgtaagaaatcatataccaacctataattcaaggatcttatggacatgtttgcataggaagaaaggttgactcctcctatgaagaatggtatgctgctctgacatcattgctaagtcccaatggcatacacatgggaagactaaatgaaatcccctctgttatggatgaactaagtgaacagcatgagggttttcttgtttatcagagttttgaaggttttttgtgttcatttgtttatcagagccactctgaaggctttgtcaaagttggcctgaattctaaataaagagcctgttctggtaagactgattacctgtgagtccttaagtgtcaaatgggtggctaagagtggtggctcacaagacaaactggctgcatttgaggcctggttccaccactgactagctatatgacttgagataaattatataacctcattaaacagttgatgctattattatcatcatcaacatcactaccattattattcccagcctataagaaagttattggttgtcagtgatctgatgaaggaaatacatgacagtctctttgagacattgttgttctcaacttcaggaaatggcaatacagacccaagttcgtcatgagtgtactctagtgaagataatgtgtactcaagtgaagagaatggttctccagagaaccactgaggggcactggatgtggtattatagtgttgaaattcacactaatcacctggcctggtctggaagaacagcatttattgcatttgatttcaaggtgttgtgtaattgttgaaatcctgttcaagttagaaagctgctggagaaggatctacactgtcctgctttgcttaggcttctgtggtttgagaacaaatgtgggtgcggactgcaagtggggaagcataattcccatcagctctcccctatagatatttaggaaggtgcatatgaggacattatgttaagtgaaatagggctggcacagaaagacaagtatcatatgaccttacttatatttataatcaaaaaacattgaactcatagagaacacagtggtggttaccaggggctaagatggtaggggaggtaggggtaaggtcagggaagatgttggtgaaaggatacaaaatttcagttcgataggaggaatacgttcaccaaatctattgtacaacgtggtgagtatatgtttttgtttgtttgtttgtttgtttttcagtgacaggatctcgctatgttgtccatgcttgccttgaactcttgggctcaagcgatcctcctgtcttggcctctgaaagtgctgggattacaggcgtgagccaccacacctggcctttaacagtgtattttacttcaaaattactaagagagttgattttaagtgttcttaccacaaaaaaagataagtatatgatgtaatccatatgttcattaccatagtttagacattccacaatgtttacctatttcaaaacatggacatgataaatatatacgctttttgtcaattaaataagtaaatgagaaggtacataggaaggatatatcacagtgttacctggttatctgaacccaagcatgatcaaagcaggtatagagtggaaaagaaacttactgtgcaggcagctaattgagggttgaactcatcccttattggaaactggaggctctggagacaccctgggtacgatattttaaggacttttaaagattttttttttttaagagttttggtcttgctatgttccacaggctggccttgaacttctaggctcgagtgatcctcccctcagcctcctgagtacctgatactacaggcatgctccaccacccccagccaatttgtagagactttaagcaacactggagcaggttacctacaagagtagttgtccgactgcatgatacatctttggagaaaccctttattggaaggaacctatctggaacacatttaaaacctatctgtctgaatttgtatttctatattttaaaaattatatatatttaattttccatactttcagtagaatctaatcacagtcccacttggcatttagtaaataagctatttcatctacactgacaatttcataagctgattttaaaggtgctgtgcttttaacaccaaaatatcttcctataaaaatgatgaaaacttactttcccactgaagctttttgctttataagtatttgatattctgttgtcattcttttcttcaaattatatcaatttgtacttcatattgtaattctcattttttaaactttatgttcataaccagcaaacttgtagatgtgttctgttagtccataattttcaatcttaaaatgtaccttttttattttttgatattaagcagtattccattatctacttttttttttaagtctctaaaacccactgtcaataactagactatcattatttggagcacagccacattgttatgttaccatagctatggctatcttttgtaggccacagtgacactgctgaccctgtagggcatctgctttgtttttccagctgcagagatgggtttgtactgattcacccacatttttcacctatcctgcatatgactaatggaacactaactatagactttgttatgggagccaagattaaaaatacaatttgtgtccatgaaattgtttacagatttacccttcatctagctatccctggttatgtctgtctccatactagattatgcggcctttgagggcagggaccacatcttggttatcttgtatctccagttcctgcctcagggctatatacaccatcatcacccccttcattattatcatcatagcttgtagtcttgggttctgcactaagtactttatgtggattttctcaattcttacaacaatcgtgaagtaagtaataccattatccatatagagatgaagaaactgaggtttagagagtttcaataattagtctgagatcaaggggctcaattttttttaaaagctaaactgaacaaaagctatattttttgtttttgagatgaagtcttgctctgtcgtccaggctagagtgcagtggcgcagtctcagctcacaaccttcacctcccagattcaagcgattcttctgcctcagcctcccgagtagctgggattacaggcacacgccaccatgcctggccaatttttttgtatttttagtagagatggggtttcaccatgttggtcaggctggtctcaaactcctgatctcaggtgatctgcccacctcagcctcccaaagtgctgggattacaggcatgagccaccatgcctggccaacagaagccatattgggtgtggatgcaatgttcatcttatttgcattatattcagaatgactgatctaaccaaccatgaaactatagatactatgtaattatatatcatgcttgacactaccagaatttatagttatatctacaggagtttctcagaattaatgtaagtaaacattcataatatgctccttaatttataagaggtctttattctaaagttcatttatgagtcagttgctctatcacgtgtatccaaataacctaaataaagatgaaccccattctcccaatgacaatatcccccctgaaattttggcctacatgaatgtataaatgcttataaatatctgttttaatatttagctatatatatatatacacacacacacacacacacatttaaaaatcacatcttaaaatacattaacctagaaatattgcttttctccacttccattttttttctttttttttgagacggagtctcgctctatcgcccaggctggagtgcagtggtgcaatctcggcccactgcaagctccacctcccaggttcacgccattctcctgcctcagcctcccaagtagctgggactacaggcgcccaccaccacacccagctaattttttttttgtatttttagtagagacggggtttcactgtgttagccagggtggtcttgattttgtgatctaatgatctgcctgcctcggcatcccaaagtgctgggactacaggcatgaacccgcacacccagcttttttttttttttttttttttttgagatggagtttcgctctgtcgtccaggctggagtgcagtggtgtggtctcagctcactgcaacctccgcctcttaggttcaagtgattctcctgccttggcctcctgagtagctgggatcacaggcatgcgccaccacacccagctaattttttgtatttttagtagagacagggtttcaccatgttggccagcctagtctcgaactcctgacctcaggtgatccgcccacctcggcctcccaaagtgctgagattacaggcgtgagccactgcgcccagcttccactcccacttttaaagaaattattttattcaactattcatgttcatctttgatattaatatatctgtcacttctagagccacttgagtcattcccatgacatgactgtgagaaggctataggacagggagtgggtagaatggagtcagccagatgcagcccaaacaaaaaggccttcaggagagtggagagctgtcagggggaggcatccatctgtaagggaagcttacaattcaagttttccccttactagaggtcgcttaattgattctccaagaagactactgtctatccagtagaattatgcctgtaaaagtgactgactgtattttatcctattttacaaaatacattaaatgtaccttaaaaaataaatacagctttggagttctgagtgttttaactttagtcaaatgctcatctgtagattgtcaagatagtcatgcgttacctgaaatgtgagtcatttacctttaaaggctcttagcaataaaaagttatggatgcatcatcatccatatgtaatttaaaaaaaatactaaactattggctgggcacagtgtctcacacctgtaatcccagcactttggaaggccgaggtgggcaaatcatttgaagccagcagtgtgagaccagcctggccaccatggcgaaaccccacgtctactgaaaatacaaaaatcagccaggtgtggtggcgcacacctgtgatcccagcaacacgagaggctgaggccagagaatcgtttgaaccctggaggtggaggttgcagtgagctgagatcgtgtcactgcacttcagcctgggtgacagagcaagaccctgtctcaaaacaaaaaacaaaaacaaaaaaaacctaagctataagtaaatataaataattttatcagttatatttttttccgtaatgactactttgatgcttttttatttctgccttaactttgtgtttagtgtgttaccttttgagaaatccagtgctgaccttcagtataaaaaaggtcagttcaagcattaggagatatacctaatgtaaatgacgagttaacgggtgcagcacaccaacatggcagatgtatacatatgtaacaaacctgtacattgtgcacatgtaccctacaacttaaagtataatttaaaaaataaataaataaaatgatttaaaaaaaaaaaaaaaggtcagttcaggctgggcgcggtgcctcacgcctgtaatcccagcgttttgggaggcgcaggcgggtggatcatgaggtcaggaaatcaagaccatcctggctaacacggtgaaaccccgtctctactgaaaatacaaaaaattagctgggcgtgctggcgggcgcctgtagtcccagctacttggaggctgaggcaggagaattgtttgaaccctggaggcggaggttgtagtgagccaagatcgcgccactgcactacagcctgggcgacagagcgagactctgtctcaaaaaaaaaaaaaaaaaaaaaaaaaagtcagttcagaccccattaaggagtaaggagttggtacaagaagactgctgtaaacttccaacctttagaaatagcttcttcctatgtgtaagtttattgaggaagaactttggtgaagttgtctgtgcctcctcctgtagaaagtccatgcacaggggtctgttagaagtcgtgtgtagaaagttgctacctcacatctctccccacattctatcttagcagacaggtaaataaaagatatgtgtgagagaatatggcagtttttcttttgcttcaaccaaaggagacaggatttttcccaaagtttgtactcttaatattataaatatatcaggctgagcaaatggttttaagacaattaaactgctgaaaacatcaagattatgagattcttctatgctgatgctgtttgaggatattgttggatcagaaacatttgtagtaaaatttattttcataatatagctctatttcctaagtttaaatattttctaaaactgaggcactggagtcctgcaataatgttggctttggagttaatgtctacatgaccctaaataactgcaccaaattcatctctttcgtccattaaataccagttacttggataccttcatgtatcatatgtctttttgtcatatgtctttcaaaggtcatcatattcttataatcaccatcaggacaatttgtaatggcaggtttttttgtttttgtgtttggtttagctttgctatgttctgtcctttaagggctatatgtgattactactcagccatcaccactatggggctatggcaagatttcagcattctttaatgatttcatggtagaaaatcttgaatttgtgtacttgtataacagcagcctacatttatatgtatttactctttcccattgaattcgtcttctattcagctaaaattgttttattccttattttgcatttatataagaattcattgtctaaaatatatctttatagatagataattttatggtgaaagattaattaggaaaagctaatgagaagacagtttttaaaacattcataatttctggtttttgacatcacttttattcattttaaaacttatgttgaaaatactacttctgaaaaaataaataaaaattacatacagattcttggataaatgaatgaattgctaaataaaaataataactttgaagatttcttggaagatatgtaatgtaaagtagttgatattgtcagttaacactgactattgcatgtactgctctgcatcatatgcttctatcaagtggtttttgttaactatgtgataggaagaataatttgaagttatatttacaaatagttacttttcctgctattatcattatccttgattatttaataatttttacaaatcatactccagctgcaataacggattaaaagaaaaaactgactttaaggattgtgatatcgaaatagatgttacattgtcttggaggcaaaataaaaaacaagtttttaaggaaacaaagtaggaaaaaatattaccagagattatattaagtagtccaatactttaaaatgttaaggctaaaactagttaagtagtttttatgtttttattggtaatttatttataataaacatgaggtactatgttttaaaatatagtgtaacaactcagccatgctttcacattttagtaattgtatactgtagtatgttattttgtcatttttaatttcaaaatggctttcaatattgtatgtcttgaattttttaaatggtgaaactgaaaaaaaaatttaaaaaggattattgttggtctaggtgacaaaaatgtggttgtaattacaaattaaagataattttgaaaaagaggtagttaaccaggttaggttaaataagattaaacgatttatggccattttataaaataatgacagtcttcattttaagctacaatgtaaagtgctttattctgagattaggtattgtggcagaagctaaaactgcctttttttctagcagtgccagaatacaacctctttttctttttgcactaacaagactgctttaccaccacagcccactctaagtaattaaatcaatcctttgtacttaccgtattctcctctagtgacggtactagatctgattatatgcttcatgcatattcaaagtaccgcactgacagctctttaatgagctcttacttaatcagtatgaacaatgttcatcttgttctttttttcctcatgcattagagctacgaacagttgggaaaaatgaaacatccagcattcatttgaaaaatatattgtactttgaaaagtgtctaagctgaggaagttgcattctgccctttaaaagtctgatggacaaattggattactagtattggattaaataacaaatggttagaggagaaatgagaaaagctcactgtgatcacaggctttaatattttttgttacttataaagctaaaggggtctttaaccagttattaaagtcaggattaatttgtaatggttcaacttactggcttttaaaagctttttaaatttaaaaaatttgagagccctgaaaacaatagtgtaatgatgtattagaagaaattttaatttttttagtatgaggttacgtatagatgtccatcattgtatactatcgcagataaggatttggtgatacagaattgatttatcttcaaatatgtttttccagttaaatgctctgtgaagcaatgagtaatgtgtccttaaatatttcttattgttaggcttatttccttgtaaaacatgagattcttttgttattagtcatttcctaacaattagaggaaggggatctcttattcttcactagaattcataggcataagtttaactgaaaataacacagtaccacatcaatattgttattctgaaggaagcagccttccattgaagaaaatgatgctaatttaagagtaggctgattgcttctagtattgcctgaaaacctcaaattataggttaagttaaacgcaaaagaaagttttaataagtctatatttttagaaatcacataggttatgaacacaagaattaagtctttaatcggaaagtaaaatatcataaaatctacacctattaatattgcacacatgtggcatttcactgatcaaaaaggccttcaccagggtacaattggcctttttccaaattgcaagctttttctcagctttttctttttactctttcttcttttgttgctacccagggatttgtgcctatcgcagcctatatcacatgaccagtgtcaagacatcacatggtccaaagtgaatacaaaaccagctaccctaaaagagagattaaaaatactgtaaaacaataaagacttttgttcagactctaaaagaatctgtcctaagtcggcttcgtaccattagttttaacagcattgaatgaaggcatatattctcaactattctccctactggtaaacaacagctatctattttatagggatgctctgaaatacatgtttaatcccttacacacagattagctttttatattctatttgtattctaaaaattatttaaatttgtattaatgtagaaatacttaaataaattatggtatgctcataatttatgcaagcactataaagaatgagatagatatttggacaatatgacaaaacaaatcatagatgaatatgtaatatgagcttttatgtgaaagaaacatgtatgtgtctatagatacagtatatacacatgtgtgatagacatagctatcaatgtggtctcaaggagatatgttaaactataatcatacttacctgtggagaagggaagtgtggggttggtggaagagggctatccttgacattttacgtgaaaagaaaatcaaacttagggaataataatctgaagggaattatttaatttttaatagatatttaaattaaccttatgaatgccatacagaagttagactgaaatattaaatactagcttagcaaaacaataaaccagtcatgggaaaaattcagtaaataaacattgaagaattagaaattcgactaggtataatttgaagggagagaaaggaagctaggaaaattaatatttttcttcagtataattgtggcctacttctacatgaacaaatgccaaacatatactatattataatccttaatatggattatattggcctttgtgaggaagtggcagggtggtattagatgatgggatggatattagcgatggagaattttaagtatctcctgtgtacaatcagttataatctaaaatgttcagttgtcactctgctcacatgttttctgaacatcatgatgttcattaaattttttttttcatagatagctgtgggtatttttttgtagcctggtaatttacagtgtatttagtaatttataagtagtctaccctattagggatgatgagttccaaaatgtcatatatatctctagtttacttttggggaggaaaataagaaaatagcaagttgttaaaaatggaaactttcacacaatctctggacttccctgatcttcctgctagtcttatgagtctcataatgattttttaattttttttaatcatgaccatatgtctctcagcactgtgagttccttattgaaacataatagcaagtcagcctctagggagaatttaaaaggtaggacattttgtttactgtacttagtgttaatatgatctatcggtatgttcacggagagtaaaatatgcatgccgaataataccaccttaagattgacttttcttttttcaggacttagactttaaccttcttataagcagtttaatatatagtattagaataagtaaaatgttttctatgtttaaaaaattatgtgctaaactactatttggcttgttttaacatcgtatagtaaaaggtaactcttcccgaattataggaaggaacacagaagaagaagaagctatgatgcaggaatggtttatgttagttaataagaaaaatgccttaataaggagaatgaatcagctctctcttctgtaagtactcatcattatgcttgttttgcctacaacattgataaatcttaggcctcttgttattgccttctttgggatttaatatttattcggtattttccctttccttagcgattacatgttttataaaaaaataaaaaatagtatatgacagttttcatcttataagaatttttaaatggaacagtagacactgaaaaagtgtttattatacagaaagccaaggaatataaacaattattgtatttaagaagtaaatcacttatacaaggaaaggaagtttggtttatattgagagaggggaagataaataaaattaaagtttatttaacaacaaattctaagttaaataaaataactcttaataaggacaaaagtacatttatagtctcaggtgatgttactctaaattttgggataaaagataagttactaaaacaaaagtgacctttttgtgattataagaattacagtaaaatggagtctagacaaaatgtaagcattcttagtttttagcattttagttcaccggaggacttaagcacgttcctttctgctcactagcagtattcttctagtatgccacctagcgtgagaatgagcaggcttacgtggtttattttagtgaaaaagtctaattttataatttctgccatgcctgaacttgataaaagagttatgaagaagcacaaaactttacaaatcctgaattgtggtctctgtattaaatttgcactgctggtactttcatgtttcttgtattcttttcatatggagttttggaaaaaagagattataaattatgaaaaatattttagaaaatagccttatacttggcatttactacaagaagcaatgaagaaagtgagtaattatcctcagattaaaatatacctatgtaacattcagaattgaaggaggaaaataatagcactagtaaatattcgactgaggaaggttttaggtttgtgtatcattcatttggagtggcttaaacttaaagagaaaagtcagttatgagtcctaaaatcaatgtaacctaaaggttcttttaagtttttaatgatttagtaattagcatattgatgaacttttgcaacttgcccagggaaaaagaacatgatttagaacgacggtatgagctgctgaaccgggaattgagggcaatgctagccattgaaggtaagaaatgctatggtggggtgaggtatgtgacgtgtcagttgtcaaagagatttaaagaatataatacacttctggtcttactagatctggtgtactagggaccttccggaattgcaaataaatgccgtggaggcagaaagcagtatccatataaacttaaggaccctaattcagatagataatcattatgtttgctattaatagtagcacaaaattgtcttaacttttgattcagtaagcttatatgtccataaaatggaaaataaaaggagttgattgatttaattacattttacttaagtgtgatttaaagttgtttccactcgggaggtttggaaaagatttatcattttgattttttacatccagactctaaattttactttaattgatgtcaacattgaaatatgttcctgttcagtctactacagttcttaagattccaacttgtattaagtgaatatctgggcaaagattggcataaaagataaatgaaacagtttcatgcttttcataaagcttttaaatgaattatatagtaatcctatgcatggttcatatatcagtaaacatcagctagcttatctggcatttactatatatgatttttttttaattcttaggtgctttataatgctgttctccttatatctcagttgaaaatgtcttatagttcaaagatgtctgcttaaaagctaatcctttgggctctgtaaaatggaccttttgtctaatcaatgcaaactgattttcctattctatattgacctcttaacccattgactgtccatggtaattttgttcttcacctgataaggtacctgatccataataagtcaattctaattagttcagaaactggaaatttaagtacgtaagggaaagccaagtgaagccttatattcttaaaatattttaataaatattgtcaccaaagtgcatgctatttgtctgaatactatcatatatgcttgtagacatttcatttttagttacttttatattcataaactcatttgataaatatcactggcaacatttgtatatcctcatttataaatctgatttaccttattttgaaaggcttcagttagccaatttccttcaagtggctacccagatgtatcaaattatagcattgataatgactataaaatttgtcaaaattatttaagaagttctgtgaaacgtgccattgaaataaagtgcacaactatactaaatggtatttttcctcttgatatagtttttgtagtcatggtatagtctttaaaagagcaaaatagtcagttgaaaagtagacacagcaaatactatttatattatatatatatgtatgtgtaatatataatgtttatatatagtatatataatacatataactcatcatacagtttattatttatagattcattgtacactacactcaacacagaatattctttacatttttatctacactttcacgtataaaaagataaactatccccaaaatacagcttgatacaatacagttgactttaagatagatattggttctaaccccaaaaccaatgttataaccaaataactgtcttaaaagcagggccatgacacattaaataattcaatttcctcagcagtcctatccctatataccagatttacagtgttaaataatcgaatattttatctgcctgacctgcttgcacatacagaaaagcagtagaaagtcatatatttgaagaaaaggggaaaaatatttttctttttaaagcagttttactacagttgttagtgttttgcattatcattctcttttgtgttttaaatacattgtctgtatatatatgactgtgccttaaatctctcggccagtttccactgctggttgagggaaaaaggagacttgagaaaaggagcagcctgttgattacaaataaagatactgtcttaagaaagaggcctgccccactagcctgggcagtacatgggctgggctgtcccagagaggtggtgatcactgtgaagatcagctctgtgaagacagtgtcctctgagccaacccttagagtggacacacattcagatgaatagcctttttaagtgttaacacaccacagaaaaaaacacatgaataagcaacagtagttagttttgttttgctttcttttattttaaagttcatttctcttttcccatccctcctacttagtagccataagatggttttagtaataaataaactaaaatcttttcaaataaatctgctgctgaaaccattcaccaggagaacagcatagaatattgataaccatggcacattgaaagaaatattaacagcttggtttgagagcaaaaaaaaataatattcaatacatccattcttctgagaatccataatcactttggcctgttttttaccctttttctcctgaggtgtttttcatagcaggagtttcattctactgaactaagttgtaggatccctcaagctaacaaacatcttttagatacttttcctatagttttttttgttccagattatttaatgccccctcaagaaagataaattcatttctgcacacattggggtgggcttttagaaagtggtatgttcattttctgcacaagaaatggatcttctctaggattttgtacatcttgatttattcctggcttagagtttgaagtgggcgctcttctaaagggatttatgcataggttcactatttttgtagttatggtttatatgataagctttttatatttaaaatcaatatgtaatcctgtggaggagcttatcccctaaaaccccatttgtaaatctattttagctttgttacacagtacagccacagtcttccatagattgattaggtacagcggtagaatcctatcaaatggcctgttctgatgatgatgcaaactctttcaggattgctagttgactggaactaaagataagacttgactgcaatcccccaatgtgctctttacaaaactagtgttaattttcatcaaagtgccaggcttatttatagtggcaaggttgaaggtttactacaagaactttaggtcctttctgttaaagtgtttataggtatttctcttgccttttttcaaggtaattatcaacttcagcaaataaactgaatcagggagtgaataattggccctatatataaaaaagagttttttaaactaacaaaacagctcagtgcagatggacataaacagaatctctttatttcaacactttggctcaaatgcagcatcaaaacttaatcctatttgttacaagaggatatggcttttgtagcaaaagtacactggaatctttaaattaatcagaacccacattgtagtttgtccaagccaaagtcagtgcagttaggcttgaacatgcgaatgtgaatcttgatcaattttaaatgtaatattacattttttaaaaaagataaaaatagtttacttaatttctcaaattagcattcaaatatatatgtatatgtatacatatgtatgagtttgtgtacatatatattatataatttattcccattatgagaaaacaaacgtgaagtaaaagtatagtttgctaatgtaaaatctattcactgcacattgctatttcctgtacagttgactaatattttgtagacagatattaatgtagcactgtaatgacagatttaatattttaaaaacctataaatttatgctgggatattttaaattctaatgtcatttaaatttgactctgaaatgatgaaaattacctaaatattcttaatttttaaatgatttcattacagttatagaaaatgtcattactgagctagggaaaagttaagatattttaaattactcaatacttcaaaggttaaaattttctttaatgtcctctcttatccattttgttaaagtcctaattttttcaatattaatgaaatcttggtatttttaattactaattaaagccttaaaagcaactggtcaagttcagagaaggaataattaagaaaattatatgtgttgttaaaatttatgttttcttggtttaatttttttaatataattttcaatttaattctatttttgaaaatgtattcaattgtaaagctgttagcaaaatggtttcgaagtaaataattataaatcaaagcttataatcagaatgatttcttgaggttggaagtgaaaaaaattaacattcattaaactagtaatcttaatataaaatttagtctcaaatctattacacatttaggtttttttctgaaataatatttctagaattatagttacctgaaattagactagatgacctttaagatctttccaacctggagagcctattaatttacctgctgaataagactgatttaagaacaagaaccagattaaaaaattttccagcattcctctcctcagttgcatttaaatccaaagaataaaattgtgatatatatggctgctcttcaattttgctgtttattattttttaaattattatattcaaagaaaccctttccaaatagtttctgtattcatctccatgctatagaatatttcatttttaaaataaaaatgtaatagtgatcagttatttaaagtatttgtgtggttttatatcgaatgtggataattaacatatagcatgtttcatataaatatgtatgtatgtgttagagcttataatgaaagaaatagtgataaattgaataaaacagtctagctttttgctgcttttctaacctttattgcatgatgatgcatctaatttttaatttgtaaatacaagatagaattccctctagcaccatttgctttcataaagctgctgagcagtttgctgtcttgaataaattttgctttggagggggtcgggggggatttgaaccagcacattcttgtgtggtttgtgaagattcacatggtaaccagcggtgtgcattgttaggtttatctgaataagcaccagccatgtgagttttaacatgattgcccagggcaatggagagagaagagagaaacccaaaaggattgcacttctctctgttttttggaaagtgcatttgctgggggagggggctgcaggagtcagtggccatggttctttttttttttttttttttttttttttttttttttttttttttttttttttaagctggtgtcctgtttccctctaggtcctcatttgttctgctatctgcctcatcatctacttcttcttttcattgtttaccttcctaatgagggaggcggggtagactgggggttgattgacagctacaagcccttacagtctggccagagagcagttggctttggtttcaaaagtgttttaaatgttcgatttggtcctgtttctattaaatgaaactgctgctcatcttaaggaaatcatcagaccagcaaagattaggaaatatattattggggtctaaaaccttcaaaaaaaaaaaaaaaaaacgccccccatccatggaaagagcactgcccatcgggttttccaacctttaacatagggtttcagaaagaaatatgtaatttttcctttgcaaaagtgctttgatttgaaaccacccagcaaacgtctccaaaagaaaactggctgtgatgcgatcgagagctgcagtgtaatattgcagagcaaatttattttttacttcaaagaaaaatgctaattagccgattcactacttttaaagttattgtgaagcatatggcgcccagtgtgagatacatccaactgctaaaatagagcgaagaggaaattagcgaagaatgggctgtttggggtgagagtgggggtgggggaggaggataggttctcaggcagattctctagccttttcagaatgattttatcgcccatcactgtttcccgcctcctcatttacccacttcccccactaccaacccctgggccaacctcttctgggcctctagctcccctcccccactttggctggattcaggtgcgcacctcaggctagccaccagttcacacctggttctaagcaggttccaacactgctgcagccatctccattcacaggacctgtttaggaagtagacttttagcgaggaagccttcaccacaacagccaaactccccagaaaacactagctagtggctctataatgtggtttgctgagaaatataaggaaactggaaaaggcgggaaggggagggcggggggccgggtgttcggaggccctgccggtgggtaactagcctcccgtcttctgcagactggcagaagaccgaggcccagaagcgacgcgaacagcttctgctagatgagctggtggccctggtgaacaagcgcgatgcgctcgtcagggacctggacgcgcaggagaagcagtgagtgggcagtggggtcgggtcgaggctgggccacctgccgaggggccgagaagtgtgcggaaagttcaatccagaggtcgcgggagggccggggcagcctcccactggcctggtgctccccattcccgctggggatccaaatactgggcgacgggggagtgctgctctgccctccacgaagaaaaataattttgtttcctgtttgtcctgtttgtctgacatccagggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcctttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttacctt

SEQ ID NO: 37760 - DNA, 13959 bp, Homo sapiens
ggagggtgtttatcgcggctagagagatgtcgctgctgcggtcgctgcgcgtgtttctggtcgcgcggaccgggagctacccggtgagaagtcctggtgctggtaccgacctgctgtccctgcagctctcctgtgcgcctgtacctttcccttcctcccaacctcgtttgactccatctcaccttccccgacagcattgcctctgcccagtccagccccggtgcacccccctttgcacactgtccgctccctaaggtcgcttccctgcccgtgtacccttcaccctctggagtttgctgcttcctgctcctcatccctttcttatctcatctaggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggtgtgtgtgtggaggggtgcagggcggagtactagagctcgacctcagactcttggggcggtcacgctggggagcataaagttagactgctcttcagtgaccataatggcacagtcctaagtggaaatctggcttaaatgacaaccttggccttgactttgtcttatttgaaagcagttgagtatcccaggattaacaaaccagactgttacggtgtttcttgttgcctggagctgaaagggtttgtgtgagctttggagtcagattgttcaggagtcaaattgtggggcccccacactgtctgactttagactttttttttttttttcagacggagtcttgctctgtggcccaggccggcgtgcaatggcacgatgttggctcactgcaacctccgcctcccgggttcaagcgattctcctgcctcagcctcctgagtagttgggattacaggcgtgcgccacgacacccggctattttattttttattttttatttttttttgtatttttagtagagatggggtttcgccgtgtcggccaggctggtctcgaactcctggcctcaggtgatccgcccgcctcggcttcccagagtggtgggattacaggagtgagccaccgcgcccggctgactttagacatcttaatctttcagagttgtgtagtttttgcctgtacggtcatgcgtctcttaataggaagatacattctgagaaatggcgtcgttaggagattttggcttatgcacatcatagagtacctacacaaacctagatggtatattgtactacaacctgggctatatggaattgccagctgctcctaggctacaaaccgttacaaaatgttactggactgaatactgtaggcagttgtaacacagtggtaagtattgtgtatctaaacatagaaaaagtacagtaaataggcataaaagataaaaaacgatacatctccatagggaacttatcatgtatggagcttgcaggactggaagttgctctgggtgagtcagtgagtggtgagtgaatatgaaggcctgccttaggacactatggtgcactatagtagacgttaaagcacagtacacataagctacattacatttataagaaatttttttctgtgataataagttaaccttagtttaatgtaacatttttattttataaacttttaacatgttttaaatttttggactcttttgtaataacagcataaaacacatattgtacagctgtaccaaaatatttttctttatgcactttttctgtgagcttttttctgtttttaaaattttaaactttttttggctgggcgtggtggctcatgcctgtaatctcagaactttgggaggctgaggcaagcggatcacctgaggttgcgagttcgagactagcctgacccacacggagaaacctcgtctctactaaaaaaaaataaaattagcctggtgtggtggcaagggcctgtaatcccagctactcgggaggctgaggtaggataatctcttgaacccaaaaggcggaggttgtggtgagccgagatcgtgccattgcactccagcctgggcaataagagtgaaactctgtctcaaaaaaaaaaacaacaactttttttattgaaatatcttttttttttttttttttttttttttttgagacagagtcttactctgtcccccaggctggactgcagtggcacaatcttggctcactgcaagctccacctcccaggttcacaccattctcctgcctcagcctcctgagtagctgggactacaggcgcccgccaccacgcccggctaattttttgtatttttagtagagacagggtttcaccgtgttagccaggatggtctcgatctcctgaccttgtgatccgcccacctcagcctcccaaagtgtcgggattacaggcgtgagccacagcgcctggccaaaactttttttaagttaaaaaattgttttgttaaaaacggagacacaaacacatacattagcctaggcctacacaggagtggcatcatcattaacactgtgttccactttcacatcttgtcctgctggaaggtcttcaggggcagtaacgggcatggacctgtcatctcctatgataacaatgtttttttctggaatacctcttgaaggacctgcctgaagctgttttactgttaaatttttttattttttatttttttgagacggagtctcactttgtcacccaggctggagtgcagtggcgcgatagatcttggttcactgcaacctccgcctcccgggttcaagaaattcagccacccgagtagtttataagttggagtacactctaaaataacaataaagcatatgtattatagtaaatacataagccagtaacatagttgttcattattgtttcaagtatcatgtactatatgtaattgtatgtgctatactttaataggactggcagcacagacgttttctttacactagcattgccacaaacatgtaggtaatatgttgccctacaatgttaggaggactaccgtgtcactagacaataggaatttttcagctccattataatcttagggaccgtcatcatatatgcagtccgtcattgtccaaaatatcgttatgtggtgcgtaactgtataaagaaaatacaactgtgtgccccatagggttgttgtgaagattagattcatccaaggcaccagttataataatacctggtatttggcatttagtggtagactgccagtaaatgatagattactttagtttctgttagagaatttagagaatcaggaaacctgagtatatcttagaactacatttagtgctaaattctgtgactttgttgtctgctctttttcctctcaatttacaggcagagatctggctccacaaggaggcccagaaggagggctggagcaaagctgccaagctccaagggaggaagaccaaagaaggcctgattgggctgttgcaggaaggaaacacaactgtattagtagaggtgagttgttggaaattccagataccaagaacagctgtcccttgggtgtaaagcttgtagtaggccctaaaggggcctgttcttgaagaagagatctgtttaagaaccataaagcgtagttgaagttaaactcatgaaaccctgggtattagttacgaattcgtttaagtatagaaatgtactggtgtgttgatgagaaatggcctgacagtctagaatattactcctgaatgtgagtctggcacaggcttacaccttgtcactgattgtttcctggaacagttagattacaagttaattatattaattgttgctgaatagagagtaggtattttagaggaggtttgggggccataattggtgaagagtcagatgtggattagtttagagtgagagatggggataaacaagataatagcataagtggtttggagttgggatggctggagaatgaggtgatgatggtgtgcagacataggtaagtggtgaacttgtggtgagtccttcaggacattattgaaccatcttctgaatatacaggctattgctaactcactggcccaacataaatcacttcattctgttccaggctaggagaggaagcgtagctttaaaattttggagtcattttttttccgttgagtctgtagcttgttctatcagtatcttgatttattctccagccttaaggcacttttggaaattatcattaaacagcttatacagctatatcaatttgttcccacaggtaaactgtgagacagattttgtttctagaaatttaaaatttcaactgttggtccagcaagtagcccttggaaccatgatgcattgtcagaccctaaaggatcaaccctctgcatacagtaaagtaagtttgggatttgtctccagtgtgctgaatttgctgtcctcattgggtcttttgctgttcctattgtagacattctcatgtctcattctgttacttcacatctctgcttaaatgctatctctttgcatagaattacccttcccccgttgctatatccccgtgtcatgctgcatttaaaattttttattatggtgcttatatattacattttaatttatctgtgtgttgtctatcttccccagcagaatgtaagctttatgaggcagggaatttgtcttttcactgttgtatctctggtgaaagagaattgggcccactacttagttggagctcagtaaatctttgtcagatgaatgaatgaatgattgaatgcatgcatgccagtgaaatggagttagccagatcaagtgaagccatttgaggctttgtgttcagaaatttggaatggtcttaggaaagaatttctaaataaagagattggagccaggtgtggtggctcacccctgtaatcccagcactttgggaggccgaggcaggcagatcacctgaagtcgagagttcaagaccagcctgaccaacatggagaaacccgtctctactaaaaatacaaaattagctgggcgtggtggcgcttgcctgtaatcccagctacttgggaagttgaagcaggagaatcgcttgaacccgggaggtagaggctgcagtgagccgttgtactccccccgggcaataagagcaaaactccgtctcagaaaaaaaaaaagagagagagattggaaaagacatggtttaggaaaataagcatattcttatccatagagggatcaaggaaaggaattatgtcattctgcctttgactcagccttattgccaaggcaaagatgaaccaaccactcacagtaatttttttgagtttattaccaactttttttatcttctttatccttctcttgagatgtcttggtaaatgttaattattattggcattacatagtcatatggaaaacaatgttgagattattttttttaattgtattgagtaggtaagtcacttgaactagaaattttagctttgattttgccagtaaacaccagtgtaccctttttttttttatttttgtttttgttttttgagatgaagtcttgctctgtcactcaggctggagtgcagtggtgcaatcttggctcactgcaacctccacctcctgggttcaagcaattctgcatcagactcccgagtagctgggactacaggcgcccgccaccacacacgcctagtatttgtattttttgtaaagacagagtttcaccatgttggccaggctggtcttgaactcctgacctcaagtgattcgcccgcctccgcctcccaaagtgctgggattacaggcgtgagccaccatgcctggccccagtgtactctttttccagatttgccatttattaacattttgctgtatttgctttatcacttctttttttctttaagagacagatctggctttcttgcccagcctggagtgcagtggcacaatcattgttcactgctgcctcaaattcctgggctcaagtgatcttcccacctcagactcctgagtagctgggactacatgtgcacaccactatgctaggctcatttttaagttttttgtagagacagtcttgccatcttgcccaggctggtctcaaacctctgggctcaagaaatccacctgctttggcctcccaaagtgttgggattataggcttgggtcactacagctggccctatcactttttatatacatgttatcatcgcccttttttttttttttttttgagatggagtctctctgtcacccaggctggagtgcaatggtgccatctcgctcactgcaacctctccctcccagttcaagcgattcttccacctcagcctcccaagtagctgggattacaggcacctgccatcatgcccggctaattttttttgtatttttgtagagacgggagtttcaccatgttggccaggctggtcttgactcctgacctcaggtgatctgcccacctgggcctcccaaagtgctgggattacaggcgtgagccactgcacccggtcatcatcactgtttaaaaaaaatctttttgtaagtatgttgcagacatcaggatcctttattccttcagcatgtatctcgtaaaaacaaggacattgttatataaccacaggacagtgatcacatttaggatttttttttctttgagacggagtgcagtgttgtgatctcagctcactgcaaccttcacctcctgggttcgagcaattcttatgcttcagcctcctgagtagctaggattataggcatgcattactacttccagctaatttttttgtgtttttagtagaaatggggttttgccatgttggtcaggctggtctcgcactcctgacctcaggtgatctgcccgccttggcctcccagagtgctgggattacaggcgtgagccaccgcacccagccaaaatgtgttagttttagtagttgtcattctactgttagaaataaatttcccttctcatttttatttagtgatttattcagcactaacattgactcgtgggttcttattttatacaataagttataactcattattcgttttgatgctcaaattatctgcggatttgatcaatgcaagctgactgtaatgtcctttgatatgcccttattattttctgagtattttcttactttttggcttttttgtttattcttatcttttgggtttatgtcatactttcctttccccaactgtggaatgggccacttcttcaaggagtcctggtcctttttagttggggaatggtttttagaaatcaagatttgaatgttaggtgtgctgatttctttctttctttttttttttttttttttttgagacagagtgttgctgtgtagcccaggctggagtgcagtggcgcgatcttggctcgctgctacctctgcctcctgggtcccggttcaagcagttctcctgcctcagcctcccgagtagctgggattacaggcacgtgccaccatacccagctaatttttgtattttcagtagagacagggtttcaccatgttgggcaggctggtcttgaactcctgacctcgtgatccacccatcttggcctcccaaagtgctgggattacaggcgtgaaccactgcgcctggccaggtgtgctgatttctactgagatgtcatttgttcttcgagcagacagtgcaggtgtatgtgctgtgtgcgtgtggttcaatccttcctttttcatagcaacttcaatatgtttactgtttttagttatgtactcatatgtactaagtgttacaatatatatacaaaattgtttcagaattgctacccctgaccactgcaaataacaaaactactaaggagttcaagatttatttgtagttctttttgtctttacattgaagttaggtggtcaaatgactccgtttagttatttggattttttttttccttctgtgagcttatgttactcatttgaaatatagttttatatttctttgtagtcagtatttattttcaccccaagtatgtgttgatttaattttattttaattttattttttaaatgtgtgtttttttttttggctgggcacagtggctcatgcctgtaattccagcacttcggggttttttgtttgttttttaaatcttttttatattaatagagatgaggtttcaccatattggccaggctggtctcaaactcctggcttcaagtgatctgcctgacttggcctcctcaaagtgctggattatgggcatgagccacggcactgggccagattttttttttttttttttaagatggagtttcactctcattagccaggctggagtgcaatggcatgatctcagctcactacagccaccgcctcctgggttcaagtgattctcctgcctcagcctcctgagtagctgagattataggtgcccgccaccacacctggctaatttttgtatttttagtagaaatggggtttcaccatgttggccaggctggtctcgaactcctgaccttaggtgatccacccgcctcagcctcccaaagtgctgagattacaggcgtgggccaccgcgcccggccggccaggttcaattttatttttgaatacataagatacattaagaaagtcctcaaagttaaaactgtcaaaaaaaaagtatgctcagaggagtcttactgcttctctcccttctaccccgttcctatccatccctttatttagataaccagtgtcattggattgtggttatcctttcagtatttctttttgcaaaaataagcatatttatacaaatagttctttgttgcacagatagtagtataatatgcatatacacttataatctgcttttttcacttaataatatgtcctggaaatactccatagcaattcatgaaggtcatcctttttattttttccaactacatagtattctgttgtgtggatgtgctatagtttaatctcctgctatgtttgggcatttaggctgtttttaaaattttctgattagaaataattgttcaatgaataatcttgtgcagtattattggaagtatatcatcaaggtgaattcatagaaataggatttcagggtcaaaggataaatgcatatgtagttttattagatactacaacttcacaccattggatttgtaccattttgcattcccatcaaaaatgtgcaaatctagctctaacattttatgattttatgaaaatattgttcttggccaggtgcagtggctcacgcctgtaaacctagcactttgggaggctgaagcaggtggatcacttgaggtcaggagttcaagaccagcgtggccaacatggtgaaaccctgtctccactaaaaaagatataaaaatttgccaggcatggtggcgcatgcctgtagtcccatctactcgggaggctgaggcaggaggatcgcttgaacccgggaggtggaggttgcagtaagctgaaatcatgccaccgcactccagcctgggcggcagagcgagactccatctcaaaaaaaagaaaaaactgttcttggccaggtgcagtggcttacgcctgtaatcccaacactttgggagactgaagcaggaggatctcttaagctaagagttcaagaccagcctgagcaacatagggaaaccccatctctatatttaaaagaaaaagaaaataattgttcttgatttctaggaaattacattctaggaagttaggctggaggatgagagtggaatgtaattgggggtggtgcagtgatagaataaaatgtttataaagatggaactgttaccaatttttaacattcttgcctttatgaaaatattgtctacacttagttgtcttaaagaatgttttctttctttcttttttttttttgagatggagtctcaattctgtttccccggctggagtgcattggcataatctgagctcagtgcaacctccgcctcccaggtttaagcgattctcacgtctcaggctccccagtagctgggattacaggcgtgtgccaccatgcccaactaatttttgtatttcgttggagacggggtttcaccatgtttgccaggctggtctcaaactcctgacctcaggtgatccacccaccttggcttcccaaagtgttgggattacaggcgtgagccaccacgcctggccaatacttttcttagagatagactatttttgcctattcttttgataatttgaatagtacagaatcagttcatgtttgttttcttcgtgcacttagggtttcttgaattcctctgagctttctggacttccagctgggcctgacagagaaggctcactcaaggatcagttggctttagcaattggtgagtatttgtaaaggttctggaaactggaaattagggactggatctcttgttatcttgttcctccaaatctaggtcaagaatcatgtgcctacaagggtcagatgatacgaacgtgagaagtggtgtgtgtgttagatgttagggaacattaggcatcttttttttttccgagacagagtcttgctctgttgcccaggctggagtgcagtggcgcaatctcggctcactgcaagctccgcctcccaggttcctgcctcagcctcagcctcccgagtagctgggactacaggcgcctgccatcacgcctggctaattttttgtatttttagtagagacagggtttcaccgtgttagccaggatggtcttgatctcctgacctcgtgatccgcccgcctcggcctcccaaagtgctgggattacaggcgtgagccaccgcgcccggccacattaggcatcttaaagagctcatacgctgctggaggaagtcccattgccaagctgtaaccaattgttatatctagggaaacggagtcctggggtcatcagaatttctaaattccttaaaagaatttagatttgtatccaaaatctcacggattttggctgtttgcaactaattaaaattattttcatcactgtgccaacaaaacaaagcatgtctttaggcagagatggccttttgacttccagctgagtacttgagtatatgctgtagggaaaatagtacattaaagattatttcctcttctttataaaaggtggcaggacaattgaggagcattgtttttaggaatttgatctttcttttcaaaaaatctggttgtgaatttgtaaagatacattcttttagagcctgttggctataggaaccacatctggatcattgtggtgggactagcatcttgctttcttcctaagtatccttgatggagggtgggtggtagggaagggttggagcttgctgggaatttactaatctgaagtttccagtcaaggcatcagttccgtttttatcaggtcatcttgtattatctatgatgtttcaatgagtcatgggtgagaaaccaggcagacagctatgtatgaggcttattaagaaattctggaagagctgggtgtttcagccttgtcagtttctgggaattaactattgggtatatgctttgagctattttaaaatttgttttggtttctggattctcctttttcatgacttttagatatgactatggctaatccaggcatacttatacagacccttttgtttattctcctacccctttttaccttttggcttatttggacttctgttagaagagaataacatcctgagagaaaggggaaaaataagttaaaatctgtttctggttctcataaataactcttgacaatgttatcttttctgtttttgatgagaggaaattgaaactatccgatgacatggtgctttgagctgtggactttttccggatagaagggatgatcaggagttgtctgtgtcagttatggagtattcaggatggtgggaaaaagcacctaattgctttggagtcagatctgagttttaattctaactctgccttgtgttactaggtgggttacctaagttctctaagcctaagcttattgtaatagtagctagcatttgagtgctatgtgccagatactatagttaatgctttatttatttatttatttttgagacggagtcttgctctgttgcccaggctggagtgcagtggcacaatctcggctcactgcaagctctgcctcccgggctcacgccattctcctgccttagcctcctgagtagctgggactgtaggtgcccgccagcacgcccggctaattttttgtatttttagtagagacggggtttcaccgtgttagccaggatggtatcgatctcctgaccttgtgatccgcccacctcggcctcccaaagtgctgggattacaggcgtgagccaccgcacccagccctagttaatgctccatatatatatatatatgtatatatatatataaatttttttttttgagatggagttttgctcttgttgcccaggctggagtgcaatggcatgatctcgctcgctgtaacctctgctgcccaggttcaagcaattcctctgcctcagcctcccgagtagctgggattacaggcatgtgccaccatgcctggctaattttttgtatttttagtagagacggggtttctccatgttggtcaggctggtctcaaactcacaacctcaggtgatctgcctgcctcggccttccaaagtgctgggattacaggcgtgagccaccacggctggctgcttttacatatattatttatttctccccaaaaccctgaaaggtaggtggtgtcatctctattttaaaggtgaggaaacaaaggcttgataaatttagtaaatgagattatgtcattgagtcacttgcccgaggtcatatagtcagtaaataggcagaactgagacctgagtcacacatacttgtgtcaccacaacctatacaacctatgtttgttgttttttttgttttttttgtttttggagagagtcttgttcccaggatggactgcaatggtacgatctcggctcactgcaacctccgcttcctgggttcaagtgattctcctgcctcagcctcctgattagttgggattacaggtgcacaccaccacgcccagctgatttttgtatttttagtagaaacagggtttcatccatgttggccaggctggtcttgaattcctgacctcaggtgatctacccgcttcagcctcccaaagtgctgggattacagacgtgagccactacacccggcctgtttttaagtaccagagtgcctggcacatagttggtgcttcataaaggtattcttcacttcccccactcccgctctcctgccccataccccttttcctctttctacaaaaactgaaaatggtatctcttcatcttactgcatatcctatgtaaatgcaaagggactgtcttccaaactgggcctcttctgtgcatattttggtaccatcacagacatcacaatttgttggtgtgttggttttttgtttttgctttaataggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgc

SEQ ID NO: 37761 - DNA, 25058 bp, Homo sapiens
cctccttccccaccgactttcttgttttgattaactccgtggactcctgactctttcttcgcccggaacatcaatatgtgtcatgtcattgtcacctgtcgctcgatgctctggaccttgctgagtattgtggtggcttttgccgagctcattgccttcatgagtgcagactggctgatcgggaaagcgaggagccgcggcggcgtggagccggcgggcccgggcgggggctccccggagccctaccaccccaccctgggcatctacgcccgctgcatccggaacccaggggtgcagcacttccagcgggacacgctgtgcgggccctacgccgagagcttcggcgagatcgccagcggcttctggcaggccacagctattttcctggctgtgggaatctttattctctgcatggtggccttggtgtccgtcttcaccatgtgtgtacagagcatcatgaagaaaagcatcttcaatgtctgtgggctgttgcaaggaattgcaggtaagaaggcaggaccccgggcacggtgggatggagggatggagagctgccggtgcagcgcactctggtactgggcattcgcttcctgctagttttggagaagaccactttctgtctattcaggtttcctttgccccttccgttctaggcgacgtttgtgtgctgctcgcatgggtctctttcccctgtcttaccccacaggaagacaggcttgttctctggtcttacgtggtcctcctcattgcttatttcctcggggtctaagctgttggttttagtttgagtaactactcctgctttttgtttttcccattaaattaaaagcatgctctccacttcagtgcaactccctgaggaattatggagagcgtgagtcccacctgcagcaagcactttatgctaagaggaatgtaagcgggggcgctcattaagaagcagcaagcctgctttccgcatccactctcagctccagcccccagatgatttcagcttgggtgggaaagacacgggctgggaaggaattagtatcagctgctctgtgtttagtgatgttctggtttaaattgtctgtctcctagagcctgacagaatgttctgtgcattcagatcagaaaatgcaagcgaactcttccattttctgggaatttctcactaacgagcttattagaaatgggtggaaagtaaaagcatgagctctttacagtggtcccagggagaaggttgtgagctgcaggaaagcatccactgctaccagtattttcgtaggcttccccgcatgggtttgaaaggtgagtcctgaaccaatggggtaacaatctgtctaggtttgattcaaggttcttgttctgggtgacagaaattcacacacaaaaacacatggctgagtttgaatacatccccaaagaagtagagtagactcttgctttgatattcagaaaacaagtgcttactttttaaccaagacattaatctagactctaacaggacaaagttacccacctacaacactaaatgaagggcacaggtgattcatccctcagcaaattctagagctgtgtgcacaggattcttcaaaataaagctatgcattgagccatatgtccagggctgtaaagcagcagcccccaaacgaattcactctagctggcctcatagcaaactcttgagctcagcagggctggcttccaaataaacagatcaaatgacagttttttcccaaacagccgataagataaagtttactgttcctcagatcttaggaggcccctgtgtagggtggaggtgggggatggggagtaatgggccaagagaaatgacagagggcctgctccttagttctgatttgctttcatgggggaatacaccatccagacaccaggccctttaaactttctggcccaaagggacaagtctcaggtccctcatctctacatctgccaggatcagccacaccacaagtgactcaggcactcatggaatttgggagaccaggattctgtatttcagcattgctcctcattagcagtttcacttgagataaatgtaccaccccgggtctcagtgttctccttctgaaaaatagggagattggaaaatgtgaccttcctttggactttttaggcttagagtttgattctgtgaagctccttgtccccttttgactcacttctgaagatgactctccccttcagcttggcatctcaccacccagaaatattaaaggtgggtttcaagattgattcatcattttcttgtcagagaaatatccctgctttattctccttggacacacggtgcctcaggggcatgtgtgtgtgtgtgtgtgtgtgtgtgtgtgtgtgtatgcatgtgtatatcttaaaacttttgcagggaagtattactgaaggcttttgaagagtcaaacatgtagctcaagggaagccagcacacactaattattaatcctgttgaagagccctggttgaccagagagtaggatttctgtttagttttccctcgctctgttgtatttgcacatccttgatgatttcatgcctttattatgggctttattgatttgctggtatgtagatgagactcctggtttgtcatgtaggagtgcttcttatcctgaggaacttgatggtgatctaactaccttcgagcaaaccagtggccatttactggaaggggtgggacatcttgggccataacactaaacctatctttggcagtcattcagaagcaaagcataggtatccttcaagactgtttacatgcagtttataataaggcgttagttgagtgaattccatgtctgagtgtggattagtccaacatattttggtactctggtgtgcatcacattaatggcaaggtgttcattattgcacaaagattagtatggctctcaggtattatttgaacactccagtgagttttctttttctttttcttttcttttttttttttaagacagattctcattctgttgcccagcttggaatgcaatggcaggaacttggctcactgcaacctccacctcccagtttcaagcgattctcctgcctcagcctcccaagtacctgggatgacaggcacctgccaccatgcctggctaatttttgtatttttagtattgacagaatttcatcatgttggccaggctggtctcaaactcctgacctcaagtgatcacctgcctccgcctcccaaagtgctgggattacaggtgtgagccactgatcctggcctccagtgagttttttctgacttttctctctgcacaaggtctcttggaggaaggttgaggagaaagaagtgggagcactgctgagggctggtgctgatcttctgcctctttccagtctggaagctttaacttcctccctacccctgttacttatgcagcatctcaaaaattctgaaattactcagaattttaaattggcacaaggcagagattcctgcatagtttgactgctgtctaggagccactgatctaagactaagtgctgaaatacaggaaagaactggtttcttttctccttccagcctagcatcacccctcagagaaaaaatcataaaaaagagggactgagctatccttctcatgattcagtgggcactttctcccctattggaggtctcatcatgcacatcaagccaatgtaaagggcagctgtggttcttgaatctgtggctgaggacattgccatactggcatctgaaagggctggcttgctttctcccgttggccaatctgtgatagcctctggtcagccccagcctcagcaaggacttgctgcagctgggagcatctgccttttctctccctatgccccctctccctcagccctggatctcttcaacactgaaacaaatggtgagaaaggaggctgttgccagagcaacaaaaggattctttagaaatacactcaggctgtgtttgttcttacaacttacattttggcaaaaatgtgactggatgagaaatgatcgtaagcatattcttttgctacacctaattttaagatataaataggccacaggcttgtgtagccttcactgtctataaaaaaacacagcataaataatcaaaatcttgatattctgagtttagaaactgggtgtgaaagaatctgctacttcaatggaaatcccaaactctgggctaacttaagcagtaatgaaatataatcattgcctgttatgtgaatccagatagcaggatctgccttcagggcaccattaggtggacacccggctgatactttctaaatactgtgcacatgtccttgacattcagcactcactcagtaatgagggttcaggcctcacctgaatgtgcctgtgaaacacggaccaatttgcctcacttttctgaaccatagttttctcacttgtaaaatgggcataacaataggtttatacctcaggactgttctgaggattaagttagataatatatgagaaaggcttaagcatagtgcttaacacacagtaaataataaatggtagctatagaatcattatcaaagtatttctgctttcttggcaagttttagtatattatttgtttcccggatttgttgcattctacggaacagggatatcttgtagcttttagaattgaccttactctgttccaatcaaacacaaatacagtgtgtaggggccttccctgtccttaagagcctgcctgtgttggagctcagggtgcacagcagtcctgtggctttggtgtaaccaggggtgtcctcagatcatttttttaaaaggcaggagagagcagtcaaattgacaagaaaacagagctccttcctccccctccccttcccctgacacacacattttccattccttctctttctggaggcagcttctagccgttgagtgttgattgcaggtggcttctgagattctcctggcggagtaaatcacaggttgattagtcttcatgaggtgagaacttgtccaaggacttggcagaggcagcaacacacatcagtttgcatccctctgggattcattacaaaagccgggtgatcagccagcagggttggctttttgccagctgtcttccttaggttgtgacctggatgtaatccatcgtgaaaccatagaatgcaaagatccaggttttccatgacaacatcaagcagtttgtttttggaaatgcgtgtagggctctcttagaagtccatggaatccccagtgactcaggtttgggaccgaagccattaaactgagctcaggatttggctcacttgtgctggctgggcctattccacagggactgccataagcatgagccaccggccagctgcctgctatcttccagtcttccctttatgctgggctggctctcacactctactccctccagccctctgcctgcatgggtctcagtccagcaggacagccttagcaagctgccccaccagtctgaccagatagattgccctggggctgaaccctgcctctgcagggctggggtgaagggtgtgtggtcgtgggaatggcgctggcagtggcggtgaagggcctggtgtatgcaggctcagccttcttggaagtgagcaatgattgagggtgaaagaggacaacatgaaaaaaagcaataaaaggaaaagcagagacagacacgtgggggttttgcctttgctgcttatataattgcttttgtcataaatctgatgcatggaagtatgggtgggcatacgaaatgcagctgatcactctccaggatttggtattcttactgctttttacacagggtaaaaaatcaccttaagcatcaaggttatgaccatagcccaaccccatgactgatctcatgccctactcattcactctcaggcccaaaagacaaggtcagccactgagaggagagaaatcagaacaggggcttgggaagcatagggagatggacggagatgcctggcacacatggagccctgcctcagaatttttctcctgaaaaagtcaccgggctttctctggggtggtgtgaccttggttgcccaccttcagaacaccctcaaagaggcatggggagagtagagggaacagcccttccttttgttcctggtgagcacaaggccctgaggacttctggctgccaaagggaggctcttggtttctggctgtccagacagatgatgctccaccagaagtcaggtccaacagttccgtgtctgaatcagttttaaaataccactgataggacacatttcctaattcatcagcctttagtagtcccttggtaaaaagtaaaaaaaatgcagacatgttatgagaaggtaggtcagaattcaatttcagtcctaggcacttgtattggatgcctactatgtgcagagacctgtagacgcaggtctacaacttgctgagttctgcttccaggctgtattagagagtcatcatttcacaaactgtaccatagagaagcaaaagaaatataaaataaataatatataaagggaatgaagaattcaaccatatcataaataaaaaaatgactgctgaaaagcaagtggaccaagcaggtattaatttagtatctctagagatggggacctgtgtttgtttgtttgtttttgagatggagtttcgctcttattgcccaggctggagtgcaatggctcgattttggctcactgcaacctctgcctcccaggttcaagtgattctcttgtctcagcctcctgagtagctgggattacaggcacctgccactatgcctggctaatttttggtatttttagtagagacggggtttcaccacgttggccaggctggtctcgtactcctgacctcaggtgatccacctgcctcggcctcccagagtgctgggattacaggcagagccaccgcacctggccaagacggggacctgtttttaaagaatgagttggaaagtctggaaggaaatggcaaactctcttaaaattctgatatagcagttgatatgcaaataaaatgcaaaagtggtttgccatggcaactacttaattgtcgacataaattatcacagagccatggatgatctatattcaaattacattaacaaataatcatttaagcatggccctgaatatttacatgagcagttctggcactctgttgtaggggcttaatgcaaaggtggtattcttttaagctataaagccacttcaaaaataatctgcatcttctatgaagaactgtcctacagcgcggtcagccacatttatgagctcatttatgtagatggtcttcccagtagctttattaaatggccagcaacttttttcttttaaagacagccaccattacatattaaatctaaaactacacatgcggagaaaatgaagccaatattaaaatgctttaagaatcagtacaaatacgtgtccacaactcttaagtaatttcaactcaaaatgcagagtggctgtgtgttcagagtgacagaggccacgttcagggacgtagtgttgaaaagacagcacctggtttgctgtagtaggaattatttaacattatctgcacccaaagacctcagcaggcaagaaatttacttgtcctagaaattccatagctttagtaactatgttttttaaaagtgccttttaccttgttacacattacattttgcagtttattttggtaacttactttgaattatcaatgtattttggttatagtcgagcaggagctctgtctttcgtgatcctgcctgtctgatgaataacttatggagaacgtatttcataaagttctttcagttgcatgtaagccagttaacaaacagcttctcaccccgaatgtgaagtaaggcttcatcactaactgatgggaaggaatcatctggctaggttagtctgttgagatgtatttcaacgttctagagttaaggctttaaaaactgctagcagaagtaatttgcttttaaacaggaattactgctgagaaagagggaggcttcaacaatggagaaactgcatctttcttctagattgtttctccacatatcctaagggcatcagacaatttttaactgatggccattaatttcaagtaattataacagaaacttcctttggggaccttggttgtaagatctttttatgacaactatgctctgattgtcttctaaagaatgctatttatgttcatctgtcatcttgtctccaccctggagagtgtttttcttgccaactataatatcatgggagtatttttagtagaaaatggatatcttactagatttctctggggaaacagcaaaagcattaatgcaagcttcttttttttttaattgacacttgaaaataaccagttccttccctttttctcttgcttgtctctgaaatcttactggttaaagcttctaaaattattgatcatgtactaaaataacatgtagatacctgctctcaaagatgctgtagtcattcacaaaaactcttttattgccaggaaaccctttgacttctagttcctgatctggcccctggagctaaatgagttactaaatgtcgacgttaagcctggtttagcttgtccacgaactcttgaaactttaaaatgagatggagtaagccatgtaggctcatgcctgtggtcccagctacacgggcaggaggatcacttgagtttgggactgtagtgcaatatgatcacgtctgtgaatagcaactgcatgctagcctcgacaacacagtgagacctcatctcttctaacttaagtttggacctagactccaaagagactcagagcctccttaccatgtatcttgatacttgcacagtaaataaataggcttcttagaaaggggtccgcatcttaacgcaggtaccctctacactcccccatctcttaccccgcagaagggccctcagccagaagttgcttcctttgaacgagtgctggtccactctgtgctaaggcttctcccatttcacggcaaaatcaaggaagtttagtaagtgtggtaacatttcatcaagccgatgtattcacttcaaagaaatgtcatttattttccaattacatccttcacccttcttgtattaaaatattcttttatgaaatgatgagaggagataataaaggctattttcagtgtctttattagcaaaataaaaaatgttgccctcccaacaatctttctggactgtaaagtccagaaagtgtaggaaccactgttttagaatataaggaagtcccacaagggtgtgacgtgtcttttcagttatacctctagtgttcagaatggaacccactacgtacatagtagatgctcagtaaatgtatgttcgctgacaggcacatatctgtggaaccactgattagtctcttctagccccagctgtaaatttataggtgttggaatttaacgaatgccattaagtctcaattctgatatagacccggccctcctagacagttatggcataagtaactgatgagccatcatctgaagaatcacttcagaactggtcatcactgaaaccaaattctgcttggactttgaaaaagttttcattggagaaccttaatgggcaaaggtatagattaaccaaaagtgatcattattgggcaaaaattcttgattcatgttataactcctactttgttatattacttttatttattcagactctgagtggctaactgaagttttggtactgaagatagcagcccatctggcatctggggaagacaagcaggattgaatacctttgctaatttcatttgggcttgtagggtacagaaccagaactcttcctgggtggaaggaagagatcttgcctccccccaaccctcggtgtttacagttgttctaagcaagatttcacgagagccagatgcctgagattatgagcagcttcccctgcatgcagacataggaataagcagatccctcaatgacatgggtttaactaacacccactggatcacggatagtggtgcaaggattcaggggtaggaggcaatcaggaaagacaaagatcatctagctctatgaattgagaaaggctgcttgggaggtgagatggctgaacagtggcctgacctattggaggagagatttgggactgagatgctcattgcccaattttgtctaattggctacagatggctttcttggatgtgtttttttatgggtgattttgtggatggcattatttttctggatggatctgtaatttcaaatggttcccaagcatagaagatctgagcaaaaactaagtcgtcagttgattatactgcctttttttttttttccttttggtccagtgggtttggtgctgtttgcagttttctgctcacacaggtgttccacattctgtacaaggttcacatcatagtgagccttaaattgttctgacctgttcattaggcttctttctagaagttggtcggaccaagggcagccattccaaagtggcatctaatgcttcagtaaggttggtgacactcagatcaaatggaagagagtggagatggaatttctttatcttgctgttgttttgcaataggattagcaagtcaacctgcttgacaataggctacctttattttggtgcagtcttccactctccataacccctcacggcactcctgtggtttctcacttgataacagttccttatcacctgctctctaatccttgtagatataactaagcaagcttttgaatgcatatcagtctctcctcttcagctggacaaatgtttttgtcttggaagttagtctctggtctgcagtaaaacagcagtctaggataaggctcaggaagtggactctggagccagattctctaatttgagtccctgtcctgccgttgattaactgtgtaaccctacttagcccttccgtgcctcagtttcctcatatgtcaaatgatattagtagtatcagcctcataggattgctatcaggactgcatgagttatatttaaagtgcttaaccagtgcctagcacagagtgctcaacaagcatgaaatgctcccattgttagtgtaagttatcttcatgattattaaagggttctaatcatctttacaaacttccaactaaagtatccattgtgaatgtatattataaatttgggggagggtgtttatagtttcatctccatttcatctttagagtctatcatttttactatagaagacctttccagaaggttcttccaaagaagtgatgcttggaaaggaaatgggcatcagaaatggcatgtgaagctggtcaacactgccattatgtgtagaggactgcataagaggcactgagtgtagatggggatagggctggagacatagaaactgaggaataggaacactctttaccactatcaacacgtttccagtggaatcgtagttcaggcctccagtctgtcttggaaccagtgctgttttataatgggacaagtgcatctatgtcacagtaagacttctgttttttacaggatagttttccagatagatggttatccactttttattatttttacccaagacattcattctaaattgtatcatgtatgtctctttcttctgaagtagggtgtctcttgtcttggtgagtaaggatcagtactgcagagtgtctccagagtccctgcacatgggaagtctgcaggttcacactgtggtctttgggaagagaatatcttaatggcaaattcagtggcgagggaactggatgtggtctgatacatgtgccctcctcaaagcacagtcttcagactgtctgacagtttgccttaggatattgtaaaagagaaaatatctccacctagcaacagttggtggcctacaaatagctgctaggggctgccagaatgacttctgactatcagcatggaagatgacttggggaaagattaaaaacgtagaaaacagagggaagcacacagatgagcattaaccacacacagagatgctgcttattactcagtcaccagttgttgtacacttgactgagacagatggcctgacttctaaacatctactggaaacagaaaaacacacccccaccctgagaggttgatctgcgatgctgccaagaggagtgggcgttttcctgggctgcagaacagttctgcatcctctgcccatagtgctggtaccttcgcagtggtgttttccgttctccaggctcacactgctaatatttaccaccctgcctctttcacaagtggtcgtggctcacctcattcccccacgtatcctttgtcttctctcacctgtcctttcccgtccttctcccgcgtgctgctcctctcctggccagtgcctggccagctctcacaggtcagccgcggcctgtcttggcagctgtccttgctgcagccaggccaagctggaaacaatttcagagatctgagcctagactcaggctggtgtctagatacctgaaagtgtattacatttaatcaactgactacttttttctgtgtgatttcctaacaaccaggtattttctgtagccaggaaggttttcagtgcaggcagttatgcaaaagaccagtcctgtggtttggtctgcacatgtgtttcagtagtaactgtgtagctggcgttctgttggccagaattgcaaactgaagcttttcctccaaccatttcaaaaacttgtcaagaactttctacaatggctttgtttaaaaatgtaatataatcacatcaccttatcttttcattcatccattcaaatcagtgaatatttactaagcacctgttacatgtcagaccttgttctaggcagttgggacacaaagaacaaactgcataaagttccctgtcctcatggagtttacattcaagctggcgggggtagacaataaataagataagtaaactatatagtatgttaaaaggtagtgtgcagtagggtagaggagccaggagaaggtgtagcccgggtgagagaggccggggtatgctggaatagtgagagggaatgttgaagatagttagggtaggatttattgaaaagaagagatttaattaaccacagccttaaaggagatagaggagttagccatgtgggtatcaggagaaaacattccaggcaaagggaacagctagaatgaaggcccacaggctttgccgatagagtaaattgggatttctgagaaaggagtcaaagatgatagcaaggtctctggcctgcacatgtctaagaattgaactcccatttgttgagatcaggtggacaaggtgaagaacaggttttgagtggggaatggaaatcaagagtcctggtttggacataattttcaagtgccttgctagaggccaagtagacagctggatatgcacatctggagttcaaaactggaaatgaaaactcagcttggggtagtacttaaagccatggggccagctgtgatcaggaggggaatatagatagggaagaggaccaaggagtgagccctgggcacccttgtgtttagactggaaaggtaaagggggagcagcaaagaacaccaagaaggaaaagccagtgaggcttcccatctggaggcagagcactggctgatgatcttaaattcatatgagaataactgtcctgtcagagttttcctttattctagtaccatcagtactttgtgaagctgtccccactgaaaagcctggaatgctgtctaagctgtgtcatatggaacacaggaagcaacttagtggcagggcagcccttgggcattatgctgtagtgagctgtgctgggtcaacaagggctggggctcagacttagctagatccacagccctctgagtcacagggcagaccaacacaaaacactagagggatttgttttttattttttcagaaaaatgttataagagaaattgatgtttaatagttagatgggctgctatgttcctaaaagggccaatggccagctatttcaaagacagacagaatatgaactcttgacctagttgtgtgacacacctagcaggtttatcagtgaatgttaaggcaaagttgcaatgtctcattagaattcgtatcgattctaattaacctataaccaagttcctaaaaagtgtcacgaagtgtgctgggtgtgggagataccaaagcttttctgcttcaagaggctgagtcccactaggatactgttgtatcatcagggttgagagtaatgccctcagtaaacagctattgaataaatttttaaaagtgagaaagagctcaagagggatgtacgttggaggtgggaacacaacgagaataaccctgtggcaggaagtggtgacaaacatttcccggggaggcaacatttgcattggaatgagggagagaatgcccagatgcgtgagcgtccaagggggtcactgtgaataacaggcccctgttcgaggaatggtgatgtgtgtagtgtgaccagattgttgactatcaccagcctctgaaaccctacagcatcccactcctataacccagccatggccatccataaatggtctgtgaaggcaagcatatggcatgcactccgtggacacgcttgggaacttcccaagtggggcccacgttgatcagaggtactttacatctgctgtcaattgtctgctgtgaactctctccagagacgttccgatatttcatagctgtggaataagctgtttgatttcgacttagtaaaggtgctgagtgttggccctctcagtggtggcctctccacagattgctggtagtggtaacaggtgaccttcttttgtttctgttcttagaatttcctttgcaagctgaggtctagtctttaatatttagtctggaagcctgtgtgacggggaagtgggagtgtggtgtctaaagactcacttcttcagacagttactctgtggaacaagagccagcctgtagtgctcccttttcaggcaggaacaaaggcctttttctgtacaaatggttggtgacccacaaagacaagaaaccttgagtcccatccattggccagcaggtggtgaaggagggtagtaatcatgactgatgtggagagggtgggttggtcagggaaaggctgtgaaataaccatggagccttatcccacttcttcacaaactgaaatgctgtggttcagagttggctcctccattcctagcatccctcactgtgagactgacatggtcaccttcagacccagtgaaatactcactgtatgcagcaacatctagccttccccaaactgggggactggcaggactatggaaatgcttttcttcccacctaagggatttgattaaaagtatttgatatcccattatttgattccagggcagtattttaaaaatttacctaagacataaatttgtgactggtctgatcacactcagtgcaaaatgttgctaggaaatcaggactgtgacttggcttttcctggtgtgtttcctacgtttgcattgggaacacagtgataaaactgtgttcctctgtgtagcctctgccctcacggagcccagtctgattatttctgttaaatgcaaaccacgtatttagattccccaaagaaactctgaagattcttgcacgggtagataaaacttctgtgaggaaaatatgaaaatggcagtggggtgtggcaggtgctgcgctgggatggctggtgcccagctgattgggagggcgagcaccagctatcccaatacaataccatgaccatcggtgaggttgtcaaggctctgtctccagctggaggtggcacctgttgggcagtccaagtgactgaccatcagcttttcatttgtttttttcctctacagataaggttgaatcatgtgatccccccattgccagcagatgctaacgtcttctaacctccttggtacaatgaggctgttagaacacggggatgaggatgttggagtcttttaaggttatgaaaattgttaccttctagggcaccattctgtcaagttgagccatcgcagaggtgagcagccctccaggtgacctatggcttctttccatggtggctgcgttgtctttggtggctggccagtgtcattctcccccccatttcttcttcctcccagctgggcttgctgcgacccagtcatgaatcaggtagagatgccaggcagaagaaaataaatgcccacagccctagtcccttccttcttccattgcccttcacaacacacaaacacacccccaaaacaacagtgcagtgaggcaaggtgatggcagggccccagagactaccagagagggtggcctcacttcaggaactgcttttttaatagctgcaaagggagagcagacagaccattttctggctcagccgtcatgtgaaacccagtccaaagcatcctttaccttccatttggcctctggacgtaacctatgaccaagctgatagtccctgagtgtactccaaattgagtatcagaaaaaccattccaagtctccagcaaacttcgtatctgttactgtattctcttgcctttgtctcatatgcccattgaagaagttattgattttaattgttttattagtatcaagcccatttggaattcagggcacaagattgcttttaaaacccagggctcaccggcctagaacaggatacatcaatcacccaaaggtctctattttctttcttgctgacacatttcattcttattgactggtatctcagttattttactgatttcctccatgggcactatggtttagaaatattttattacaaagcaaactgcactgtcagtaaatttttattaaggtcctgctgtgtgcccagcatcattctaagcacaggcattagagcagtaaactaaatacacaaaaatccctgccctcatggagcataaagtcaaggatggagatggataatcatcaaatggtaggttgagtcgtatgaaatgacaattcttgtaggtaaacattatcaactactgacagtttcttgtgactgctaggatgaagtctgtgcctgagggatgcttgtcagggcccaggaactcctgcccaggctgctctgaagctgcttcagcctgagagcagtggagaaccagggccaggctgggctcagacaggtagctttgcttcccactgtggacctcgtgaggggaggactacgtgtggcattcaccacagagggacacccaagtcactgatcttgctgggattcctttggtagaagaggctttatctacatacccaaagaaatgataaataagattttttaaaaaaatttatttttgcttacctgaaggcccagttttctcttagacattagtccattttacaggtgagggatcatagagggcagagcctggattcaaaccctattccatggcctcggctatgttaatgataactgtgatgggcactgggagcagaggcccgccagtcagggcagagtggacagtggtgacttcctccactgccccacggagccctgggttaaggcgctcttgtgcttgtcggggctggctgcccaggttgcagcgtgtggttggcacacttcacacccacagggcagatatacctcacccgctttgtattactctgtcacatggactttcctgtgggcttataaatattcaagctgaagctttccacaggctcacaagcatggcactcttatgtgacttaaacaacagcaagagtctccctgctttacttattcacaaactgagccaggagcagccacaagatttgaagatggcctgaagcccctcagcagtcacacctgagccattagaaaagggagcgcctcagggcaattaatgctcctggctgggctcagcacgctgtggaaaggagcctgattgctatcaaaaataaggattgtattaagtgatgtaaaacctgcctgcttccccagagaacccaagacagccaaattaaggtattttttgtgccttacaaactaggcagagcctgacacaaggtggcagagctggtatgtgacagcaaactccatgctttgtcttctgtccctaatatattaaagtgcacatataatacaagtgcaatgtgcagttaatgttgaattggaacaaaaaatatgaacactttggtcttttaaagggaagagcagctaatgctgcctcacctcaggcctacactcagagctttagggcagaggctacagcacacccaaagtgcctttgcgtgccgggctgggggagattgtacagaaggcccatggagggtacaccagagtggcaccttaggacctggagggagaagactattaacatccccatcataccttgtggggaggcttcatagggaacaaagtgggatgcagacaagattaattggggtttatcataggccttagaaatatttaagaattggttaaatcatttaagatctcagctgaacaaacctctgttcagatggagaatattttttcaagagtactgaatgtagcctggggatctcctctctccccaaattattatacttctcaaaatatgcccttaacaatgagctgatctgcttctgtgtgagaggggcctgccgagggcttttgacctgtgttcaggctcatcatctgtttccagtttttgttacgatggtagaacagacttcacaattcacagccacctatgagtgatggattagtccattttacaggtgaggaatcgtatgtcggtcactcagctcatacagggcggagcctggattcaaactctaaagtcagagctcttaactattaacagaatcacctcttaatttggtgagtctctgctgtggtccaccatatttctggtttgtgttctagcctcctgtcctcacactagactatggggtcttttctgctacttgatttctaccctttcattgctgtggttcaggaccttccatattctagacgaccaagagtctgcactggctgccttagccttgggggaactggctgctggtcatttctaacagcctctctccagcttcacttgctcttcccagcaccaatcacatttccttgctacaactcattgcctcccaggttcccaccattcagatctatagagagggccgtggggttagaaagacttccttgtgaatcacccctcttcaaacaatgagcatctgaattgattccctctactccacccctgctacaaagtcccttgaggccatctgagaagaacaatgggatggggtggagacactgaaatcccaaaatgccctggtagtgacatgccaagctggacaccatcacaggatgaagaccactgtgaaagttgtgatgtgtaagttgaaacactgtccccaatcttccttcacgcctcatactgccataaagtcagtcatgttttctttgcggggaagttgctgtaaatgacttagaagctttggtggggtaaacccagagaatttcagttaaggtaggtaaagaaacagaactcagagccaagatgccaagattaattcaccaggatagaattgatattccccagtatctaaaaagtgggaactttgattatgatacagcattcttgattacataggttgaatttttcagagaaaatgtttttgccctcctcctcctcttgcagtatcttgcttttttttttttttttttgagagggagtctcactcttttgccaggctggagtgcagtggcccaatcttggctcactgcaacctccacctcccgggttcaagcgattcttctgcctcagccttcccagtagccgggactacaggtgtgccaccacgcccagctaatttttgtatttttagttagacggggtttcaccatgttggccaggatggtctcactctcttgacctcgtgatccacccacctcagcctcccaaagtgctgggatttcaggtgtgagccactgcacctggcctaaagaagatctgttaccaagaaagttttaaagttttgctgggtaaaatctgggggggcctaggttgcctttgtcatttcaggcctctggcttttttgggaggagctactgtcatgtgactggcagccagggtgaggcacccactgcaggcacagggctgatacctgaaggtcagcaagcgactccttttgtggctcaccctagtcctagctctggtgggactaggcaggaaaaataactcaagtgatgcattctggttatatagtgagcagtaatgctgtgaagaacaggaaaataggtgtttaaaatgacaaggtagtagggtcagcaaaatggaagtaaagcttattagtgtccactctcttaaaagtacgcagacagaaagtccttacaaagtttgcaatttgtttgtaaatgtgtatataaatacagaaacatctggcttacttaaagcactaacaatcaggtaaagacctggtctccctcgtggcccttgctcttgcatttaatcaggttgacatcagatggttctgtgtgaatttccttagaccaggagttggcaaactctttctgcagaaagccagacagtaaacattttagagtaaacattttagattttgcagaccatagcaaagcagtcgtaggcatccaaaaatgaatggccacagctgtgttccaataaaactttacttataaagttaacatttggcttgagggccttagtttaccaacatctgccttagaccaaaagagaaatgctcagtgcaccaaaagccctgtgggaatacatagtaacaagttggccactcgtggtggaggccgaggtgggaggatcacttgagcttaggagtttgagaccagcctgggcaacatagcaagacctcatctctacttaaaaacttagccaggtgtggtggtgtgtgcctgtaatccgagctacttgggaggctgagacaggaggatagcttgagcccaggagttcaagtgcagtgagctacaactgcaccactgcactcctgcctgggcaacagattgagactctgtcttaagaagaagaaaagtaccaatttgcttttctagaagagaaatttttagtggattcacattccaacatgtaaaaaagtggctgaaaatatttctaataatgtgatacttcttgatcaggtcagattagtttgcatgaaacagtcccaacactttctattgcagaatagatgcccttgcccaaagcaagcaaatcaagtaacaattacaacagatctggacagttgtagcaccatggggattttctaatctgttttctcttttgttctgcaggtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaatctgatctgcctcctttagtttggaagagacaatgccattttctcccttgagtaatcttgtgaaacagtccacagtttcatcatttgagtcaagtggagaactaacctttacctaccaaagccacgttccacggcccgaggcttaaacaggaccaatgagaggccacatccagctacgcaaagttactggacatgcggtctgcagtgcacattataaggaatggaacatgaaaatagtatataatcctagacctggagttgccaagttctgtcagactccatctcccccaggttcaatgaaggataataatctaaatcattagggcagcagtttctctggtaacggaagagaccgtccgccagatctgcaggctgtttctgctccaacactgcttgcttgtgagcatctctgcctcagaatggggttttgggttggagttcttgttttcctctgttctttcaagttgtctccaacgaacagaaaactataaacttactggggacaggatgtgtgctaaagggcacagcaagacactgtcttttgcttagctgaccaaaggggtcagcagggatggcgtggagtcatgctgtggaacttattctaggctgaatcctagggtaaggtggatcaactgaactgtcactccagagattttagaaatttgagtaaagaaacaataaggacctatacaatcatatgagaacaaaaatatgaaatcttgctagtgaagacgtattttttcttcttcccagcagccaggctagcaccagttctggcccagtctcctcttcttctggagatcacatgtttttcttctaaggttaggattgtgctttgactgcgaaaggaaacctcactgtttcctccttccagggactgaggtctccaagctagctgtggcttatgcagatgttcactgggaggacctgccagaatctcggcacttggggggagacctttactcccagtttggtgaccatgctgtagtcagctctatttccaatcccgacagtagcagaatggcattctacaacaaaaagaagctagttatgggagttaagtttttgtagttactggtgttgatcctgaaagcagactgagataacattaaattgctgcaactgaagaactgcagccaagaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatcatgttaaagctgtctgagtctaaagcaccgtatcttggtgcagaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattc

SEQ ID NO: 37762 - DNA, 6464 bp, Homo sapiens; identical to SEQ ID NO: 35826

SEQ ID NO: 37763 - DNA, 25507 bp, Homo sapiens; identical to SEQ ID NO: 35630

SEQ ID NO: 37764 - DNA, 62085 bp, Homo sapiens
ggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagtacggcccgcccgccgcggtcccctgcctgccctgccgcccgggagctatgcggcttctcgccccgccccccggccctgcaccggccgctgcggctccccctcggccgccccacccccgcctttcccgcccgccgccttcggtccccgcgccccccgcgcactgccccgcatccccctccgcgccctgcagcaactggcggggccgctgctccccacgcgccgccgcggacaccgcagaccccggaccgctcccgggtgccctccagccccgcccctccgcacccttcaggcgcccccctcccgaccacctcccaacgctgcccggttgctcactccgcaccctgaacccaggtcccacgcgcctcgcactcaggaccctccccagccctgcagccctagctctgctgcggagcccgggcgtgggggggctgtttggcgcccggccccgccccccgcgggtgccgctccaggctcccagccccgcggctgggcagtgctgcggcacccccgtcccctccccccacccctgcagtggtcccgggagccgcgccgcagcctcagcatccccctcccctccgcactgagctggccgctgcagcagccccggccccccacccccacccgcggcgccgagcccggccactgcagcccccgccccgcccgcccccccagacgtttccagagctcagagtgcgagctcccgtttgacggggacgtcaaggaaaatagcatgggaaggggagttcttgatgtctgactgtgtcctctcttcccttgctgtcagttgagccgggatgcagtgagatgaaaccggctgtgggggggtttgagcctcactttgccccatggttgagggagatttctctttcaggggatgataccctctttttaatctttccttccccgaccttcaactgttcctgctgagagaagggcagggtctctctgctcccttctgccctggttctcttggccgggaccgcagggctgtctgagatgcagcaggtgtgtgttttcagcatcgcccacccgctcctgatgtgcagcctgaggtggaggctgttgccttgcccagggactggatgagggggtgggagcgcggcacgccacccacatctgttcagtgtcctgcggtggccgcgtccttttgcctcatgttggatggtggtggtcacagcgccggtgtgtgtgcatgtacgtgagtgtgactagaggtctggtggtgggagcatcatcgtccccagacttgaagtgtgtctgtgtcactctgccctgctccgtgtcccagttcttttccccttctccctccaggggtgctttctctgtggtccgcaggtgtgtgaagaaaacctccacgcaggagtacgcagcaaaaatcatcaataccaagaagttgtctgcccggggtgagtgttccctgtcttgacctcttcctgagggtgcctccaggggccatggtttcttttgaggaagccccaggaattgggggttgtgcgttttagcacttggagaggagttggaatttcagactggttggactttgtgtcaggctgaagccagaaaaggagttgcatgggggactggaagcgcccaggtacaaaagaatgaaggaagagatgcaagtagctgcagtggcccccaaaggctcaagggagttcggtcttcagggaggtggaggatatgggggtagtgggtggtacagaatggggagctcttaatttggggcatttggagcctctccctttggggcagtggtggctactgcaggcctttcctggtccctgtgccccagtggtgacttaggatggaaatgcagtaagtgagcagctctgacaaagccagcctcccctgcccaccaggcggcagaacagactcccaagggaagggaatctgtaaacatcaggggaggctgctactggcgagggcttctcaggaacaaattctgccagatgaacttgattgcttttttgatcaaattacaaagttggtggtgcagcagcagatgtagtctgtcctgggtggagggtgatgcctcatggtctagaaatcccaaaggcccggtttgggcaggaactgcactgcctccgagtctgaggagcataaaggccaaggccttggggcctcacttgcgagatcctcccaagtacctgaggcttggagggtcagggcctgtctttcacaccttgaacctacactctctgaacttcctattgggtacttgccaaactcacctcatctgataggtgtagacccagcaatgtgtgaagtgctctgggaacaggtctggtgagtacagaggtcagatctcggagggctgcagggtgcagctgggggacaaaggttgtgaaactcagagaaaggaattagggctgggcagtaggatgccataaatatattaggagccaggacacatgccctggggaagacatgggctttggccaataatgacacgggtttctctgggataagagacataatagatgtcccaaatgcttagagaagctctacaattccacgggcttctgtcgtgttggcagttgttctgggacctgtttagcagggccgtgtccactccctgactggggactctctctccatccctctagtagggcactaattgctgactcccatccagctccatctcttgctgttcgtgtacattgcctataaagttggacttgtttgttttctttctctctgggtaccttgagtctgaggatggttgccatagagatatgtgggcagtcagataccctggagtgggggtgggggggacaacaggggctgggctctctggcagacatcctctggccaaggatggaaggtgcaggcaggaacaatggcttgaggctggatacctctcttgcccacacagcagagccctggtgcatcagaaacagggctggcatctggtgtctccagttgatgatgcaatgctttgctctcttcatctcaccagtgtcctctgacccatgggtaagagaaggagagatggctgggagccgaattctgggatgtgaggataggtgatgtggtgacttcctgcagctgcctgactggggctttcatttcctactccttccctacctgcgtaaatttccatgacctgtgtgatagcctccctttcccttcctcacctccttttaaccttgtcccatctttcccaatggatatctttccctggccaaactggatgagacttgatttctcgttgatttttttttttttcccctcaagaagaggattcttgtgtaaaagtatatgcttcagacagcaactccccctctcccaagatggatatgccaagactgggctctgttgtgtggcctcatgtgccaggttgactttgggacagaggcacagatgataggcacagatgccagccagaggggtcagaatgtgtaagtgccagccagtactgtgtggaggtgggaaagtggaaaggggctgtcttggagatggagggaacaaggtggggctggactataggtgtgggcatgggagatgtgaactcctggagagatctgggccagggtagccatgggctggttcccatggggttagggagtgagggccatggcttccctgcagactctcagtttacactatatattttataaaggtgcagccactggagctgggtttcactcatcgctgtctgcctaggtctccgcaggtgttggatttctgtgtctgggaatgtcgtgggcccaccagggtcatctgtgaaggtctgaaggggcttgctgtgttcactgggtcttcctgcctcctgtctttcttgtttgtgattctctgggctacaaactgaaaagataaaaagagggtatagagctgtttctccttggcatccctggtgaggtggctaggagtcagggagagggatcacctgttcttctgggggggtccaatcgagacaggaagccttcttttgggctgttgtgtcttgtcactgtggcctcagaggcccacattggcggctaggttgcaaggtggggagttcatgcggatatgcgttgagcactgtctttgtctgcgggcctgtctacataaagtcactgaaagtcacataacgtcactccgtttgcttcagaaccgtgataggagtggagctgggctcttaagggagcccatggttccaagcttagctccactaggccgaaggaggcatttaaaataggcttggatgcaggagctagtgggccaggtgatggcaatgataagtcgttattttaagatttaagagcacccccctcaaggagcctgagcccttatgtctttttttatttttaaatcttcatattcccttcttatctttattcatatgcatacagattttcacctcgtggagcataacattttatatcctgctctctttgcttatatccaaagcatttcccccatattactacagttgaagggcaaatggtcctttcttctacgtcgtttaggatttatccctaaaacaatcagcatcacaagaaacttctgtatatgtaccatttatctggattccagttgcttttaccaagatagatactggggtaatgcccttggccttactaagagatgctaccggaaacagtgttttgaaatctgttataatactttaacatatttatttaatctgtacattccgtgtgaagaaatttcttttgaagctaaatgtaagcaaaagctttcctctttgtgaggacctgagaggtgagggaagggtccttatgtgtttctatacttctgcatgggcaggccctagcgaagtgcctgacgtatgccagccacatacacattaaatgaatgggtcaagaggactatgtaaccaatcatggttgccttttggctttggctcctaggaaactcagagtcaagttgccagagcccttgtaccctgctacagacttgggtcctccctttctgatccagggagccaagctgcagacctgatacggctgctggaagagaggacagatgaggataaagacctgtgcttggggcataaggcagagtgggagatgtaggcagacatttagctgatgattcctccttccctgtcactaaatggcactatagggccactgttgggatctcttccaggtagtgattttcaattttagtgtgcgtaaggatcaccctgagtactagtttaaaaaatacagacttctgggctttagccacagagattctgctttaggaggtctagggtggagctgcagaatctgcatttttaacacatgctccagtgaatttcatgcaggtgaggcatgagccactctttaagagatgccacctaaaatctgcaacaacagttgctcttgccatgccctctggaattcaacagacacaccttggcccatccttctccagattgtgtgtctgccactatgtggccatctgtgcacatgggctgttctgtgattaggggcctcgttctgggcctcgggattggggtgtctgtgtctgaggctgcggcaagctgggtggctcgggttgtggcatgttggccaccagaagggtaaaggctgtccctttctgggtccagctggccctggggactgaaatgggatcccctggatggtgccagctgagagtccccgcccccttagtgttggcctgagtagcccccatgacatttgtgtcccctgtggtatctccaagtgagactttcctgttaaggatctgggtgaagtgagggaaagagaagggagggggaagcagtaatgcagggagtgggagaaggaagagaaatccacacagcactggaacacaggcctcgaggaagcatttaaggaggctgtgtgcgaaaccatgctttcctcctgaggataaaacaggccaatttctgtaaacagagaaatgggcatcctgcatatcagtgatggagcgcctctactttctctcctgaagggatggaagccgactgcaggtccctctgtgcaaaggcttctgccaggcggcttttgtcacgcggtcacgttgagctgtgggccttagcacacacaacactggcctgtccccctcccctcccacctgtcttcctagagtgacttggggtgctgcatcatggtgtggggatggaggtgggaaggttgccctgtcctgtcagggaggcccctgccttcttcctgctgcttcctctggtcccttgtcaccatacccttgttcgaagctgtgctgaaaccctagaggtgagtggctgaccccattctctgctgagactggagatagggaaggggaggctgggtgtgaccattcctgctcccatctgtatgcttgctgctctctgaacagctttggcagaccaacaagggcctgatcccatgggtgccaaaagggtggtgacaggaggagatgggcactttgcacctcttgaatgcctctctgcagagcccctttgtcacctacccatggccagacagatctgccgcaggaccgctggggaaatcaaagcacaaaagctttgtctggggtcttttttttcttttttggttttgtgctgcaggtgcccatgactttgccagggctcagacccagcgtcctcaggccgtgtggcctccacccactccttggcgcctttctttaaaacacaggttctggatactttgttcctgtgatgaatcttggcatatcacctcacacctctccatctaggccccaagctccaagcctggtggagcaaatccctcctcgttgctggctgaggccccattcccgtctgtacccacctctctgggctgtgcggtggggagatttccagccactcctccccaacaccatctccgcttcctgggccctatcagcagcagccgcagcttcccatctgctcccctcttttctcctccctttctttcccttcccccctgcttgctgctgccctgggaggagctatttttaggggctgcttcctgggatgttttacttggggctggttaccatgaaggaaatgtcaccaaaacagtgggcaaaggctgcaggcaccgggagccctgccggggggcatggagaacagacggctgacccttttctggcccttgagagcagccagagtgcccccaggcagagccttgccttcttggggcttgctagtgaccccttggggattttctctgtcaaagctgattgagggccttttcgctatagggcatttcttggagcctctcgcttcccttgccttgagatccagaggccaaagtggggctcaggtctttgtgtcaccaagttaaaactgcttgagtgagggttgaagataaggggaggatgctgggtacatgcacagagccttgggggttcacatgggaccatttcaggccccgtccctctgtatcacagcccccagctagtcaccaggtgtacatgtgtgagggcattagaaaccatggtcctgctcttgtgtgtcggatggactttgcttttaattggagactctttgcatctttagagtgagattcaaagaggaagggatgtggcatcacagtgtcagggtgaggtcggtgggatcgtggcttgggattcccactggtcagtgtcccaggcccagggctgtgcataagcagctggggaaggtggattatgacatcaaatccctgcgatgtccttgtttctgctcctcagagtgccaaggggaccagacggcggcctctgctgcttgggaagaagatgaaaggcactcaggagggcagcaagtgaggccgcctcccatggagccctgaaatcagtggggttgcaggaagtttctcacatccatgtttagggtcataggcacagacctgcaaaataccctttacaaagttaagaatgtctttgagattggaacttgggagagtcctcagtcagagtaggaatgtgcatcctttcccacgtacagaggattgtatgtttacgtggcagcaggatcttatttgaagctagtgctggcatttgtgttttttttttaggaaaatgtcactaagtcaagcaggcccatccctgagagggccatggagaatctgtggccagccctccctggccccctgacctggcagaggaaggaaagggcattggagtaggcttctgtcttcaggccagagggggaggtggttcaggggcaggcttggtgcaccccttggctgcaagctatcacctccctatctgcttcctcttttctgcctcccctggtgcatctggtcacttcttgctgcccttcctgtgaaatcgtggcaccttggaccaagtcctgaagcacttgggcagaaggcgggagaggttgggtttctaggatccttgtttcccagggcctggctctggcctgggctcagaccactctggtctaggcaggctgctggggaaaggctggagctgcttctgctttctgctcctgttgccacctctgctaatgatggggaaaacctgcagagggctgtggttggagctgggctgaaggccggcaggggtgggtctctccatggcagtagcacacaggcaggcaggaagtggccctgtgcaaaagcgggaagtggcagttgtcaaacaggaaggggggggctgggctgtgggaggggcggggatgagcctggtagaaaggtgcgtggaggagggtccaccttggaaggtctgagcctctccctagtggttactggaaggaggggtgtctcaaggggagacacctttgcagcaccttgagatgccgagccagggccctcccactgtggaccaagcccattcagtggcctcgccctttttggggttggagatgctgcgtccagctgggatgcccttgcttttgggaaagatgctctagaaaccactactccatcctggaacccctctgctgccactgctgctgggatggaccctctgcttttttgcagccgtgggccagccctggatgtgactacaggacaggaagtgtcaggggaagagacaggagacaacagctggagaggctgggtggtggccgggcagtatgtggcagcaggaacggggagagcggggcaggtagaaactgctctgttcattgaggagagcttgtggatggcagggtgccacggctgcgaggaagaggagggaagcggacagtggcacttcctgcggcgttcccctctctctgaggagcccctgttgctgcccatcacctgcagactgtagacacaggtgggccccgccaaaacagggagggacactccacctccaggactgcaatggaggaccatgtggggagcccagaagccaggcaggagggcttagttgctgtgttgcagaccctgcatctgcctgggctgaggggacagtgggtcccattcacagtgtctctggtgatagctgtggccacaagcccagcccaggagaccctgtcaagcttctcactgggcccttggaaaggagctatatgccagaccttatgcaaaactcttgacctgtaccacctcagttaaacctcagatcttgctgtctctattttagaagtgaggaacctcttggccgggtgccgtggctcacgcctgtaatcccagcactttgggaggccgaggcaggcggatcataaggtcaggagatcgagaccatcctggctaacacagtgaaaccccgtctctactgaaaaatacaaaaaaattagccgggcatggtgatgggcgcctgcagtcccagctactcgggaggctgaggcaggagaagggcgtgaacctgggaggcggagcttgcagtgagccgagatcatgccactgcactccagcctgggcaacagagtaagactccatctcaaaaaaaagcaaaaaaaacaaacaaaagaagtgaggaacctctttcccaagataatgtgcctggctcactgtctcacctactttgggtcctaatcaaatgtcacctccttactgaggctttcttggactgccctactcaaatctgcactccccactttctctgctttttctacgcagcacttgccgtgacatctaacgtgctgttgagttttcttactgtccatccctcccccatacacaacccactagagtgtcagctccatgagggcagggatttttgtctgttttgttcgccactgtcttcctagcatcttgaatactgtctgtcacatagtaggcctcagtaaatatttcttttttttttttgacttgctctgtcaccccaagctggagtgtagtggcccaatcttggctcactgcagcctccacctcctgggttctagtgagcacatttggctaaattttgtatttttagtagagatggggttttgccatgttggccaggctggtcttgaactcctgacctcaagtgatccacccaccttggcctcccaaagtactggactgggattacaggcgtgacccaccgcgcccagccacgataaatatttcttgaaggaatgaatgaagctcgggtgggtttaatagcttgctggatgtggcagtgttgggctcaatccagggctgtctgacttcaaaaccgatgtgttgttaattgccatactccacagcttagaatcagaatgaggatcaaggtatagtcctggggttcagagaagacctgggccttgccgggaacacagggctcagctccttggagttaaggctgaactaagaggctaacaaggaccctctggatgctgggcagctcctttgaggagctgggagcctgagtctgtgtatcttctctccactcaaagtcactggtaaagcagagtgcccttatttttagtgctgttgctgttgtgggactgtaaccattagctagtaagagacttaaggaaggagataaacattaatcttctgggccttccctcagctgccacctccgcattgcaagatgctgttctcctgcacctgcccaggcaaccaagcctgagagttatgggctggagggtggtgaggtttgtgcccagagagagggccgtgggtctgtagctttggggctggctggcttggtacctccatctcaagtccagggatggaaggaaggtggggtcatgtcaacatcctgccagatctggaagaagcaagccccccagccaccaggcaaggctgttacagcctccttgagtgcctcgcttctggaggtcactggccacatccctgtgcctgggaccaagggatgccaggtgatctgggagttgggagttacttggggttctcctggctgcatcctggtcggtggtcatgctgaacccaggcacaggaaggaaggcctgacccagatctttgggcagctgggacggattagctgggcagcaggaactaatctctgtctgtccccacctccttccacaaagtagagctgttgctagagggaaagtttaggacaaagctgggtttggttagtgaaacaataaatgtgaatttcttctagtccataatccctacattatctcacactgacagtcctgagtttgaatcccccttttatccctttcctgctgtgggatcttgggcaagttacttaacttccctgggcctccgtttcttccatcatctggaaatgtggacaatcatagcatttacctaatgggatcattgtgagggctgtgggaagatttacagaagctttttgctgtttagggtagaggcagggagacaggaatagcttggcagctatggatgtgaaggcccctgcccgggcctggataattcagggtgaactggactctcttccttttgcaccccctccaaagcctagagtcttaactcaactctcaccattctttatctggccataatagcacaggggtggagaaagagggctctaggctcagaccacctgcatcactgcctgttcgtgttaccttaggcagattactctatctttttaaacctgtttcctcggtaatataatagagctaatcagatccctacttcacagagtttctgtaggtatgaaatatggtaatccatgcctctgcctgacatgtagtcagtgcatagtaagcgattgttatggcgactactgttattagtaaacccttattaagcccctgtttacagaaagaactctagaaagcactacctggaaaggtacccccgcccttcgaagagcttgcaactgaaagataactgatgtaatatatgatgtgagaatcgtgagaagtgcattgggaaatcggggggggggggggtggagtaggagggagaagtcacagtctaccgagaggagcagggaagacttcatgaaggaggtgacttttggcaggatttcagcaagtagaaagagggaaggacagtgggggagggctgtgaggcctccgtgctgtgagtagcatcctctcttcccacgtactggagctctgccttcctgtggaaggaattgacccacgcagctcacttggatctggggacttgtggatttctggttattccaccaaaaccaagtaatcctggagtctgaatttgaagaggtcaaagcttacagccatggtggccaagaggactccggggagaagcaggatttgtgtcctggtttctctttctataaaatgggcatcatactaatgccaacctcctagagttgttatgaggataaattaaaagaggcagctgcctggtgtagaagtaagctctcaataaatgttagctattattattttaagtcatcattatcttgatcatcaacctctttattatcagcatcattatgtttcaggcttgccatcaggactatgtagagaatatatgcaaaacccctagccagtgccgagtatatattaggtgctcagtataacttagctattattagtgttcctaacaagaaagagattctgggccaggcgcggtggctcacgcctataatcccagcattttgggaggccgaggcgggtggatcacctgaggtcaggagttcgagaccaacctggccaacgtggtgaaaccccgtctctactaaaaatacaaaaattagccaggcgtggtggtgtgtgcctgtaatcccagctactcgggaggctgaggcaggagaattgcttgaacccaggaggcgaaggttgcagtgagctgagatcacaccactgcaccccagcctgggcaacagaacgagactccgtctcagaaagaaaaaaagagattctggacaccctggaccactgaaaccctgttgtggtggaaagagcaccagagttttagttgaatacctggattcaaatcccagctctgctgctcactggctcgaagtgtgcaaaccctcaagtcatttcctcatctggaaaaggtggtcataactatctatctggcccaggcctggtggctggtgcctatagttccagctattcaggaggctgaggtgggaggattgcttgagcccaggagtttgaggctgcgatcatgccactgcactcctgcctgagggacaaagtgagaccctaaaatgaaaggaaaacaagttgtctccaggattgccatgacttgctgcattacttcagcaaatcatcacaaatgcatagttagtacctgaactgaaggaatatgaataacaaggtgaccacaaggagaatggatggttgatggcttttgttttttctcttctgcttttagatcaccagaaactagaacgtgaggctcggatatgtcgacttctgaaacatccaaacatcggtgagtgcctgggcatggagcattttgtgggtattttgtagaagcagggataacagatatccactgcttttgtgtgtgggatcacctctgtctgtggaccttcacctggtgtctgtttttacatgagcaggatagcaactgtgtctcagaattctggggcattctagtttagagacctgagtatctgcatcactgcggcaccttctcagggctggggtgtgaggcatcagaataggtttcagatgctatttcttccctttctccttctgtctttgggctgaggtccagggtcctcagcgtgtgaggttccgggctcctagcctgccagcgtccctcaccaggggccatccacagccctcatgcaagggtcaggattttgtttgtggacctgaaagagttttgttcctgctgcggtgtcctgcacactctgggggtttccatggtgctcccatttgtattccccagagccaggaaagcaagctgcccccctgcctggctcctctggagaagggatggcaggaaccactcagatggggaaggagaaaaaagaggatttctccctgctcccaccctgactggggggacaagagcacattgttggttgtgctaaagcctgaggaggtttgcctgcctcaacccactctggctcagttttactttgttcagctgaaatggtctttgccaaaagcgttggccctgatttggtgctccttgcagaagggacagaaactgggctggctgcagtgtctgagcagaagccccagtgttgacttgaggcagagcaaggagcatctcctaggttttccctgaaagccctgagtcatcacaaaagacaacacgtgttctgtgctcctcaggcatggcctaaatctcagggctcccaccgtgccccagaggtcgcctgctctgctctgttggcggccagggctgtgaggtgacttgctgaagcctaatgcttccttcagagctacccagcccctggcttcccaggtctcgggctagaacagtcaaagtgagctctgtcatggaagggctgaggtcctgctctagccctctgggagaggagcagctctgaggtagtcagaacgtcagctgtgcagggctttctagatggcaatcagcagcttggattacacccgaagcagattggtgtggccagtggtgatcggctttgcctgatgcagtgtgttctgcagagccagcacctctcagctggtgggttcctggccgcagaactactggagctcctaggtggtttctgaggttaggccttcacctgaaaacagcgcagtggggactgacatgttgcctttggtaggagagggcccacagagggaaacacctagaacagcagtcacagattaggcatgttttgcttggctgactcagtggtctaaaaatatttttattatttgccaatatttaaaaatgagatttcacattttgaaaaaagaaaaaatctattcccccgcctttccagtcagaaggcttggctctgctgagcccccaccttgcatggccagaaggagctgtgaggagcggtggctgcccctgcagcccgctggccactgtccttgtcacccactatgagctcacatttgcattacccacctgggcccctgtaggccttgcaagcttgtgacctctaacctagaagttccagaacaggaagaaaaaacatgtgcgtgactaaagccacccataagcacagaagcattttgatgttccagacccgggtctcaatatctgaggagggtaacttcctttcctttatgctccttgtgaccaactggtacagcagtgataatttgtcctcatgtaggcaggagaacagcagctaggggtcagtgatgcaggaagcagaaccatgtccacatcacccgcgatgcgggcgggttgaccatgggcgggttgaccacggatgggttggccacggacgggtcagggtataatgaagacaattgagaaatgagcaggaaggacaaaaatagaattctaggtgaaaaaagccctaggtgtctttttatttatttctagaattaaatacatacttttttaccccatagacttcactctgtttggtagccctttacttttaccatctgccctcggctcagaatggaggcaggcggagggaccatatatcctggccgtctgctcagaggccaggtggggcacagtcactcttttggcctctgatttcctagaactgtgcttccatttcatgactgctcccaggtcctaaggaggttggtccgaggaccgattctggggttgagggtgggcagagggaagggggagtcaagactgtgtcctgggagctccagcatccggtgggaaccagggctgttggagatgtggcggagctgcaggtccaggcggctgtggttgccatggatctggacctggcttgtggcaggagaggaggcaattttgtgcccctaattcactattcctcttctctctccactgcgctgtccttcagaactgtgacccttttggctctggcctcttgaactccatcccaaagggaaacaaacgggccagcccaagaacagtgcacagtcgaggaagctagagcaaagagcatgtggtcagccctgcctgtggtcagactcggaggcactgaattcagatggagcatttggtgctaggggccagtcatgcccagtttccccttaatagctagatattctgtcccaggagttaaaagcctgttggaagagtgaaccctgatataaactctggactttgggtaatgatgatgagtcaatgtgggttcatagacggtaacaaatccaccactctagtgggagatgttgatggtggaggagactgtgcatgtgggggacgtggggtatttgggaatgttctcgggtatttgggaacaccctgtactttccgctcaattttggtgtgaacctaaaactgctctgaaaataaagtttattaattaaaaacaaacaaacaaacaacaaaatgcctgtttgggtgtaaggcacactgccgaactccaaacagcgctgggagtgtggccagtggtggggagttgagaggaggagacgctggtgtgaggtctgaggtctgaatgaagtccgttctacctgtgatctgcctgctccctgctctcaagtcctctaatgaatagactctgtcttccttcgtgctgagctgccccagcagtttcgatcatagtctagcattgtggtttagagcagcacttctcaaacttttatgtgcttatgactcacgcagggatcatgttaaaattcagattctgattcagggggtctggggtaggacctgagtctccagctgatgctcatgctactggtccgcatgcctgtcaatacttggagaagccaagttttgcggcttcggagtcgcatccagatttggggtttgaatctgggatttgctaattagtaactgtgacctctggcaagttatttaactcctctatgcctgcctctgttttgttatctgggtcccttcgtggagttgttatgaaagggttcagccaggaaagggggctaggagggagatgatgaaaatggagattccagcccctagaagtgatctcttcaagacccccagcctcgactcagttcacaagttattcaagcctgaccatttacccttgagcccagtacccattcagctaacagtaagtgtagcaaagaaacggttgcaaataaaaagaaacattgaatcatgactgagcagttcctacatccctgcccccatggtgggggtggggggagccctgccacagtaagctcttggggggcagctcagtcccccacaagcccccatggcaacaggacctccttcccactgtgttattgctgcagatatttttaacagcaacactttttcagtgctttttggagaaagatttgttagttaaaatgtggcatattgttgggtggtttttaaagaattggaaatagccacaacatttgggttgtggctatctcagtccttgaagacatgaaatatcaagtaaaggtttgtaggtgttttggcctgttctgtcttccacggtttttaaagaacagcaattaggtttgttgctgaaatgcagtaaatgctttatactcctttccccagatcttcctgtctatggacatggcctggcccttgttggccttcatgccctgtctttactctggaatgggctgggtgtcagattattttattccacgcatccatagtccctctgctcctgcctcacagcatgacacagttgtgcttagttaacgcatttgtgtaattgctggtttaaagcctgtcttccctcttcgcctggcagctccaggtggcagggccggctcctcttcttcacagccacatccatggcatgtacagcctcgcctgctccggggtagctgcccagtggacattgtcgagccagtcagaatggccacaggtagtggggacagattggagctcctttgcctaagaatttgagaaggtgactcccaagcaactctgcaatatcaggaatcttgatgttggtttgtcttggcttcaagtcccggttctgccacttagtgtgattttgggcaggtttcttatggagcctcagtttcctctcctgtcagatggggttatttatatgtaagtagctaccctgcagagctggtgtgagggttcaatacagtaatgcacgtggagcccatggaacgatgccggcacacggacagctcaactaagtgttagttgttagatttagattgttattatcagaatctgatggggtgcggtggctcacagctgtggtcccagcctctcaggaggctgagacaggagatggctcaagaccaggatctccagcccagcctgggcaacatagtgagaccctgtctcttaaaaaaaaaaagaaataatgaatctgctgttgctaaataggcacttagaatggcacagtcatttctcctcttgtcttcagtgtcctgttaatttctttacaaattaaaaaaatgtcgatagcagtcttattcagatacagcttcctccatccctccttgtcttggcaggtgccttgctctggggcacacatcaaagctgttctctctgctgggtggcctagaaggattagtcttcctttgctgctcctttcttctaattcccttccccggcttcctcccacctgggctctgtgtgtggccttcctggagaagggcagacgccaatgactccatgtctaggcagaggcctgggtgcctgcacttcttgccctgttcttggccttgctgtgctgggcgggggcagggtggtgtggggcatggggtggtgttgggcatggggtggggttctggctgaggcagggctcagtgccaggcccaggcagagctgagtggctccacttctctgagatggttgtcagcatcatacctgctgctgtcccgttaattccccatgctgctgctgttagtcacctccctaatggagctggtctgtagcttctgggacagctgatttccaggggattatttgtattacacactttaatgctttttaatagcaaatttttaattaaatggaaagtccttttggaagcgagggagcagcagctgcagcaagactcagcgtgaggcaccgacttagaccagaggtgcgcaagtgagtggggcggaggcaatggcaggacttcgagaggacttgattgagtgtatatggagtgtgcccaggctaatttttatgggaggaaggcaggggcctggcgctggctccttcctcctgtcctaaaagccccctctgtcatctgcaggcctagggaagcatcttctttgcccaggagagaatgtatattggatatatacattatatccaataatgggagggatattggaagtatcacctgcctttgatcccgttcccagaaatactgagattgggatgggatttttggggttgagtcactagattagatcaaatagtgtaggtaatgggatgcggaaacagtcttgaggccctggctccggccctggcaggcttcggagtcctcagtcatcaagggaggagaacaagggggctatagtggtggttcagtgcctcgggactgtgccggctgggttgtatactttgctttctgaatgatcttgcttcgtggggaggggacatagggaagcacctcagccctgaggaaacgtgtgacactggaaatggaagcagccagggcccacccaggaagagacatggccatttctttgtctcctagcactgaactggttagtttggtgtcaggccattcctgaagtgctccatgaggtgcacctgtaactgccaaggcttggagcaaaggtcaaaccgagggaggcctttggaacagaagttccccatcaagagagttcacgtgaggggagggacaggacagtcagccaaagcggagtcgtttctgcattagaatgatgctcaggggttggcatttaacccagaggtggctttgtgggcagaaacttgaagaggagacctcagaagacttcaggttggttttttacccaagagctttggaggcggggagcagggagggattccgcctgccagctttttctcgcagctggtgcatcgcccgagtcttcttccagtggcaccctcccggacctgtctgcgatgctgctttagggacatttgtaagtggtctttcttttggatgccagggctttgttgcctgaatatgggggctgccccacatttcttaagggaagcagtggtgtagaccacagtctttggagtcaggtagcactggattcacatcttgacccaccacttagaagctctttggcctttgttaagagactttgtgtccctgagcctctggtgccctcatctgtagaatgggaataacattcatctcaggtggtcgaaaggaataataaactcctcaaaggcaggcactctgtctgttcctcctgaatcccgctgcctagcgtggggtccagcacatagtaggtgcttgataaatgcttgcagaatcagtaatgtatgcaagagcctagcacaaggcctggcatagtaagcacttaataagctgttattgttgtcattgcctgaatgtgtgcgtggccttccaggctcaccatccattatcctgcaccacgtgccttcctgctgagctctgcctttccaccttcttccccaccccttagttctgctcccatttactgctctggaagagctctctggctttcccatctggtcattgttgtcccctgccgtcaacattgctaggtgctgctcacgctgcatctcaccatcgtgcatcatatcccaggaccaccttctcggagaccagccctctgggaaggttccggcttttctccatcttgacttcttagccatgaagcttttctctcttgcctgagtctgaggtggcaaccagagcgccaggctctggctcccaggctgcatagccttgcactggggggcactgggcacgtcgccacttccccccactgctccttctggagagccctgtgagcccgacaggatggggcaggggtggggctgctgaggagaagcctaggatttccaagttttctctctgttaatctctgtccccatctcctctcttgcagtgcgcctccatgacagtatttctgaagaagggtttcactacctcgtgtttgacctgtaagtgccactttctgagggtgtgggggcctttccctctagctgactcaaaatgaaggctcaggaagaggcctaaacaggctctccagcctccgcccagggccccctcctttgtccgagggaaaggatttgactggggcagattgctgcccccaccaagggggtctccatgttcccccagcgtccccccagggctctgaaccccaggacagcattcctctcgcacttctgttcagcagcacgccttgcacagatgcctttgtcttgtttctcagtgtgctgtccttagtgaagaaataaaagacagctctttgcatgaccttaaaaatcctgagaaatcagaggtagctttcattagtcggaaaccaggctccattggattgggtctctcctccacgttggttgtggtttaatgtcttaaaagtggctcttacctcctggacactcctctccaggattctcagggttgggtctctgtgtcattggtctcattactcttcaacttcagtagtagctctgtccttcctgggcagcgatattttagtgtttatgttggtctcaaagctgtgacttttggggtaggttgactgttttctcttagatccctgtatcttcatctctgcctgactattagtgaatctgtgcattttggaaaaagaaatgtccggaaggaagggacggcccatgatacctcaaggagaatccgggtgtcactgaaggatcgagtgtgttctgagctctcagatgaaatgcatggggagttgggatttctctgaaagccattctacagggtgaccctgtttcttcttggacattggggttggacaaaggaccctttctgcctctgaccctcttcttcccgttggttgcagtgttaccggcggggagctgtttgaagacattgtggccagagagtactacagtgaagcagatgccaggtaggatgagggcccgagagttcaaatgtagctctggagtttaggactgaaggaagtcttggccaccttcggggtccagcattgtacctgtttgaatagtctttggggaagatcagaatagctcttgtctggagaaagattctgttgagctgggctagggcttgcatactgtgggtgatattagaagttaaaaattcagcacttcctaaccaggcgcagtggctcatgcctgtaatcccagcactttgggaggctgaggcagttggatcacctgaggtcagaagttggagcccagcctggccaacatagtgaaaccctgtctctactaaaaatacaaaaaaattagccgggtgtggtggtgtgtgcctgtaatcccagctacttaggcggctgaggcaggagaatcacttaaacctgtaagcgaaggttgcagtgagccaagatcatgccactgcactccagcctgcgtaacagagcgagactatgtccccctccccccccccacaaaaaaaatcacttccaaatgaatgttttacaaagcttttccaagtctcctttaccctgtgaccccagaaatactttttttttgcactaccatgtactcgccaccatgcccaatgtccccctctgcccttttctttcctttgacaaattctggtgtgctcaagccactgtgctgaggctctggcatgatccagaggtgcagaagacatggtttctgtcctgagggagtggagagttctgggctgataatccaaccatagagccccgggagctttcagcctctgtcaccttgtccctagaccaccatgaccagccttgccgtggggctcctccaacttgaggaccgttccccggccacatgcctcagcctctgccctccctggaatccctggtgcctccctcacccacgctctcaggcgcctgttcagcctgcctttcccgccttggctcttcccccagccttgcttttctcgagggtgatgtccctacaacctggttttgatcatcctgcctgcagcttatctggcttatgtggcagctctggctgcttctggagagtgggggagtgcagcttcctcacgaatttctcaaccttgagaggccaatgtttgctgatcaacttcagatgcttcagcctcgggaagaattctcaagtggggagatgaattccagtgccagcaggggaggacgaggctctgggacggaggaggcagtgatggctcagggagcctgcggggaggagggagagctatagggagggggccctgagggggggtgactgtaccagtgggcttggcctggctctgctgggacacttcgcacttttgccatttttggccagaaggcgctccctgctagcccggctctgttctaattatacatctctgtggagactcgcctctatagctcagtcttaaagtttctgtggcccactcttgggctgtgtcctatggggaggcccgagtttcagcccccagggacccagtacgaccccttggttcttgtggcatccccagcatcagattttaggaatagtaagtccaggccacccagccccatacactgggatgctctgcagatgtgcttaatataccagatagtgcctgatgacgggggtctatattctaggccaagttcctcagccttggtgctactaacgttttaggccaggtacttccttgttgtgaggcctctcctgtgcattgtggcagacatttagaagcatccttggcctctgcccaccaaatgctgggagcacccctcctccagttgtgacaaccagaaatttctctaggcattgccaaatgtcccctgcggtgggggggggcgggcggcaaattcattcccagttgaaaaccactgctctagactgcccccgctccctgtcaggagtttgatgacagggatggcaggatggtttgctatgtggacagtctgatttacgtgtgtgactgtggctgggcgcagtggctcacgcctgtaatcccaacactgagaggccaaggtgggtggatcacttgagctcaggagttcaagaccagcctgggcaacatggtgagaccttgtctccacaaaaaaatacaaaaattagctgggcacggtggctcatgcttgtggtcccagctactggggaggctgaagtgggaggattgcttgagcccaggaggtcaaggctgcggtgagctgtgttcacgacattgcactctaacccaggcaacagagtgagaccctgtctcaaaaataaaataataaaataactttgggtttttttctctacgcaaaatcatcagaagtgctccttaaatgccctgtttggaagctcttaagtacattgtttcttaaaggtatctttgtacttgttttagctgccttactggatgccagacctcagggcagctattgggtcttgtccatcttcattatcctaggcactcaataaacatttagggaaatgaatgagtgcacccaccgccaaagtagcttaggttgtttagttggactctccttcctaagttgccagcacaagcttcttctccaagaacaaagttactgtatggagaaagagaaagaaggaagggattggatgctctcttcttcctcaggattctgggctgtctcctgatctcttggaaatgagttggttgtgttagacctttccagtcaaaagggggtgagaggaacccgttctagcggtgatcctagaaaaaccattgcatctgcctgggcctcggtttcctctttctttaaataggttgaacaagatgatgtgcagagtctaaggttccagtggccgttaagtgattctctgtgaatccgtggccccttgtcacatgccttagtctgcagcatgtggttgtggatgtggatgaggtggtttaaccctgcgctaacatttcttttccttctgcttttttagccactgtatacatcagattctggagagtgttaaccacatccaccagcatgacatcgtccacagggacctgaaggtactacccaggctcccctccgtgcctctgctcatgaagtgttggcgccacctggtgccagatagtggtactgcgtaggcccaaactaggcttcctctgggctgcagggtgggtgctcacaaggttctctgtgtttcttctgcagcctgagaacctgctgctggcgagtaaatgcaagggtgccgccgtcaagctggctgattttggcctagccatcgaagtacagggagagcagcaggcttggtttggtaagggtgatcctgtcttcccggaatgcagcccccgcccttcctcctcttcctgatctgccttcctctattagaactagaagccagacccttaatggtcctggcctccgagatctctcttggccgtacgcgactcagtacagtaagtctagctgttgtcagcactgctttcttgctgcctgtgggaaggagctggagttcctggtaggcatacggctttgccgtctggttcagattccaggcgctacaagaagcccagcctgtcagctcttgctgcccatgtgctgagagtttatgtagcaaaagcagcaggaataagatgggacttgggggaaatggctggtgtggatttaacgagagagaaagtgggttcagtatgcctctgccctctcttttgctacaggttttgctggcaccccaggttacttgtcccctgaggtcttgaggaaagatccctatggaaaacctgtggatatctgggcctgcggtaagcccattccacgctctcagcttttcgctgttaagggccctcaacttccgatgatggcaagaaagaggcatcgctattccttgcaggtcacacacgtgcctggtgtatgtgaaattatggtgtttgcccctgggatggctgttcccatcacaccctcctccctgcgtacttctgggatgacattgtatccttcttggagagggatttgcccacgccttagaggatgggttgtgcctaaagaaatccctggtgtgacttggtgacgtgaagtgtgaggcatagcaggaggggctggtagcatagcattatcggctggcatccacttctgactctggtatggcccctgcctttctaggtggctctgagccctgcatggtttttcttggttcctcagggaagtaggcgactgacccccatgacctgtgtgttctgtctcgtaggggtcatcctgtatatcctcctggtgggctatcctcccttctgggatgaggatcagcacaagctgtatcagcagatcaaggctggagcctatgatgtaaggaccagagagccgggcagccaggccaggaagggcagatgtccttgctcctcgggctctgtccaagggagcaggcttgtttagtgtgtcacgtgatacgggggtgtcaggggactttgaggacccaggaatgggcatccagggcccaattcttgccactctatgtcccagggagcaactttcttttgcacagccttcttcataactaaaattgaggagtccactgaagtcctttgatctttacttgcaaagaatggagcggcctcattggtgtgctgtgtaacacagggacaaaaggcctggagactccctccactgcagtggcaccttggacacattgctgagcctctgttccctcctaagtatagagctgggcttaaaccagagaatgttggagtccccttcccgctctaatctgatgttctggcattctaaacatgactgttctgtctgtctttccaagtctttaagttgacacaggttctggaatagccgcagggcttctccaactctgccagtcacagctttaggtaccacagagtatcccaattacaggagttgagttgaagacagaaccagtgttgcagggtatgaagctcaccaataccacattcttctccctattcctgctccttagttcccatcaccagaatgggacacggtaactcctgaagccaagaacttgatcaaccagatgctgaccataaacccagcaaagcgcatcacggctgaccaggctctcaagcacccgtgggtctgtgtaagtgtctttgctagtggccaaggagctcaggggtgtcagccttctgtgtgccctcggcaccaccccctccttcttaccagcagagattcattctgggccccaagcaataactgagcaggcgggcagaggactgttgagggccagggtcaataaatgtcaccagggagactcgggaggctgatggggctggtgggccactgctcctctctcccccactcatggctgtcaggctgggattggttctgttcttggatgagggctcaggttgacccttgtggactccaggtagccggtgatagaaagcagctggcaaaacccaaagtgaattcccaagctggggttcatactcagatctcaactccactggagtggtgaccaagatccaacaaatcaacagaaggggtttctgagtcattaaaagcataaaagctgaggcataaagcttctgcgctaaagtcctaggagagtcctctaggctatcagtgtgggttgacgtactctgtttttatacacaattctttcaagctgaaatatcaactttcagacaaagaagaggatttggtagagttaggcatcttgacaaccacgaggcattatttatctgtccattctgtgtttattaaatacctctttggtgctggttaccgtctgggtgctggagatacaaagatgaatgaggcatggtccctgccccaaaagatcatctagggagacaggcactcaaacaggcagtcatgttacaatgtgacaagtaggtacaagaatctaatgagagtacaggagctcctactgttcctggtgggtggtggggttactgaaggctgcacggaggaggtgacacccctgtgcttgttcttggcaaataacgaggtcctcagaacgttaacctgcagacagagtttagcacagtgagaggttatgggaaactatggtgagttgaaggaatgttgagttgtttggttgtcgatgaggctgcaaatatcagaatgcaagagaatggggcaaaagattccctgacatacaagtttctgcctcaggagtttggattttattctgaaaacatagggaatcatttaagggttttaaagaagaatgaaatttgcatttaagaacactttggaagttgtgaggaaatgaattgccaggcatggtggcatgtgcctgtagtctcagctgctggggatgctgaggcaggaggatcataagcccaggagtttgaggctgcagcgagctatgattgcacctgtgaatagtcattgtactccagcctgggaaagatggtcagaccccacctctttaaaaaaaaaaaaaaaaaaagaagggaattgaaaatttttaaaagaaaagggctggagacagagagctcaggaagcttttttaatagttggaatagtctaagcaagaccaggtgaggtctcagcagagggtaaggatgggggaatgtgcagtgtgttgaaattcaagagatatttgagagaacctaaaggatttaattctctccagttggatttggggggagcaaagaagagagaggccaggtttcaagttgagcggagagttgtaccctcactgacccagaagaaaaccagaggaggagcttgtttgtgagacaagacgatggttttctctttttttttttttttttgagatggagtctcgctctgtcgcccaggctggagtgcagtggcgcggtctcactgcaagctctgcctcccgggttcatgccattctcctgcctcagcctcccgagtagctgggactacaggtgcccgccaccacgcccggctaattttttgtatttttagtagagatggggtttcaccgtgttagtcaggatggtttcgatctcctgatctcatgatccacccgcctcggcttcccaaagtgctgagattacaggcatgagccactgcgcccggccaagatgatggttttcattttgtgcctgctgagtctggcaacctccagccagacacattcagtgggtggttagaaatatggtcctagagattagaaaagaagctaaaaattggaaatccacattgtagtcatttctgtgtagttggtagtgaggctgtagaaatagcctcttcctatgctgtagatgggcctgttcctatgctggttgagttcttacggtgagcttctattggctgtagtagagaagagacggccactacacaccagcatttaatgatagggagagttagggggcccagcaaagagcactgagagtgagaccttccagaagacccagaagctaagaaacagggggtctcagtaagggagcgtcaggaatcagatgcagaagagtccctgattaagttggggaagaatcccctggctctgaccattagatgccattgtttcatcatttcactgagacagtggagagaaagatgaaaccctgttttcagtgagacgaagagggagtgagggtgaggaggggcatggggagctaggcattgaggtgggaaataaatggtgatacttagattaagatgggccaggggagcttttaatgtaaggctcacacctgtaatcccagcactttgggagaccaaggcaggcgatcacttgaggccacgagttcaagaccagcctggccaacatagtgaaactccatctctactaaaaatacaaaaaattagctgggtatgttggtacacacctataatcccagctacttgggaggctgaggcatgagaatcactagaacccaggaggtggaggttgcagtgagccaagataatgacactgcattccagcctgggtgacagagggagactctgcctctaaagaagaaaaaatttctttttaaagattatattggtcaggagcggtggctcacacctgtagtcccagcactttgggagaccagggtaggtagatcacttgagcccggaagtttgagaccagcctgggcaacatggcaaaaccccatctctacaaaaaaaaaaactttaaaaattagctggttgtggtaacgtgccttagctacttgggaggctgagatgagaggatcacctgagcctagagaggtggaggttgcagtaagccattattgtgctactgcactccagcctgggcaacagagtgagatgctgtttcaaaaaaaaaaaaaaatttttttgtttaaggagaggcttaactataatctatagagaagaatctagtccagaggaaagagttgaagatccttgctaattgaggaagcaaaggtttggacagcagaaaaagagagggggctcctgagccaagggcagggggtccatcccggggatgaccatgatccccctgagacttctattagtgtggaggcaggtgaagatcggcttgtgagtggaagtctgagctgaaaggggttcttgctgatgacctctcattttgcttttggagaaatttacaccgaggaggaggtaaaatgagagacttggggaaggtagagaaggtggggagagttgcctccggacctggaaagagtgggccaagggtgagggaaaggatgcgaggaggccccgtagtgttggtgggcacctggctgcaggtgccaggatttgtttttctgacaggctggtgaagacagcaacagcaaggggagagggcaagcaacctgaaacaggcacccaagaatgggggaaatattctgttctggggtcatttttgcaggccctaccctctgcagtcccgtgtgtctcgagcccctgaggacatcactatattctgaaattacataatgatgctggtattgacagctgagtcattgaggaagtgtagactgtgtcccatggactctgtttaaggaggccaggaagttagcagtaaatacattgaagacaaatttccatccaaaaaaggcggggcacagtggctcacacctgttatcccaggactctgggaggccgaagtgagcagatcacttgaggtcaggagttcgagaccaccagcctggccaacatggccaaccctgtctctactaaaaatacaaaaattagctgggtgtggtgggatgtgcctgtagtcccagctactcgggaggccaagacaggagaacctgagaggcggaggctacggtgagccgagattgcaccactgcactccagcctgactgacaaagcgagactccattgcaaaaaaaaaaaaaaattacatccagaatgatgaaaagaattgatgcttcaaggtgacgatccttagcttctgggatcatggcttcattcaggaccttgctgggggtgtgtggagaggggctcttggaaggaaggaatgtcctctgtagagagcaggaaccctgccgttctctcgctgctgagcatctggaacgcagtaggtgctcagtaaacagctgcctaaggagtgactgaatgaggatcacagcccccagggtactctcctgttcggtagcctctgtttcccaaggaagaataggacggtctctcagcagcccgtctagcatccgttatggtgttctcacgttcatgttgtccttatgtaaccttgagtttcgggtagtgcttttattctaaaagcgttttcacatctgtgacctcatttcatcttcagagcaactctggggtggctgagtgcatgaccctgtcctgggcatggtatcggtgccaggactgtgggaggcgcagaggatctgggctggggctcatagcctgtctgtttggtttctagcaacgatccacggtggcatccatgatgcatcgtcaggagactgtggagtgtttgcgcaagttcaatgcccggagaaaactgaaggtgagtgtcgtttctaggctgccagcctccttgacatcatgccttgcaccagtgtggctcctgccccatttcagaaggaagctcccctcctggctggagctgggctctgaaggttgtacatgtcacaggggagggggcccagaggcctgatgtcttcaggctctagccaggacctgcctttgcctgagaccagcctgcccttttctagggtctcagtgaattcacaggaccttcctctttccccagggtgccatcctcacgaccatgcttgtctccaggaacttctcaggtatgttttcccagctgtgtactttgattatgccgaggtgagtggatcaggaatgggctgttgccatcccgggcaccgctgggtttcctcggcgtcctgggccacaccttgaccagggcgagtgaggatcctgttttgaggggctgctgctgctgctgagtcctgctcctgagattcagggggctggactcacatttgtgaattgtttcctagaacttcccaaggagtagcctgcccaacttgctatgtaccttgtttctctggattcttatttaactctctgaagactctcagcactttacagattttagccattctaggatcttggaggatgtgctgggggaagaaaagagagatgaggtacagtgagtcttctcaattgccaaattgccaccattcatttgcctgctgggacgatctcttacttcattttgtccaagtggagatgactaatagaaattattccagatgtttaaaccttttgtggcgacttgtgcttaaaatagtccctgagatactagctataacagtgaagaaataaagaccagcaggagagagggaaaggaacttgcttaaatttgcataaagaattgggagaggtgggaccaataatttgtaaatcatacttgacatttatttttaagatgcaagacactccactcccctcttgcccccaccctcaccccaacccctattattgtttgccttcaattgggaagcacagtggcttttttgtgaggaaaagattaatgtcgagactgaagacagagagggctctgcccagcttgccatctcccccggtcctccctccctctaaccccttgcctcactgttttggttcaagacccccccttctccttcccataataagactccctcccttgcttcccctctgcaccaccatggaaagggggttgtgtgggagcctaagccaccactcagtgggagccacttctgaatacccgtcctgctgggctcgcctgcgctggctccaggtaacgccagggccttggctgtgaggatgctgcaggcagggagcctagggcttcgtggtgtagcctgagagccatggagctccggaaggccagggctggatagtgagcccggggctggtggtgccctgccctaggccttctcctttgaccctggtttggggcttgatcttgtgtcatgggtacccacgacgggcatactgtggtgtggctccacctctcgcagatgggaacagggaagcgtggctggctgcctccggtggagttgcaactgtagtcccacacttgcttcttgtgctttaatgacgcagcttctactttttgggtctacgagcctttccagaggacattgaagggcgtttcggtgttgcccctagagcgaagctctgtcctctctcccctctgagttgaagaaatgtgaagacagtctgctgcttctcttttagcccagccagtcaatagcaagggccctgtcttgcagccccgggcctccacatcagcctccccctccatttcaggaaactggcatcctggtttcaggaaatcgggtgttaggacaaagcattttattcatccctgtagagcctcctgttcttattggccagacctagactggcctttgagctcactttgccttgggtcagaggagacaaacaatgttgcaagcattccaggatggcctcttctgccctgactctgggacaggtgaggacagagtctgtccggaagcttctgcagaaagaggtgtctatggatgcaatcaagaaggaagggcacctgtgtgtttctctagggctgttttttgagttgacctccaataggagatgtggcttatcctggactctagcagtttggctaacagcgaatcggggcctccagagtgtattgcttcagcagcctttgttttctttctcagggtttatttcttgggcacctttcacctcagcacactgtgacacacagactgagaatgctgcctctctcggctacctcccttaagacagggacctgtgtctctgaggggttggggggcatggagctggggcccaccagtaaacttagctgcacaagggccacagaccctccctgggacccccacgccagtccctctagtgtgtgggatgtagagaggggagagggctgctctgcgcccccggcactctcatcgtgggctcatttagcttctagggagggaaggactagaagggagggcgtttcatcacagccttaagctagggccgggctacctcagaaggggcacctgcctctcaccggctcaggcatttcgctgtggaccctcctccggagggggtcatgagacaggcactgcagccctctccatctggtggggacgcagtgttccctatgccctggcccagcccggtcttcccaggcccccagactgctgcagggctggctgcgcctacctcctcagcctgcccctggcgctccgctcccccagctcggctggcttggccacgccgcctgggctgcgcctcgcgctggggcatgctcgctgctgacggccccgtggctttgcggggctctgtgcactgagagactgtatcccctcagttggcaggcagagctccgcccccgcctcgcctgccgcgagcgccgccggcctggccgggcaaggtacgtggcatgagtcctccccgaccgcctgcctcggccccctgccaccccaccaggagggccagcatgccgggcccactcaccagggaggcgagtcccatgcttgcgggctgagatgggcatgccagacagactacctaacttggcatctgcaagcgcatcgttgttatggagccccctaaccagccatgcatgctgggcgcttgccaactttcagggggcagtagcctgggggcatggagctgggcagcgggagccttgccaagagcccgatgccctgggagggctgcagccaacagtgggccctcagagacagtgctgggcattgccctgagctgcccggtgctaggactagatttccgcagcactgtttaagaccccacagaggagccgcgctcctcaaaattgtgaagtctggcgcttgctggcctccaggtctgaaaggctccagagtgcagaagcctcagagccagctgtttctgggttcacatcctagccctgccacaccctgagcgagtcacaccagctctcccagccttaattcctcacctctccaatggggatgataaataacatggtggtgcttaagatcaccctgtcgaaggctctcagccctgcctgtgcagtacagctgttacctgggagctcgtaagaagtcctaatgccaggaccccaccccagacaataaaatcagacccttagggataagataggtagtacgctttttttaagctcccaggtgatcctagtgggcaaccagcgttgagagctggctggtgaatggaaagcacttagacagtaggcggtcaggcacaggagtcagcacatttaaaaaacaacattcaaacccagcacgacaagataagatcaaaggtctttttctggagtcagaattctcgtaatggaaggacccctgttctcactggagagagatggaacacagcttggggaggaatggctacccaaagggcaggagggtggcagcaatagtgacaacgatggtggacacttactcagtacttgctatatgccaggcactctaagtgcttttcatgcataatcccactggattcccaccactgttttgtgatgtcagccctactttatcccattttatagataaagaaattgaggctcagagaggttaagtaactcaccaaaggtcacacagctggcaagtggtggaaccaagatacagacccagggcaggcagtccaggtgtatcagacagttgggctgattccatctccctgtgcctcccagactctcctccccactgtctgctaccttcctgtggccttttgtggccagctggtgtcaccagccttctggcacagagctcatcagcctggagcgtcaccctatgcctggctagaatctgtttgacagctcattattctgccgagtccttcctgctcacaggtccagagagtggacactggggaaagggtggcagctaggacccagtgaacctggtgaggacctgctcagtgaaggcttcaaccccctggcaaaaccctcctgtaggtggtcctggtttctgtgtctgtgtctgtctgtcctctggtctcctgtgtgaactgtgacactctgcttcttgagaacactcaggagatgtcttgcatccttgcagtttggccatccagagaacttccatggcacctagggatggagccctcactctttcaccctggcactctgcttccaggcctgggtggaagctgtcaaaggcagagtccccagtgccccaggcggctccagtactgagcatggcttctcctctaagtgtcgtgcatccatgccctcctccacgcagaggagatcctgaggtgccaccctgagggctctgacgccactcaagatccccttcttgctgagaggctataggaagtgcctcttttgggggtttcgggagacccttggcccccttgtcagacacagcactctcttgtggatctggctgccggacttcaggttggggagagggtacaatgcaggagacttgatattcctctttgttttcacagctgccaaaagcctattgaacaagaagtcggatggcggtgtcaaggtaagtgtctccagcctctgaacagactggcctctttctccccgcagtcactatgggaattcttggcacctggttccccctttcccagggaatcttcctatccttgctagtctgctttaaaccagatgcctttgtgctcagaacagaaggttctgctggcctgagagggaagtagggaggtatttttcctggccctagctggatgggaatgactcaggggaagtgatccaaatcatagtttataccagagctgaatccggaacctgacttctacacggatgcttcatctccagggcttgactctgggttttttaggtcatttggttatctttctttttttcctttttagagcacaaatccttttaatcaaatgaaagccaaatttgcctgagtgattcaggcagggtatagggcttggaacctgaaaccactctccttttggtctttttccttctctctacaacactttcagatcccactgagtgcaacagcctcgagctttcttgacgcataggctcctcagaaaaaggcaaaggccatggtggatcacggcttgttcccactgggtgagggagcttttcccatgggactggggcaagaggagggacctgggacccaccaggagccctgctgggaatggctgcttggccaaggtagaggagaggtgactggggctacccacagggcccaagacattctgtagatgctttgggggcagaaaggatcctggggctagggcattgggtaggagctcatgctatcttgaagcctcccagcttacactctagactagattttcactgggccttttcccaagatcttgtgtcaacagctgagatacacacacaagccccgttccctccccgttccctccccactccctcctctttccctcattctctgcatgcctgcttctgtgttcttccgcccctcgcaggggagcctgggctccgcgcacaccctctgacatggagctgggggcatcgtgcggtccccaagctctgcccctgagctacatggatggagccaggtgaggaaaaggggcaggtttagttggagagagtgtttaataagtacctgtcagtcagatgtccacgcagcattctgttctgaggggtacacaacagaggtgtaagagggggtgtggctttcagtcgccataggaagggggccgcacctggagtcagctgagcgctgctagtggacccacgcgagatggtttagtccaggaagctcataggagagagcgtactggagaaagctgcagggacataggtgagactcactttgcagttttactttctgctatatgttttctttaaattgaaaatatgggtcaggcttggtggctcactcctgtaatcccagcactttgggaggctaaggcgggtggatcacctggggtcaggaattcaagaccagcctggccaacctggtgaaactccgtctctacaaaaatacaaaaattagccagtcataatgaccggtgcctgtaatcccagccactcgggagtctgaggcaggagaatggcttgaacctgggaggcggaggttgcagtgagccaagattgcgccattgcactccagcctgggcgacagagcaagactccgtctgaaaataaagaaaagagaaaagaaaacaacatgacatttctataacttaaaaacaacaaattatatttgtatgggttctcttatacatattgatgttctctgcccagtgagaacacagggtgtgtggtagattgatgtcaaaaatatggttggatcagtcttatcaggcagaattggaagtttctgtgtcagaccatgggaaataccataggccattgagcagggaagctatggtgagagtgctgatagaaatgatttggcaagccgggtgcggtggcttcactcctgtaatcccagcattttgggatgctgaggcaagaagattgcttgagtccaggagtttgagaccagcctgggcaaaaccttgtctgtgaaaaaaaaaaaaaaaaattaactgggcatagtggtgtgcatctgtagtcacagctacttgggaggctgaggtaagagaattgcctaagcccagggagtttgagcctgaggtgagccaagatcaagccactgcactctccagcctgggtgacagtgaaaccctgcctcaaaaaaaaaaaaaagatacctgctgtgcccctagaagttgggaaggcaaaacttaatctaccttttaaggtgtttacagtgggagagacacaaggcagctactgtttctatggagtctgctaaggtctcagggaggtgtgcacctggcaggtgctgggggagcagacagataaacatccaaaccaggacaggaatcttctggaaggagatggccaggaattgagcttgagggagtagctggattttgctgggttaaggaggagacaggaggggagggatattccaggcagagggaagagcgcatgtgaagatacacgaggttgaaacagcatgatgattctgggaacttcagtatcttctttatggctgaagggaagagcaattgcataaaatgagacctgaaataaagcagtgactgttgaggtggaggggagaggatggaaaaggcaccattacagaacaggtttctagccaaactttctagatactactggtgtcaaagatgaaggtcatgtgcagccatgtaagattagcccaaggagccagctcaaaccatgcacatccagggcccagcttggaattcatgttctggaggccttggctgggaggcagaatctgtgaattttaaaaacactttcatgaatccaaagcacatgaaggtttaagagtctggtaaaggcaaaattttggggttatgtgttaagaaagggctggaacaagagtcggcaaaggaaacagaggaaggacagagaggtagggggaaaagagaaatgtgcagcagctgcagctcttccaggaaccctgaggatgagggctgggcagacacatcattaggtaaaggctttaaatgaggacgtgcgtggggaacctagccctgcaatgtgttgtgtgtctgaccctgatatgtgctcagtaaatgagttttatgccacattcttttgagaaaagagcttcaatatcatggtgggaaccagaggccaatgatcacccaaaattaaaaggccaaccgcgtattcgcagccgttgtgatgggaggggttaatatttttattgaaagagtttctgtgacaaataatccctcttaaaacccagtagaagctgggcgtggtggctcacgcctgtaatcccagcactttgggaggccgaggcgggtggatcacgaggtcaggagatcgagaccatcctggctaacacggtgaaaccccatctctactgaaaatacaaaaaattagccgggcgtggtggcaggcgcctgtagtcccagctacttgggaggttgaggcaggagaatggcgtgaacccgggaggcggagcttgcagtgagctgagattgtgccactgcactccatcctgggtgacagagcaagactccgtctcaaaaaaaaaaaaaaaaaaaaaaaaaaacccagtagataggctaggtgtggtggctcacatctgtaatcccagcactttgggatgctgaggtgggctgatcacttgaggccaggagttcgagaccagcctggccaacatggtgaaaccccctctctactaaaaatacaaaaagtagccagtagtggtggtgcacgcctgtagtcccagctactcgggaggctgagataggagaatcacttgaaccttgcggggggcagaggttgccgtgagctgggattacaccactgcactccagcctgggggacagagcaagactctgtctcaaaaaaaaaaaaaggaagatagatgatcaaagaaaataaactgacaacctgaaaacaaggaagtagaactggataacaaatgtggaaaaatttctagcctcactagtatcagagaaatgcaaattgaaacaaggtgccatttttggactctagttagtgatggtagtgaaaaccagaatggtcctttctaaaacagcctgtgtgtcaaaaccataaaaatgcttctacctctttttaccctgttaattctacttctgagagtttttcctaaagaaataattcaaaataggaaaaagctaaaagcagaaaaatgttgaacatgacattatttatagctgtggaaagattggaggctgggcacagtggcttatgcttgtaatctcagcactttgtgaggccaagttgggaggattgcttgaacccaagagcttgagaccagcctgggaaacgtagtgagaccccatctcttaaaaaaaaaaaaaaaaattagctgagtgtggtggaacgtgcctgtagtcccagctacttgggaggctgaggtgggaggattgcttgagcccaggaggctgaggttacagccaggatcacaccactgcgctccagcctgggtgacagagtgaggctctgtttaaaaaaaaaaaaaaaagagagagaagaaaaaaaagattggagacaatttgaaaagccagtaaggagccagacacagtggtgcgtacctatagtcccagctactcaggaggctgtcgcaggacagaattgcttgagcccaggaattcgaggccagctgggcaacatagtgagacccccaactcttaaaaatgtttttaaatttaaaaataaaaagattttttaaaagccagtaaatgactaaataattatgggaaatctacttaataaactattcaaaagttattaattttcatgaccgtagggatattttaagtgaaaaataaagtgcagaaatgttttatattaagtgaaggaagtggtatataaaggagtacagacaagccaggcacggtggctcacgcctgtaatcccagcactttgggagcccgaggcagacagatcacgaggtcaggagatcgagaccagcctggccaacatggtgaaaccccgtctttactaaaaatacaaaaattagctgggcgtggtggtgcgtgcctgtaatcccagccacttggaaggctgaggcaggagaatcgtttgaactagggagtcggaggttgcggtgagccaagtgcgccactgcactccagcctggtgacagagcaagattctgtctcaaaaaataaaaaaaaaaaggagtacatacactatcattctaaatttggtttgaagaaacgtgtttgtagatatttattcagtatataatatgtggataaaaaagggactggaagaaagcccactgaagtgtcaacagtaacttcaccaggtgatgggaatttgagaaactttttttcttacacatttttctgtattctatatttttcatctagattgtgcactactgttatcagaattttttttaaatactattttttttttaaagtaaagcataataccaggtgtggcaactcatgcctggtaatcccagctacttgggaggctgaggtgggaggattgcttgagcccaggaggttcagcctgggcaacataagcaagactccatctcaattaaaaaaaaaagaaaagaggtaagacatgtgcttgtattattatatcttataatgatatctttttttttgttttttgagacagggtctcactctgtccccctggctggagtgtagtggtgtgatcttggctcactgcaacctccgcctcccgggctcaagtgattcttccacctcagcctcctgagtagctgggaatacgggcatgtgccaccacgcccggctgatttttgtatttttagtagagacggggttgcccaggctagtcttgaactcctgagctcaggtgatctgcccgcctcaacctcctgaagtgcgggggttacaggcatgagccaccacgcctggcctataatgatatcttaaaagattgctttctttttttttttttttttttttttttagacggagtctcactctcacccaggctggagtgcaatggcatggtcttggctcactgcaacctccgcctcccgggttcaaacaattctccaacctcagcctcccaagtagctgggactacaggcgcgtgccaccacacccagctaatttttatatttttagtagagacggggttttgctatgttggccaggctggtctcgatctcctgaccttgtgatccacccgcctcagcctcccaaagtgctgggattacaggcatgaaccaccgtgcccggccaattgcattttttaaaaagactggaagattgctaggagtattagtggttttcccatgccccttctctgttttccaaattgcttgtattgtggctgcagtccttttataatatgaaacaggtaaataacaacttatgttgtggctgcatcaaaggggtgagaaacgaaaaggagaggacaaagcaagatgtgcagagttcgacctttccaggctctctcaaagtcaaggttttgatcaatgttatgagggaggcctgtgaagtagctcagatggtcttgagctttcagcatcatggattcttcttttagatcccatcttcccttcccaactcccccttcctcaattcctactgcttaagtgtccatagggcgatttctttttcactgttcagaagctttctgcaagatgttcaaaatactagcattggtttgagcagctagtctgtcttgtgttcttgatttgggggacttagcttctatttagatttctttgaagctggatgccagtgacccagggtctatggaagagtaagagccacttgtgaggatgactgaagaggccacaaactctcagatcctgagagtgtaggacaacttgtgccttctgctagtcccaggccagaatggccatcctatctttaaaaaagaaagcaagcaagaaaaacgaaaggttatagttatttccctaagtactatttgaattattttgttaaattaagtatgagaaagaggtttgaacgcttttccagcttaaaatttaaaataaatatacagtttttaagtaaaagtgagatatgattctttagaaatcatctggcatttagccaggcatggtggtgtgcacctgtagtcctagctactcaggtggctgaggcaggaagatcccttgagcccaggaggttgaggctgcagtgagccatgatcatgccagtacttcagcccgggcaatagagcaagaccttatctctaaaaaaataataaaaagacctcacatttagacaatgtggtagtgtgctggttcagaaggagcccagctatgcatggctaagggcaaatccctgaatggagaaggaaattgaaaaatgttgactaacctgagaaacagtctttggaaaagggtgatctcaggttctcatgcaggacaatttaggaaaaagagagcaagccaggagaaggctgagaacttattccccattagtcaaaaatctgctttaagtcaagatcctgcaatggcctttcacaacaagcccctgaaaatcagcagaacaaagactgggcctggtgagtgagtgcctacgcagagttcttgctgccgtgattcagtgcaagttagaaacctgtgctcttctttagcctggggaaaaaccaaagtcagcaaacccagctcaactcagcaaactttcgtcgcctgtatgctaactataaggcatgttgctaggtactgtggaaattgtaaagacacataagataggaaccttcctgaaagcagtaacactttagttgggtaaagggataaggagatatacacacacacacacacacacacacacacacacaccccactacttatatatatgaatataagggaactccttctttttgagggatgattttcgaagtaaaatatcatatttgagcatatttaaaaggccactgtaaggctgtgtgcggtggctcacgcttgtaatcccagcactttgggaggccgaggtaggtggatcacctgaggtcaggaattcgagaccagcctggccaacatggcgaaaccagtctctctactaaaaatacaaaaaaaaatcagtggggcgtggtggcgggcgcctgtaatcccagccactcaggaggctaaggcaggagaattgcttgaaccagggaggcggaggttgcagtgagccgagatggtgccactgcactccagcctgggcaacagagtgagactccctaaaaataaataaataaataaataaataaataaataaataaataaataaaaggccaatgtaaaagaggcctaactatatttaggtttttcttttcctttaaatctaattctaaattatggaccattgtcaatatttgtagcctctttcgttgattataataataatccctgaaaatgccttctaaagaatgctggccgcttgagggcaggagcagtttatcagctgtgtttacctgaaacagccctcagtgtttgctgggcattgttaaatgaatgtgcaaaagttgaacgacagacggacatattacagggggaccttacccccagtgagctaatgatgacattgataattacccttcattttttagacacagtcttctgggatatattttcagtgttccacgtggtcttcatcttgatgcgtctgtttcacatgtgaacgtaaagttcgtgagcatctagttgaggctgaggaatcactgctttcaacattccctgtggcttacatccctgcatttttatgatcactgtagttttaatcactggcactcctgtgtttctattttccacgaattgcaaaatgcaataaaaaattcaaatattgtaaacaagcatggctatactgacaaaggaaggccaacatttaactgctaggtgattttcaaaagctcagcatctttatgtaaaaagcatagtagggatgcagcgaagtcagaagtcaaattttattagagctgaggagagcctgtagtagcttttgctttttccctggtggctgctcacttgaatttcagacagttctagtaatgagagaaaataaataacattacagggtgagctaaccctatgaacccagacctgtaaatttgtagcaaaatgatacttaacctcacagacttgtgtcttaatctccttaagaggctttttttgagcaaggctgagacatctcagaagatactaaatctgtgtctatgaacctgaccacaaaagagttcttccctcccagggtctggagggtgtgagtgcctgtcggtccgtgtgctgtttaaccctctggtgctggactccgggtctccctccgctcttttctccctgatgcagagcccacactggtgcgctaacctgcagcgtctctgtgcttctcttcttacctcctctttccccttctctttccctcttgctgtggtgtgtccagaaaaggaagtcgagttccagcgtgcacctaatggtgagccttgcctgcccacccatcgcccactccatgctgcctgtgcccgcctgccagccacgcaaacctgttctgccacgtgcgtgtgcctcactcatcctcactgcatgtctgtgctgtgtgggcaggtgtggcctgtcctgccaggcgggggccattgcccaaggtcacccagtagcctaaaaagtggacattggaaggggtggtacggcaccccctgctgtggagcttggacagaccccagcgacccagggtaggatgtgaagctggtagggacttggggcaagcaagggagagaccctcactctcttgtcacccagaaggagaggccctgcttcccaggcatgaggagctgcttcctacagactggcagctggagggcaactgtgtggtgggcagaggagctggttgcaggctcccacttgtgagtctcgctctcctggctctgcccccgtgcaaatcccattctctctagctgtgcccagtggtttattctgcccacccagccctcgggggacagctaactcatctttctcacgggacactgggcaccaagggcaacacagcagcctgagtcattatgaaaccatccattaaaaccagaggtgggggccgggcgcgatggctcacgcctgtaatcctagcactttgggaggccgaggcgggtggatcacaaggtcaggagatcaagaccataacacggtgaaaccctgtctctactaaaaatgcaaaaaattagccaggtgtggtggtgggcgcctgtagtcccagctactcaggaggctgaggcaggagaatggcgtgaacccaggaggcggagcttgcagtgagccgagatcgcgccactgcgctccagcctgggcgacagagctagactccgtctcaaaaaataaataaaccagaggtggggccacttgggtgacatcccagccctctgcaggttttgtgggcaccctggagtccttgccccctgtgagggtcttggcctcagctgggatttacaggtagggcagccctctctaaccaaccccgaacaggtcagcatcattcactgagctaggtgggctttgcttcttggtgggaatgagagacagcagagctcccgtgagtttagacccaccgtctcactactcctgggccccctcttctctagcctgtcgcagtctgtggagtcttgttcagtggagtcacttggtgcctggcttgaggttccatgcctagccctgggtttggggatgtctgagccattgacagcaagctggcggtggacggcttcaggtctggtccaagaggcctccaggcaagaagtaggacagtcaggatgctttctgtgtatgtcctaggagagaagacacacattctagctgtcgatgtatcatctgtgccctgtgcagggatggtagccacacatttgtctcactgcctattgaagaacttgcaggcatcaggctgctcctcagtggcccccaaccccactggaactcagtgagatggagtacgctggttagggaactatcagaggcaaagaacatcacatggatatggctccctgccctggagatcagccttcttcctttcttccatcttccccttgcccctcccttgctgtgcccctccgtgtaatgtttttgtttgttcgtttgcttttggttttttgagatggagtcttgctctgttgcccaggctggagtgcagtggtgcaatcttggctcactgcaatctctgcctcccaggttcaagcaattctcttgtctcagcctcccgagtagctgggattacaggcatgtgccaccatgcccggctaatttttgtatttttagtagagacggggtttcaccatgttggccaggctggtcttgaactcctgacctcaggtgatccacccgccttggcctcccaaagtgctgagattacaggtgtgagccaccgtgcccacccaccaccatgtagttttgaaaggcaaggagatatccctggtggtcatggtgctgttgggaatgttggcctgtgtgtggcctactctgtcctgggggctggattctgggactacagctacagccccgctgggtttcacctgcccctccccggaacactgcccttctagctgatcaggcctaagatttgtcagacaaaaaggtgaacagcacagtcctgactctgctccctgaggtcagtgaatgcattttgtgtctgaaagggacttccacccccatcctctggacaccatctcttaggccaggcatacttttcttttctccttcctctttgtttcaggcttcgagctggtgttgtaagaaggaaatacaggtgctgggttgaaagtgcagcaggagactgcccacagataggggaccagagtttctgaattttgttctgctttcttataaactacccccctttttcctgtacagtgggaagaagatcttgaacttctttgggtcaggtgtggattttgcaatgacctggcacctggcataagcagagatttctggagggatgctttaaaacaaggctttgggctggtcccaccttgagggtgcccccagagctaggtctctgggccccacaaatacttcctctgatcatctctctagccatcgctcccatctacacagcgttatggaggccacctcaggcctacctcctccaggccagaccagggggcaagggaggtctgggagttgaacctgagtggccttggggactctggaggaactaaaccatctgttttcttgtctcagccacagagcaacaacaaaaacagtctcgtaagcccagcccaagagcccgcgcccttgcagacggccatggtacctcctgactacagcttctccgcctctgaccctggctgcctcctgccccttccctcttcctcctcttgtgccccctccctggcctcctggcctgttcctttcttggtccccatagaactgactgctttgtgtgccgccctgtatgccccttccccttcattgtcccgcctggccgcgctccatcccgcatggcagaagtgctgctcctgctcctgctcctttcgctggtggggggaagagtgatcagggctctcagctgaacctcccaggcccagcccaggacccctagtgggtctgctgtgggggctgggaaggtgagttgcttaggaaaggagagggtaggagctttcttgggacctgaacatcagttcttggaggcccccttgtaaaacctgcctcagcctctcctttgcaaagccagaaacaggaaagagggctggggtccccacctctggatggtgctgaggtctccaggctcctggagtgcctcatgctggctaagttctctctgggctcctccaggggttctgtgtgctcttggaggtccctctgctagtggtggctaactagagagtcagcaggggggtgactgggaaagagggagaggtgatgttgcctgctactcccctccttgcggaccctcataccacatgacgtggcggcgtggggccaggaactagggaaggcagaaggcgggcgcagtgggcagctctctgggctcagcttgctgagggggcctcctgtcctggctctttctgggagacctcattcttctgcccatgttcctgcctcacacattccccgtgatgaacgctgtgggcggggcccggcctgtgccctcagtcccacagctcctctagtgtacctgccccgtgggaaccccatgtggaaagagccctcagaactgacaggaatcagggacagaggcccttgctgtcagcctcctgggcacctgcacctgccaggcctctctttcttaccagcccagtgctgctgccaaaatccagggctatcccagctgcccgggaccccagttgagccgggatattttgtcttctggagatggctggtgggcaggcctcagtggtcatcatagggtctgcgggggtcctggggtgcaggtggggctcctcagggaagagccatagtctgtccccaagtcggaagggtaatcttcatcttctctcacaggagccacaaaccactgtggtacacaacgctacagatgggatcaaggtgagtggctcctgagcctgcctcctgctttccaggtcagcaggagacaggtgggctgggtcccaggggtctacaggctgcaccctgaggccaaggtgtttgcagaggctcagctgaaggtagcctgtgcccacagttgctccatgctgaggaagggcattataccttacagagctcaggctttgcagtcagacagacctggtctgaatcctggccctgcaccttagtatcctttatctgcaaattggggatgataataatagaatcttcctccatatgtcggaagtttaaatgagagtaaacgttcactgaaaaaataggcaagagtatctccagaccctggagcgttctccatggcctgacccctttgtgcccttgatgttttcaccagcattcctgaacatctgttaagcccagataccatccatggctctggcttacagaggtgacaagacaaattatctgttcaaacggtgggtgggatgggaggcagataaaaaaccaataagcaaacagataagataagctgggcaccgtggctcacacctgtaatcctcacactttgggaggccaaggtgcgcagatcgcctgagctcaggagttagagaccaccttgggcaacatggtgaaaccctgtctctactaaaatacaaaaaagtaggcaggtgtggtggcgcgtgcctgtagtcccagctacttgggaggctgaggcacgataattgcttgagcctgggaggtggaggttgcagtgagctgagatcacgccactgcactccagcttgggctacgcagtgagacttaatctctcaaaaaaaataaataagataaaatctaatgtcaataggtaatctgaagaaaatggcagaaagtagagagagggccaggtgcggtggctcatgcctgtaatcctagcactttgggaggccaaggcgggcggatcacttgaggtcaggagttcaaaaccagcctggccaacatggcaaaaccccatctctactaaagatacagaaattacctggggatggtggcacatgcctgtaatcccagctacctgggaggctgaggcaggagaatcgcttgaacctgggaggcggaggttgcagtgagctgaaatcgtgccactgcacttcagcctgggcgacagagcaagactccatctaaaaaatgaaaaacagaaaaacctcaccaaactagacagagagaacagggccttgaattaagtagtcaggagagggcttctttcaggaggtgatatctgagctagaaactgaatggtgggtgggaaggaggcagccaggccagctctgaggctgagtgccctaagcagaaggaactgaagctcagatgtggcctttgtaatcaagcagagggaagagcaaagtgagacggggagaaccataggagagtgatgaggttggagaagcagcagggcctgctacagaggcccttgtaggagtttgcattttcttccagcagcaaggagaagctattgggagttcttagcaggagtaacagaatctagttgacactttaaaacaccactctggcctcatgatcaagaactctagggaggcccgggcgtggtggctcacgcccgtaatccctgcactttggaaggccgaggcgagtggatcagcaaaggtcaggagctcgagaccagcctggccaacatgatgaaaccccatctctaataaaaatacaaaaattagccaggcatggtggcaggcacctgtaatcccagctactcaggaggctgagacaggagaatcacttgaacccgggaggcagaggttgcagtgagccgagatcatgccattgcactccagcctgtgcaacaagagcaaaactctgtttcaaaaaagaaaaactctagggaggaggtaagtgtggaagttagggagaccatgaagctgttatcatggttcaggtgtgagatgctggtggcctggagtcaggttgtagctgtgcattggaagtgaagaggtaagacatggggtttactttggaggcagaaccagaagattttattttagattgggcgatctgaatataagggaaaaagagaaagagaaggattgaggatgactccaggttttagcctgagtaactgggtagatggtggcatttaccaactgggggaagactagggaggggatttgggaagagtcagacagccagggtggaagcagaaccttccacaattcctccttgcacctcttgtaggagcagaaactctgcttttgttctgctttgctcctctggcttccaagggatggagcatatagaaacatgttctttttggcctacagggctccacagagagctgcaacaccaccacagaagatgaggacctcaaaggtaggtgctggcccttggagggggaaggactccagcagtgacccaggtacctgggctccaatggggcacctgccttttctgtccccagaactgggaatgctggctcctatgcccctaggagagggcttggtataaaagctactttccacgagccaagatatgaggcccctgtctggtgttgctgagttgggcaagaggcttctcttctttgaccccaagtctaaaatagctaagctagagattctccaggggccagggctcagagaactgttcctgttgctgataatgatgtgccatccaagaacaggggtaccccaagtccctgccgaagtagcctgtaagtgctatgagtcataaatagagtgaccaatcactcctggttttcctcggacacagaacttttggttttaagactgtgatgggccaggagtgctggctcacacctgtaatacccagaactttgggagggccagggcagaaggattgcttgagaccaggagtttgagacaagcttgggcaacatagcaagaccttgtctctattaaaaaaaaaaaattaggaacaaataaataggccaggtgcggtgactcacacctgtaatccccacactttgggaggccgaggcaagtggatcacttgaggtcaggagttcaaaaccagcctggccaacatgatgaaaccccgtctctactaaaaatacaaaaaaaggccgggcgtagtggctcacgcctgtaatcccaacactttgggaggccaaggtgggtggatcacctgaaggtcagaagttcaagaccagcctggccaacatggtgaaactccatctctactaaaaatataaaaaattagccaggtgtggtggcaggtgcctgtaatcgtagctactcgggaggcggaggtgggagaatcgcttgaacctgggaggtggaggttgcagtgagccgagatcaccccattgcactccagcctgggcaacaagagcgaaacttcttctcaaaaaaaaaaaaaaaaaaaaaaaaaattagccgggtgtggtggcggggtcctgtaatcccagctactcgggagactgaggcatgaaaatggcttgaacccgggaggtggaggttgcagtgagctgagattgcaccactgcactccagcctgggtgacagagcgagactctgtctcaagaaaaaaaaaaaaaaaaaaatatatatatatatatatatatatatataaatataaaacccagatagtcctgggaacactgggatgagttggtcactctagtcctaagattttggcctgaatgatggagttggaactaatctgacaaccgtgaggccacatttggtcatgtcctggtgggcccgtaaggaccactagcctaagcttgggcctggctagagtgccagggcggtgggagggcatggcaggctggacccccgggaatctctgtcctgctctttgattgggcctcctggaattgctccctttgcctgaattcagtaagtgaccttgggccaggacatcagaaaagacagaggaacactctaggacagagctgggagagcatgccctgggtggcaagggggcaccaaaccttttggaaccaaaaaaaatagcagaaagctgcgaggaagtgaatcatagtagctccaggcccctgtgagtgaggtcagatcagttttgattccggcactgctggcaacataggaggcgctgtcactgctgggctctggaccctgtggcctggccccctggaacatcttccccgggatcaggggtccttggacaggctgttgtaaggctcgtctggaagccacagcccaggtctgggcacctgcctggtgccctcagctgggaggcctctctggcagaggcggcggcgtgggatgtcgtccagtgtccacagcagcctgaggcgaggcgtccccttgccccggctctgcagcgccatgggctcggggcctgtctggcttgctcgctcacctgccttgttctgtttgttttggctgctctgccttgccctgccctgccctgccctggctggctagctgccccgctccgcactgggaatggcagctcggtgcctgaaggacggagctcccgggacagaacagccccctctgcaggcatgcagccccagccttctctctgctcctcagccagtaagtgtgagggaggcacattctggcttccgtctccctggctcgtcctgaagcccctcagggacccccaccacagctgtcagtcccacccacctgcccgtggtagtaagctctgggagcatggcctctgctgggggtggggggtagactggaggtgctgttgagaccaggcaggggcccctgagtctggggcccaaagaaatatgagaagtgtgggtggaaaaacatggcctgggatgaggggagtagaaagcccccaggatgtgcagtgggccttgcctcagcgctgagccaggaagaagggcagagtcggaagtcaggtctgtgggggtgggagtgggatgatggggaaatcgtgacagcgaggaactgtgttggggatgtagtgcttcctgagtctcagcataacagtattaagagcatggggtcagaggcaagatagatctgagtttaaatcccagctacactgccttcaagagtgtgaagtttaacctcccagagctgcaggttccttatctgtaatgtggaaataaaatggcacgcacctcagagccttgttagataaaagacaaggcagtaggaagtcttgatacggtgcctcgatgggttatcagtagctcatcctcatatttctagttacgtctgtgctggaggatgcctttgtctgctgcttttcctcccaccatctatccttgcagagtttctaagcacaaccctcttcgcccgtggggccccagtcaggtcatccagatgggtctggtggggttggagagggtgtgtgtgttgtgggtgcacacctgcctgctgcttttggaagccgatcgaactccttgcttcccttaacctgctgcttgctcacctggagctgtggcctagcggggctgacggctgtggggccccctcctggatgtgcctttggctgcgctgccctgtcccaactgtgctgcttggctgtgctggcccggctgggccgtggtggtgctgttctaacgcttgcagttgtcttgcagccttttgctcctgtgaggaaagggttgtggcctggccccgcccagggctcgggttaggatgagcccaagctcaacccaagctctcccttaccctggtggcagcccctgctggtagtggcattccctataagagaagcccatgccggcaggacatcaccagctgtcccttggctttggatgggttggggaggaggcctctggagggcaccacctctgcctgcctgtcagtctgagccctgtctggttttcctgaggaacacgtcctggcaatgagagctggtgtgaaatgtgcagctttcccaagcctcgagaggtaaatggagcagcctctctggtacaggctgtcccaagtttttacagttctgggatcatttctcccagaaaagccctgtggagttgagcagtgggaagcatccatcctagggttctgatggtcctttggcaccccagccctagctggattctgctgtcaggctacctgtcacccagggctgggtcctggccactgaatgagggctacgagtgggggtggtgattgagacctgactgagccccttcaggtgagagaagtaaattgggggtggaagcggccttattgggagatgcttgtgagagaggctgctcatacaggggaggggctcacagcattcacgatgtaccaggctcctcacctgttaaaggcaagcgtgttttctgcaacctggttgttgatggaaagggaggcaaaggccaaagaaccataactaatggctgggcttcaggagaaagtggtcattgtctctgcagactgcagagagggagacgggagggaaggtgtgttcgctcttcctgccaagggccctagagacagagaagagggatgtctttgtcataagcgatcacaggggactcctgaggactggggagggctctctgtaacttgggaggttccccagtaggtaaattgatggatttttctcccccacagtgcgaaaacaggagatcattaagattacagaacagctgattgaagccatcaacaatggggactttgaggcctacacgtaagtagagacccatttttttttgtgacctaagtcatctcccaaggccttccctgcttccagacaacaattaggaccctggggaaagggaggttggaccttgggcaaagtatctgagttaagccctctcctaaactgggagcccttccaggtagattccctgagctcacccatggtatcctggcagtgggccgaaagcacagggctgagtggctcagcaggcaggcctggaagatctttgctgtcttgtctggcatggccacaggtagcctgctgctactggatagacaccgctgataaggaaggaagacaagtcactccatagaagcctgataggctgcttttttttttctccctgtaggaagatttgtgatccaggcctcacttcctttgagcctgaggcccttggtaacctcgtggaggggatggatttccataagttttactttgagaatcgtgagtgggttcgtgctgctgatatactcctgcctgcccctttacccctttgtctctgtctcctgctcaccttctcatcccagttgcccacttttcccttatttgaccttcgtgctgcactcctactctgtatgcttgtccccttgtgccccgatggttgtagacaggcacctttgaaggccctgctcctgagctccaagtgccattcattctgcagctgctttgtggcagtgccagtcaccacaatcaagctcacttatttcttgccgggcgcggtggcttacgcctgtaatcccaacactttgggaggctgaggctggcggatcacgaggtcaggagatcgaggccatcctggctaacacggtgaaaccccatctctactaaaaatacaaaaaattagccgggcgtggtggcggtgcctgtagtcccagctactcgggtggctgaggcaggagaatgatgtgaacctgggaggcagagcttgcagtgagccaagatcaggccactgcactccagcctgggcaacagagcaagactccatctcaaaaaaaaagaaaaaattatttaagcctcacctctttccaagacggattggaaggaaaccctttgagattaggttgagatgatctcagcacataagaactaagctctgtgtctgcaggtttcacaatagaggaaattaaaaccaggataagaatgtgcaaaccagggcactgttggtgatttgcgagatcggaagttgtggctagaatcttcctgactatggaggaaggcagacgtcttgtatagggggtggggtgtacattctggacagttcatggaaaataaggggataagaagctgaatcatcaccccctcccatctttctctctgctctatgagaccctccccttccttatttttatctcttcccactttatgctgggccttccctatcctgccctgagttatagttagtcactaacttctccgctggctcccacccttatcacatctcagctacatatataaactctctgttatctaagtaattctattagccagaagcaattccagagtttatattagtactaggaaggtgtcatgtagcccctgtctaacatttgaattgaactaaaatgtgaatctcaataaaagcaacacagttttcacagcatatgctgataatggcaatccaacttcttttgccttttccccagagaatcctgggaatatcctgagcttggtgctttgatgattctatttcagctttggtgccttaaaaaaaattacaaatcaattttgaatggtttaagttcatgattttgttctgcagccctagctaggggtgagccaagccttatgaaatctaaactcagcctaacagaatagaaaatctataggctttagttaagagtcacatggtcctgagttcaggtgtgtgatttgagcaaattattccttgagcctatttcctcatcttataatgaagaaaatattatccaccaagaaatacagctcgggcatgtaaaaccccagcacaatgcctgattaaaagcgcagcaggtactgtcactgttacccatctttctgttccttttggataaaggagactaatgtaatgtggcatcctggcctctggagggcgttcaggggttcgggggtgggggggggcggtacttggagattctgggagtggttgcttgggagatggtaagacttggaagtgcaggctgggaggaaaatgcaggtgcccaggcctgatgtcctcttacctaccccaccctgccctgcagtcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggtgcacctggttgacgggggagaggggctggaagggcctgggataggtggggtcagaggaagaagagaaggctgggaggtggtcctgggagaggaggtgtgggccgtcccagaggactggcaaagcctggcagaatggttgcaataagttatgcttggaaatcagacagactagggtctggctccgtgactccaaattggatgacctcagacaggttacttcccctccctaaactgtttccttagctgtcaaagaaaggcagagagtggtgcctacctcatttaatcattgtgaggattaagtaagatactataagtaaagcacttagttagtgcttagcaaatgggaggcagttttgtatttaagcattagcttcacccactttccccaccttctcaggccgacttggccatgtgtttagcgtgctaaagtcgctggaactcatctgtgtgctcattgtcctctgttctgttaccacattctgtcctgtttgacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 37765 - DNA, 41489 bp, Homo sapiens
atggcgggtctgacggcggcggccccgcggcccggagtcctcctgctcctgctgtccatcctccacccctctcggcctggaggtaaggacccctcgcccctgtccccagcgctgcccacagctgcgggccctttgggccaggtgactagacgctcaagggggagaccttcgtccctgggaactgcaaggggtcccaggtgggagcccctcagccactgggtcctcggaactgcccctcccaggagccagccccgtgcccaggaggaacctgtcaaagagacaccctcgactcagaatagtcccagcccagcatccaggctttgctgccctgcgagggctgagggggcccctgctcaggtgcccgggtgcccgccctgtagggggatcagagcatcctgggggagggcccagcgggaacccctgggtctggagacaccacagtctgcacacctgtggacacagctggggtgcacaccagccctggggacagggaacctgggcttgataccagctcaaccgcagtgagctgtgtgacctcagcaggttccttgacccctgggaagccgggatccccccgtcaggaaggtcagggctccgctgaggatgggtttgcaggttgggaagctgctgctgtgttctccctgctgaggcaggcagggactcctggtatgcatttgtgtgtgtgtgtgtgtgtgcatgcacacaggaatgagcgtgctgtgtgctcgtgtgtgtatgtgtgcatgcacaggtgtgcatgtgttcagatgcccggctgtgtcactgaacagggaaagggatttctggaggggtacatatgtctgctcacaggttcatccttaggcaggtgtatgcgtatgtttggaggaggtatatgaagctgctccttagtgtgtgcaaaagtctgccacctgacagacatgtagacatgtacacatgtagacatgggcgatctggcatccaggtgtgacactggtgtggactgtcactgtgtgtgttatggagtgtgtacatctgtgtgtgtgaatgtgtgtgcgatgtggcacgcaagcatggaaaggcgggctggagaaggtgtctgtctcctggcagaggcagtgtggctgagacagaggctggagtggatcctggggcactgctgggccatctgctatgtgccccaacccaggcacagttggttatggggtttgagggtgtgccctgtggggctgctatgccgcggccaacgggggaggacagaagaggctcccgggcatgggaaaaaggagggcatttggtaggggggtctgggtggagtctggtttcctcgggagtcctccttgccatgagaaccaaacgctgagtggggggcgggagggccacggggtggagtcaagggcctgggcaggagctgcagctgtttccgtgagattgaacagcttcctgtgcagggtccgctgctggacctggatgaggccaagggacatgggtacccacaggcgggccccagcaggggcaacgagccagggcctgaaagcagcagccccgggtccgtctcagcctcctccccaggtgtagcccccaaacacccagccacccttcttcccagatggggccaccacctatagggtggcagttcatcatcaaggaaccttgagaattagaaattattatcatcacttgacaaacaaggaagctgaggctccggcaggctaaggcagtccccgggggttagtatcagccagctctctgccccaggtcaaggggcaagggggttaggagtgagctagcaggcaacatttggggaggggaaggcttggggctgagtccttaaagcaggcatgccctaggcagaatcagctctctccttgtgtcctcagtgacaccgctaaacgcccagctggcctcacactttgcagagatcaatctcagctctgtcccaggtggctggacttgctaggtccaaataaggggtgtgtgaactgatgagctcgtgtggggttttgcacagaagtgctactgaagtctgcagaggtcggggagccaacacagggagtggagcgctcagtcacatgctcactgccactcacctggctgtcctgggggagcctggcttctccctcaaggaggagggtgtcacttatgcaagttcagcggctccaaggaaggaaccctgttgcgggggtgggggagcaggaggaggggacaagccgcacagctcccaggctgtttcaaaagtgagcatgagaaattaacccagggataattcttccccatcccccagaaatagtatcagggatttttttttttttttttcctgatttcagaactgaagatggtttggaacagaggtttccttttcttttattttccttttttatttttatttttttaccttttttattttttttaaattgagacagggtctcgctgtgttgtccaggctggtctgaattcctgggctcaagtgatcctcccacctccgcctcccaaagtgcttggattacaggcatgagccactgcctctttttaaatatttttttaattattgttttccgtccttaagtaggaacaggggttttcaacctggctatctattagacttcccacccaagaatccctgcttgctttggttggagagggacctggacacagacttttcaggcttcccaggtgacggtggggtcgccagggccaagaagcactggtttagaggtcgatcccgctctgtgtgtctgccgaggccccggcatgagggcaaatgtgccctgtgtgggaggggacacagtcacccagtggaggacagcttgtttttgaaaacccttggcagccttctgcatgcaaacaacaaacagcttcgtgtggtcttatctgctccccaagccagccccctggactttggtttggcaaagccccctgccaagatcggctggccccaggctcgctcccaaacaggctgcttccagctctttgaacctggagcccagggcccaggcaaatggccctacatgtgacttggggtcagctgggggtcccagaccaggctcttcagctcactggttctccatttccctggctgcaaaatggggagaaacagccctgcctgaagtacctcctagggccagtgagagcttctagcaatgtaatatctggggggaaaaaaagcatcaaataaaaggaccgtgggaatgggcatttttaaaataatctattctcttattcagagtctgctaatttgggctcatggatccttgtaattagtgcacattgctaaggtttaatactccctctcactacttacaccatgttttgtctagtggaggggcagctaatgtgtaaatagatgtgcaatgatgaaagaagcagacaggactcggttgggggtggccagaaggagccttgagaaatccaggaaggcttcccagcagaagtgacatttgagttaaacctaaagagaaaagtaaatggggccaggtgcagtgactcatgcctgtaatcctagcactttgggaggcccacatgggcagattgcttgagcccaggagtttgagaccagcctgggcaacataggaaggcccccgtctctatttaaaaaataaatgaatatttaaaaagaaagaaaaagaaagaaagagagagagagagagagaaaggagagagagagagacagaaagaaagaaaggaaggaaggaaagaaggaaggaaggaaggaaggaaggaaggaaggaaggaaggaaggaaggaaggaaaatgttggaggacctgtctgtggatgaggggtaagtccccagactacaggccctggcaggcagaactgaagagacagaagagcagattctcgattggaggaagccctgtctgcagttagtgctgacagcatttggaggtggtgattttcccatcatgggaggtatgcaagcagaacacgaaggatgtttgtggaaggaggtccagcccaggccagaagactattatgatccctgagagtctaggatcgtgattctaagatgcaagagacaagttccaccctgggctagtcggtgaaacatgccaaaaccacataaaacaagacaagtgttctccaggccaactgcttagggccagctgagcagcacagtcagggagagccgtgggctcgggaaaggcaggcgggagagtctgagctcagccctggtgcgggggtaggacttggacagaggcaaggacattcctggcaggagaaacggcttgtgccaaggagtggagggagaagtgaggatcgccacggggcctggggaagcagctgttaccttttcaaagtcctttccaatttccagctgctgtcattttattctcacctctctcacttgcagagaggcaggaatccttcgtagcccctaaaccttctccatttcctcattgcaaagtggggattaaaacctcgggctccccaggccgtcaggttcaggcatgaagtttggcaaatgccaccatcatcagggtctgaacggtgggggtggagagtggggacagaggagatctgggggaggggaagctaagtcttccccccagaaagtgcctggggtgcaggagggcagaaccccaggagaaaggaagtcagggttcagccaggcccaggggctcaacaagcccaaggcagggggactcccagggcagatggggatgaaacaggttagagctggattcacagacaaccaccctgccacccctctacttaattcacccatcatgtattgagtaactactgcatacctggccctgggccacggactgtgcagtgaaatgggaaaaaatgaaacgtaagtgccactgtctttttatttttgagcaattactgtctgccaggtccagaagaggacatagcctattacttgaacccttttacaacttgcagcaaccttgcaaccttgcagcaaccttgcaaccttgcaacaaccaagtgattatctgccccatgtcacaaaaaaggaaaccgatgttcagagaggttgagtgactttcccaaggtcgcacagatggtaagaagcagcgaaggcagaattagaagccagaggggtctgttctgagcactttgctcttccccccacctccaccacactgttccctgcagtctgctctggagccagagagtagagaggaagggagagaggcacgtgaagaatgagggagagggggagaaagaggaggaaggagagaggccgaggcagagaaagacgcataagagactgttgagagctggaggccggagccagggaaggcatcagaggcccgaggcgggccatgtgtgtgcttggcagcggatgacagggcccaagtgctccttctcagcaggcccagcccccctggggccaccactccgagccttgaggttctgaccagattacttgcacacttcaggcctggactgcagtgcctgaggagccacaagccctgggagggggtggcgccggggtcttggctccggtggctgtgacagctccacagccctgaccctgctgggctgcagctgaggctgacagggccctggggccagcaagcccagctgtgcagcgtcgccaggcctcagaggccagacgtctggccgcgaggcctccctggacacattgcagagacacccgttcccccagccccgcccatgccccacggggctcccggcccctttcagcaaaagcagtaagggagggctgggctggggcgttggcaaggtggcttgtcaagctcagaggggggccttctgaggtggaggcagggcccccggtttgggaccctgtctgttgccatggcgatggctcaggcagggtctggatccagcatcacagcgttccccagtgagagcttcactggtccatggggactgaactcgtgatcctgtctggccggtgaattcgcttttccttaggaaactattcactgtgctcattcatggcgtccccctgcggccccggcgcctcctaagacagcccgtgtcagacggccagagccccacccaagctcggctgcccagtggctgaggacgctgacctcacgccgtcctatcagtgtgggaatggctgcatttgtgctggcagctgcacctccttaatgctcgctgtagcagcccagcctgcccttcccaaagctctggcctctacccggcagctcagctcgggaagggagtgggctgcctggtgagaggtgctcagacccagtgtcttccaccccaggccctctccctgactccagggagaaccaggtaacacagcaagaacaatcatactctaaggactggcagcagggcgcaggggcctgtcatcctagcactttaggaggccaaggcaggaggatcgcttccaggagttccagaccagcctggggaacatactgacaccccatctttacaaaaaaatcaattagccagatgtggaggtgcacgcctgtagtcccagctacttgggagactgaggcaggagaatcgcttgaacctaggaggcagaagttgcagtgagctgagatcttgctactgcactccagcctgggtgacagagcaagactctgtctcaaaaataaagcactggcctgagcttcaatccaggccccgtctctttccagctgtgtggccccaggcatgtcccttaacctctctgagcctgatttcatgtcttaagatgatagtctctgggagcggtggctcacacctgtaatcccagcactttgggaggccgaggcaggcagatcacttgaggtcaggggttcaagaccagcctgcccaacatagtgaaaccctgtctccactaaaaatacagaaattagccgtgcttggtggcatgcacctgtaatcccagctactcaggaggctgaggcagcagaatcgcttgacccaggcagacggaggttgcagtgagctgagatcccaccactgcactccagcctgggtgaaaggccaagactccgtctcagtctcaaacaaaacaaaatgatgatagtaagccctgcccttccaacttcacaggccgatttcaaagagcaagaatgagaacacactttgtaaacagaaactgctctggagacaagcaatgtcattattgccatcagcattattcttgtttccatgtaattgtgggttttgccattgaaagtaatggcaaaaatcgcagttacttttgcaccagcctaatagttctggctcctggaggactgactctacctgtttcctttcaggggtccctggggccattcctggtggagttcctggaggagtcttttatccaggtaacgtacatgaaacttccacacacccaggtcatgcggatgatgctgatgtccataatagatgcacattttgacactacagaaggtaggaacattgacacgcctaccagaagtcacacccacttaaaaatgcaattaacaagacattgatttacagctattaagagcatacaggctggacatggtggcttatgcctgtaatctcaacactctgggaggcagagaaacaaggattgcttgaggccaggagtttcagaccagcctggacaacatagtgagatccccctctctacacacacacacacacacaaatttaaaattagccatgttctgcattgagaaaaatgaaaatgaagtatagaaattaaaaaaaaattagctgggcatagtggtgcacgcctgtagtcctagctactggggaggctgaggcaggaggatcacttgagcttaggagttcaaggctgcagtgagctataatagcaccactgcactgaagtctgggtgacagagtaaaaccctgtctctaaaaagaaaaggggaaaaaaagaaaagaaaaatcaaaagtaatactttcaatacttaaaaagtatttgaggccaggcacggtggctcaagcctgtaatcccagcactttgggaggctgaggcaggcggatcacaaggtcaggagatcaagaccatcctggctaacacggtgaaaccctgtctctactaaaaatacaaaaaattaaccaggtgtggtggcgagagcctctagtcccagctactcgggaggctaaggcaggagaatgatgtgattgaacccaggaggcggagcttacagtgagccgagatcgcgccactgcactccagcctgggcgacagagggagactccgtataaaaaaaaattaaaaaattaaaaaaagcatttgagtgtacagaagtgacctggaagtggggagagacgccagcactcccccagatacatactgacactggactactggccaagcagaagagaaaaccgaggcttgcagagagcaggtcttgcccaaggtcacgtagttaggcagaggtggattcagccatagctgggggtggcagcgggcttgcctggcagaagtaccgatgatctctctttctctttctctccccccacaggggctggtctcggagcccttggaggaggaggtgagctcagaaaccacacttgttcatcactgaaagggcctgggtttcacccgagccacatgcatcctcagacctgagaaccctgggagacccgagcatcaaggactccctcatttcacagacagcatccaggcggtgggaggaggcttctttgagaaccagaacccattggccttcccagtccctcccctagactttatgtctggtgccctctgccttcctatttcttcttttttttggtgggggaggacggggggacagagtctcgttctgtcgcccaggctggagtgcagtggcgtgatctcagctcactgcagcatctgcctcccaggttcaagtgatgctcctccctcagcctcccaattagcgaggactacaggcgcgtgccaccacgcccagcttatttttgtattttttctagagacagggtttcatcatgttggccaggctggtctcgaactcccaacttcaagtgatctgcctgactcggcctctcaaagtgctgggattacaggcgtgagccaccttgcccggccccttgcccggccccttcctatttctttttatcctcaaaaacctccctgccaagccggctgagcaggcaccatcttcttttttttttttttgagacaaagtcttgctcttgtcacccaggctggagtgcagtggcgcgatctcagctcactgtaacctccacctcccaggttcaggtgattctcctgcctcagcctcctgagtagctgggattacaggcacatgccaccacgcctggctaatttttgtatttttagtagagacagggtttcaccatgtttgccaggctggtctcaaactcctgacctcagatgatccgcctgcctcagcttcccaaagtgctaggattacaggcgtgagccaccacccccagcccatcatccccttttgaggctgagactctgggactcagagagtataaaccacgagttagaagtagagctaggttcccaggggctccaagtctgagcgggaggacctggggtgtgtgattccacactgcccacactttgcccgggttgggggttggataagtagtagatggataagctgggccaccccattcactatcttctcttccctctgcagcgctggggcctggaggcaaacctcttaagccaggtaagacccaaggcctcggagcattgagagacagcgagggagctggggagggaggagcctacccagctgggaatgggacaaggaaactaggaacaggacaaggaagccaacgggcaggaggaaggagggaggtgtggacaccgattagcctcccaaggatgagtaggccggggccaggtcccagggcttccaggaacaagaggctggaagcagctccatgtcctccctgtgtgagggcgtctagcatctaccctacatgtgcatgtgtgttcacccagctgtccagagactcctctctgcaaaggagaggctgttagaggcaacatcagggattgctccggttccagtggcctccaagccttacatgaccctcgggagctcagacacagatcctcagccccagacttcccctgagtggtcccctagcccttgaccccagaccaataccccagatcaccctgaccttgatgccattctgagcccttctcctgactccagatggagcactggtctcaagccaaagcttaaccccagcccaagccctgagcctaatcccaggctgaaccctgaccctgctgaccctggtcccacaggacccccaatcctggccttaggccaagccctgaccccaagcccaagctgagcaccgaccatggccccggataagctcccctcctaatctcaggccctttccagctgtgtccagaccacggagttttccagtaagaaggtgtggccggatctatcctggcctcgcccaaggggctgggatctgccacgagggtccactctcagctctggggaatgcacccccaggaaggaaggtggggcaggtccctccgggaaatactggcggataaggagcaggtggaggaaacagcgtctctgtccagattgatggtccctcggcatgagacgctccacatgtgactttggccgccccacaccctgagctgtgttgccctggctcagaagcccaagtctccaggacacagtttagatgtccaagagctcttatgaaatcctgatagttgataatccaagtgcaaatgaatcttcaagacccagattcccctgcgctaaaagtccatctgggttgtgaaacaccagggctggagccaggagaggcgggagaacggggtgcctggggtctacagggctctgcaaggccaggagaccctgggagcttgccacttatccccgccagcacctataccctgtcttcctggagcaggtgagggttcttagcagggtctttgacggtgaagagaggacaggggagatgatagtggtgcagaggtgtggaggtaggtctgtgcttggcctagaagacccaaattgaggaggttgtgcctgcaaagctggagggtacattcattgatcccactaggagcaagagacacatagcaggttgtggttaaacaccagaggaaagacagacaactccctacgaagttccaggatgtgtagttgcaaaagtgaagcttttgttaatgaaagatttaggttagacttctgaaagaacttccagctcagggtgaaggagtcaatccaaaggaaagtcagagcatctccttctgataaaaagggcagtgtttccaggcaaggggctggattccatgacctccccgaagactcagggctacagaagggtcggcagagcccccatggcacccccagggaggcccccacatccgggctgccaggacgtctgggcctgcccaggcaggatggaatggagcacaggcagcgcgtgtcatgcttgggaacaattaatcccttggtgacagagggtgggtggcctggcagctgcttttccacgtgggcgccaccacaggtccaagctggccctgccctgcctcagctctcagcgggggaccaggcagctggaagcctgcacacccaacaccctgagcactagccagaggccagccgcccactgagaggggcacgggcatggacaagaaggaactgggagcacccactgtgtgccctgggtaggttgcacaactaggtgctttctgcacacatgctcactggtcccagcaaggcaggtgatataatggccattttgtagatggcaaaaactaagcctcatcggagaggcaaattgacctgcttgtgctcatggaggctgggtagcagcagcagggtctgaatctagaactctctgactctagaaagaaggaggatggagctggccaggtccctggactcccagctgtggtcagcccctccccgctttctcctcctttccagatgctagaatccttggggcatttggggcaggtgagtgcaaaggaaggagggcaggcagagacagaagtggtcaggccacatgacaggatgctcaggctgggatcatgggaaaaaggaagatggccccagagaagctgcctgccccccactgcagccccagcctcttctcacttcctgtgcagtcctcagcttcccctcccagcccctctgtggacaggaaaggtctgagcatgtcccttgccctctcagagctcaggaaacatgcctggcttgagagaagcgactgccagcgcaggtgggtctggcccgggtgctgggaagtgactcctgcctgatcgccaggcactcccgcccggaggcaaagatgcttcttacatgaggctggctgagtttcagaggggtccagctcccactagtaggaaatgagggacgaggagtggttagtaacggagaccacacccagggaaagccaggggggacctctccagggtacagcaggctccatgtttgggatccatccctggagaggactcacccctgaggctcaggactagcacttgtaggagagatcgtcacataattagaaacaaacctggcatggttgtgaactctgacctgatggcccattggtcctggccaaggcagtggaatgtctcccgcagtgggagacgaagcgattgggcccagatgtggggaggagagagccagagggacccatttggcgtctcataaacatcttagtaggaggctcctgggctgcagggcaggctggatggaaggacagatgggtagtggggacacaggagttccccgatgcaggtgaaggggaggggactgagtcaagagatatctgcaaggaagcagaagagagacctcactggcctggggtgaggtctcgctcacggactctgctctgtcccagcccttgctgaaagccctgctgaatcttgttagccagcagggcttctaggagaagcacaggcctggcccaggcttgttagggatcggtgcaatgacacctgcactgcacatagtagtcgctcactaaactactggtggatgctattttatcaggatcgaccctgagcatcacaggcttagggaccagcctagggacctgagtggctgatcacagcactgccctaactccaggagacatttcccactctgggcctaggaacactgcctacactcctgtctctgtttcttatccacagttcccggagggcttgcgggtgctggccttggggcaggtgagtgctgacacccaagaaagatatcccctgtggggaccagcccctgagctcaacccagggctggtatgcagcacggtcatggaacaagggtgcaggccaggttccgtcctgggcactgacggggactgatgctgataccaactgccccaagcagctgcccaggacatgaggaaatcacagctgagtacctgggttcctttataacatagtagtgaaggctgcatggaggaagccccatggaccaaggaagcccaagggagtcgcttaactcagcaggggttcaggaaggcattctagaggaggtgggtggggaaatttgaccccaaaagatccatgcagttttcaggaaggctgaagtgagaggatcccttgagcccaggaggctgaggcttcagagagctatgatcatgtcactgcactccagcctgggcgacagagaaagacctcatctcttttgttgttcttgttgttgttgagacagagtcccactctgtcacccaggctggagtgcagtggctcagtctcagctccccgcacctggtgcagttgatctcagctcaccacaacctccacctccccggttcaagtgattcttgtgtctcagcctcccaaatagctggaattaccagtgtgcaccaccacgctcggctaatttttgtattcttagtagagacggggtttcaccatgttggccaggctggtctcgaactcctggcctcaagtgatccactcacctcggcctcccaaagtgctgggatgacaggctcaagccaccgtgcccagccacaagaccccatctctaaagggaaaaaaaaaaaaagagccatgcagttttgtcagagctgtctaacacattaacctcggcacacaatctagttctggtacttaggcgcggtggctcacgcctgtaatcctagcactttgggaggctgagacgggcagatggcttgagcccaggagttcgagaccagcctgggcaacatggtaaaatcttgtcactacaaaaaatacaaaaaaaaaaaaatttgccgggcacagtggcatgcacctgtagttccacctacttggaaggctgaggcgggaggattgcttgagcctgggtggttgaggctgcagtgagccaagatcgcaccactgcactccagcctgggtgacagagtgagaccttgtgtcaaaaaaaaaaaaatccattaccggtgagcagtgctcacatggatgtcctgcaggcattgatgtctggcagagagcggaagagcctccaatgtgcttcctgagtggggcacagccaggcagggccagagcgtaggagtcttcataggtgtggtagctcaggacctcaccccatcctcccctccgcagggctcggcgccttccccgcagttacctttccgggggctctggtgcctggtggagtggctgacgctgctgcagcctataaagctgctaaggctggtgagtggtgctctttgggacatgccacaagccctctggcttccgtggggccctccgctttgcaaagaaccttccctcaactcaggcttgggagccgggtgggtgggattgtcagttgcaatctactggggctcagggaggcagctagctgtgcccagtctgaaggtgagttagtaacggggccagacctcaatgctgggccctcagcatgcagccccgggcccttctgcctccccactgttccttacgcaatgcctcacctgtcctggctctgcaggcgctgggcttggtggtgtcccaggagttggtggcttaggagtgtctgcaggtacgatggctatccccgaactccctgggtcaaagttgcaggcctgggtggagccaactctgatgcagccccttctgtgccaggtgcggtggttcctcagcctggagccggagtgaagcctgggaaagtgccgggtcagtgcggaatccctggggctggaggacagagggcagggaggggcagagggcagggaggaacagagccctctccatgccactgcacttggggaggaagggcagggcctggcttcagtcgggcagagaaactagccaggctggtgcctgcgtctgtgaaatggggaggaggggcctggcccacttcccgggcccttctcccgggatcttggggtagaaagagacgggctctgtggcaggctgtcgggcgacagatggggaaactgaggctcaaagaggcgagtcagtgtggaagggcctgcagcgagtcccggcagagctgggggagccccgtgtcctctgactccccatctggtactcgttctgccccaccaagccctttaggaagtgacttcaggttaaacaaaagactgcctgagtctacgcagcagggagggacatctggaagctgttagccagaggtgggctggcccagccatgtaaacaggctccaggagacggagataaatccacacaccgaagagtttgcagatgacttccgaaactcgtgggaggagggttgtggccaccccacgtctgtccctggctgcccctgtcgggcacagaggctgtgggtttgagggccttggagctgcctgggtgggaagggctggggaggggtccctggaggctgagctgctgctagtaactttgctttcttttggccacaggtgtggggctgccaggtgtatacccaggtggcgtgctcccaggtgagagcaaggagggaaacagggactctataggaagaaagcagccaggacgcagtggctcatgcctataatcccattgctttgggagactgaggcaggaggatggcttgaggccaggagtttgagaccagcctgggcatcatagtaaggccctcgtctctacaaaaaaatttagccaggcatggtggtgtgcacctgtagtcccagctactcgggaggctgaggtgggaggattgcttgagcccagaaggtccaggctgcagtgagctacgatggtgccactgcacagcagcctgggtgacagagcaagaccctgtctcaaaacaaagaaaaagaaaaaggaaaagaaaagcagccccctcagcctccctagtacccccctcgcctccccgaaaagcagaggccaccagaagccctgggtcctgacctgagccatttccccaaactccaaagctcaggctaacagacataaggtccctggcagtccgtccatcccctgaaggtcaaccagccttcctgcaccccacccaagccctgatcccaggcacagaccatcatcacagcccgaggcgggcccccgaggacagatcccagtgtgaccagctatttcccaaaagctgtgagtcaccaaggggccacccaatgagtctgccctgcaggagaccctaaagagctgcccctcaccctcctttcccctgccagggcctgaccaccccacccaacatgtgacctcctgaattcccccaaaagcccagatttaggctgttatgtgggatttgctgatggagtggcccttcctccctctctcccccactacgctgaaagccaaggctgcccagccccaggggagacaggagaggtggaagacgctggcatggtcccagctgtagctggatggctgctttgggggtctgggttgtgagcgagagccccagagagcatgggcctccctggtctacgggcgagtggcaccgcgcagcagctgtccctctctttaccttttctgcggagggtggtcgagacggcttttgtgattaactccagcatagagatgaggctgactgaggcaccagctcacatggctgggaaataggattaaaactcagatcttctgaccttgagccagacagggaaggaaagtcagcactaaacaggtcctttctccacccaccccgtgagccgtgcctgtcactgacagtcagtcccaagggaggtcagctgggggacccgaggaggggaggggttcccagcagggcctgcaaggcctgccttcctacactcactgctttgtcccccggcaggagctcggttccccggtgtgggggtgctccctggagttcccactggagcaggagttaagcccaaggctccaggtatgcagctgtctggacagagggctgatggcagggactctccaaccaccttctggccccgggtgtgaaatggggtgggatcctggactggctcagggccctctgggtgacactttttatgttccagccctgggcagcctggtgctgaaaaacctcagagtgtggctgggcacactggctcacacctgtaatcccagtattttgggagggtgagctgggaggatcgcttgagcccaggagttaaagaccagcctgggcaacatagcaagaccttatctctacaaaaacatgattaaaaaattagccggacatggtcacacacacctatgatcccaactattcaggaggctaagacaggaggatctcttgagcccaggagatcaaggttgtcgtgagctatgatcacaccactgcactccagcctgggcaacagagaccccgttcccccgcaaaataagaaagaaagaaaagagggccagatgcagtggctcatgcctgtaatcccagcactttgggaggccgaggtgggcggatcacctgaggtcagcctgaccaacacggtgaagccctgtctctactaataatacaaaaattagctgggcgtggtggcctgcacctgtaatcccagctacttgggaggctgaggcgggagaatcgccagaacctgggaggcagaggttgcggtgagttgagatcaccccattccaccccagcctgggcgacaagagcgaaactccatctccgaaaaaagaaaccccagagttcatgtgagcgcagcatgcgatgactggtctgggaagaactggccattccttgggcctcctggccccttggtgctgtctggcccagtgtccacagttccagggctgtagtgacagctttttatcattacaggtgtaggtggagcttttgctggaatcccaggtgaggcaaggctggtgggagaagcagggtggccagccaggcagaggctctggcgttgggaggggttgggcacccaagatcccatccaagcctgcccaatttctcccacgcctgcagagccaggtcttgcagtggctgtagcacaaagtggcacccatcccaggcctgctccccccactggcatagcagcccaaaattcaaaggagtccagaaaaccctccagcctgtgccaagggctgcaggcccaaactggggcccaggccccaggagggagagaatcccgtagcttcctggaggaagtggcctgtcactgggaatttctcaactgacccatgatggagattcagggagtccctcgaagcaggatggtttctggatgctgtagcaagctccttctgtctgagcagaaagtggagtgggtggcggagggtttggaagggggtgctgggacctgaacttgctctctttattcccacaggagttggaccctttgggggaccgcaacctggagtcccactggggtatcccatcaaggcccccaagctgcctggtaagtcagagggacggttcaagatgcaccactcggccgggtgtggtggttcacacctgtaatcccagcactttgggaggctaaggcgggcagatcacttgaggtcaggagttcaagactagcctggccaacatggcaaaaccccgtccctactaaagatacaaaaattagccaggtgtggtggcataggcctataatcccagctactggggaggctgaggcaggagaatctcttgaacccagaaggcagaggttgcagtgaactgagatcgcgctactgcactccagcctgggtaacagagtgagactctcctccaaaaaaagaaaaagaagaaaaaaaaaatgtaccactcactgcacctccctgcacagaagtcagcctgggtacaggtgtctctggtggcagggaaggggtgttgaagcccctgtatggtcaccagccaaggagagcatgggaaagtcatctgcaggtattgaactcacacacacacgctcatgcacagagacccatagtcccgatctgaagctattaggctggtggaaaggaacacggttcattggaaagatccctctaacatccacccactcgtgctcccgcccctacctctgcaatcagcttagacaataagatgctttccactgaggagggggtgtaaggaaaatactcagactccagggccatgatggggcttgaatttgtagggggatgggtgttccatgggcctcgggggcagaggtgtcctctccctccttcacccagcgcctttgctctcctgggagcagctcaggaccctgatgtgggaggtctcaagctttagcacctgtgggggtagatctgtccacccaggttggtgggagcccagcaaggcatggggcagcccctgagtttgctctgtcctctctccaggtggctatggactgccctacaccacagggaaactgccctatggtgagtgagacccttctagactgtgggcttccagctctttccctctccagggtcctagcaagggtgctgtgcttccagccctgggccaggagagcacctcgctggggcagggttggggtcttggagtgggaatctcagaaggaaagggcatggaatttggactcagcatgggtctccatccctgccctcccacctatcaataatgagaccttaagtgagctgtgttgcttctttgagcctctgtgttctcatctgtaaaatggacataacaactccatacatgtgtttgtatttgttttcactctggctgggggtgacaggtgcagactcaggacagcttgggccccgagggcagagcagggggagggggagggcagcagtggtgatgtctgcacagatgaccatcaagcctctctgttttgcaggctatgggcccggaggagtggctggtgcagcgggcaaggctggttacccaacagggacaggtaaggaaagcctcacgtcacttccagccaagggagcactgatcttccaggctccagagccctggggtgggtgaggttccctcctgaaagcagcagcccaccctgcatccagaccctggtccaaacctggagcaggatcctgggggaggagtggggcagctccatcagcctctgcctactctgaagctcccatgtatacccacatgtcagtggattggctctcttggggctgggaacaagtgggctctggagatacaggagcactgtttcaaggtctctcccctctgcttccttcccccaggggttggcccccaggcagcagcagcagcggcagctaaagcagcagcaaagttcggtgagtgcccctggagtccccacctggtggcctccaggcccctagcctctccattcccattactattgacagcctgcctccaaagtggcccctacatacccccatttactcaaaattttcaacatcacccatctatctatccctccctccaaccattcttccatgcatccatgtatccattcatccttccatcaatctattactttctccatccctccctccatccattcccattcctccatgcatccatctatccatccatccattcatgtactcatctgcccatccatgcatccatccactcatccgtccattcattcatccatccatctctccctccatccattcatccatccatccatccattcctccatgcatccatctatccatccatccacttatctatccattcatctacttatttacacatccatgcatccatccatccatccactcatccatccactcattcatccatccatctctccctccatccattcatccatccatctatccatccatccatccatccatccatccatccatttctccatggatccatctatccatccatctgtccacacatccatccatccatttatccatccacccactcatccatctatccattcatccacccatccatcactacctccctccattcatccatcctccattcctccatgcagccatctatccatccatccatccacttatccacccattcatccatccatcaatccctccctccatccattcttccatccatcaatccctccctccatccattcttccatccatccatccacgcatccatccattcctccatgcatccatccatctatgcacccatccatccatcccctcatccatccatccatttatccatccatcactccctcgctccattcatccatccaccatctatccatctattcccccatatacccattcatccatccaaccattcctccatgcatccatctatccctccatccattcctctaggcacccatccatccatttctccatgcatgcatccatccttccatccatccttccatccatccatccaccatctattcctccatgcatccattcatccatccatccattcctccatgcattcatccttccatccatccatccacccatcaattcttccctccatccattcttccctctatccatccactcatccatccattcttccctctatccgtccactcatccatccattcctccatgcatccattcctccatgcatccatctatccatccatccattcatccatccactcatccatccatccatttacccatccatccactcaatccatccatccatccatccatacatcaatccatacatcaatccacccatccatcactccctccatcgattcttccatccatccatctgcccattcttccatgcatccctccatccattcctccatgcacccacccatccatttctccatgcatgcatccatccttccatccattcatccatccatccatccatccatctattcctccatgcatccatccacccatccatccatttctccatgcatccttccatccatccatccatccatccatccatccatccactcacccatctatccatccatccatccatctacccatcaattcttccttccatccattcttccctctatccatccactcattcatccattcttccctctatccatccactcatccatccattcctccatgcatccattcctccatgcatccatctatccatccatccattcatccatccactcatccatccatccatttacccatccatccactcgtccatccatccatccatccatccatccatcaatccatctatccatcactccctccattgattcttccatccatccatccatccatctgcccattcttccgtgcatccctccatccattcctccatgcacccatccatccatttctccatgcatgcatccatccatccatccattcctccatgcatccatgcacccatccatccattcacccatgcattcattcattcattcattcattcattcattcattctttcctccatgcattcatccatgcctccttccttccctccctcactgcctcctcccacccatccatatcagagatcagggacaaacaagagttctcttagagaatatagccactgttgtgggagtcaagaaacgggaggcatttttttctacctgaggaaagttagaaaggcttcccagagaaagtgacatgtgatttaggccttaaaaataaagatggagcttaccatgtggttaaaacaggaaagaggaggccaagcagagggaatgggtaccacggtggttagaaagataattttaggtggtgcatatataagcatttaaaatatttaatagttatgtatcaatttaatgtgtactataaaaatgttaactcactgctcaggtcagtgagttcttggctagcatggctgcagatggaacgtggtattcctgtgcccgtgcagtgggtggagtgggcatctgtcccctgccccaggtagtgcccacctcagggtcagaccactagggctgaagtcctccttcatcctcagccccagggaagccctttccttatctccccaccagcccgagagagcgagaatgtggggagaagcctgaagctgggcctcccagtggaggccccgcaggcccccctcccagcacccgaggctccttggccccagcggctggtggggacggctgcaatgtgggagcgggagagcagggctgtgaggggctgccagagccaagcagccaggcgcttggattacaaacttggctgcatcttcggaacacagggagaggaagtcttgaacattcctgcaggggaccctctggcccagggagcggccacttgtggtttctcagtatgtggcagtgattagaatgggatttgtctgaaaacatacaagtcccttaatgagtgtgttgaaatggacactttgggggagagtcaaggaacagtggagtggggtgggggcctccccagacaggcccatctggagacacccgggccccattcctggataagatcacactggtgaaaacgccggcgtctaagtggccatcctgcctgtcctcaggagggtccttgggaaactacattgcactgtccccatctcaacaggtgctggagcagccggagtcctccctggtgttggaggggctggtgttcctggcgtgcctggggcaattcctggaattggaggcatcgcaggtaacatctgtcccagcagggggcgggtgtgtccttgagatggccacagggcaaggacctcaccctctgtggctgtgttttcaggcgttgggactccagctgcagctgcagctgcagcagcagccgctaaggcagccaagtatggtgagtgcctcccggggtggcaagtccacggctcgggcccctgcatagacctcggagaccctagccgcaaagccagatggacttggcctttgttccttcccaaatatgcattgttcatgcctccttacctttgccccttctgatcactctacctgagatgccatctctattgttttgccctgattaactcagcagagggaggggaccctgcagaggggacatggctcctcccactccatcccctccagggccagcccacaggtgtctgctgcatcaactaaatgggtgcccagtggtgagaattctgactgtgctttaggaatagatcacattctagctatgcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggtaagtgagaatttggttcaaaaaaaaaggaaagagagacagaaagagagagacaggaaggaaggaaggaaggaaggaaagaaggaaggaaggaaggaaagacggaaggaaggaaggaaggaaggaagggagggagggagggaaggaaggaaatgaaggaagggagggagggagagagagaggcaggaaggaaagaaaggaagaaacaaaagagagaaagagaaagaaagaaagggaaaggaaggaaggaaggaaaaagaaaagagggagggagggagagagagagagggagggagagagaaagaaagaaagagagagagagagagagaaagaaagaaagaaagagaaaggaaggaaagaaaagaaaagaaaaagaaagagatcacattcctccagctcactgattcaaatcctagagctctttagggaccctcttagtctctccacatctctctgatgagtaggatccatgcagaggaaatgtcaacccacctgcaatcctgcattcaggaccaactgtcacttccatactctactaaccacccttctagcccctctgaggttcccataggttaggggaacaatgctttttcttccacaggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggtgagctgggctgtgtgtgtgtgtgtgtgtgtgtgtgtgtgtgtgtgtgtattagagagaaatattgagactattgccaaaatttttgcattctccctaacaccataaccatctgcccatacccttgaccacgtctcatcccctcatcttctcttccttgggctataccaatctccttattagcttctaatcagtatcatattttccaattgaccttctggctatcagtgttctctggggggcaggaaccgtgtctttttcaactccatgttcctagcccttagctgagtaggtgttcagtttatggtggataaaacggtaagtgggtggatagatggataagtggatgaatgggtgggtggatgaatgaatggatggatagatgggtgggtggatggatggatgggtggatgggtgggtggatggatggatgggtggatgggtgggtggatggatggatggatggatgaataagtggatggatgaatgggtggatagatgggtaggtgagtggatgtgtgggtggatgggtgtgggatggataggtgagtggatggatgggggcatggatggatgggaggatggatggaagaatggatgaatgggtagatggatgagggatggatggatgggaggctgaatgaaagaacgggtggatgaatgggtagatgggtggatgaatgagcacatggttggaggggcagatgaatagacgggtgggtggaatggtgggcaagcaaatgcaaaatggatggttggctagatggttagatgaatggatagataggcagatgggataagttggcagatagatgagtggacagagagttaggtggttgggtgggtggattgatatccaaggatagacaaatggacagccgggagcagtggctcacgcctataatctcagcactttgggaggccaaggtgggcggatcacctgaggtgaggagttcgagaccagcctggccaatatggtgaaatcccatctccactaaaaatagaaaaaaattagccaggcatggtggtgggtgcctgtaatcctagctacttgggaggctgaggcaggagaagtgcttgaaccggggaggcggagattgcagtgagctgagatcgcgctattgcactccagcctgggtgacaagattgagactccatctcaaaaaaaaaaaaaaagacaaatggacaggtatagaggtgggtcattaggtagatggatgatgggggtggctgggtatacagatgggcaggtgggtggacatcagtgcataaatggatgtgtagccaactctatgttggcatgaaaggagatggcccaacacacagatgggtagacagagggatacatactacacagctctcctccaatctctcctgagcatttgtgtcccttttggtctctccaggggttgtgtcaccagaagcagctgctaaggcagctgcaaaggcagccaaatacggtgagtgctatgctgacagctctgccccaccctgtcctggcctttacttgccagaactaaaggaccctcctctacttgcccagagaagggaagtgacttgcccaaggtcaccgagcaagtcaccagcaggcctcaggacaatgtctcccccatttgtctcccaccacagggccatggggctgagtggcgggaaagtcccaggatggcattcccagtggggacagtgaccctgagcttccctgctctggccaaggccctctcagaggagcccaaaactgcctggggatgtggattctgccaatagtctctctgcatccaacaaagggggtcttcccgaagtgctcagagaggagaggggccagaggaggactgaagagtgtcagtaaagggctgggtgcagtggcttacacctgtaatcccagcaatttgggagaccaaggtaggaggattgcttgaggccaggaattagagaccagcatgggcaaaatagcaagaccctgtctctacataaaatgcaaaaattagctgggcatagtggcatgtgcttgtttgttccagctacttgggaggtcaaggcaggaggattgcttgaggccaggagtttgagaccagcctgggcaacatagcaagaccccataaataaaataaaaataaaaataaaaaataaaataaataaaaaataaatgaaaaattttaatttttttttctttttctttttctttttttctgagatagagtctcactctgtcgcccaggctggagtgcagtggcatgattttggctcactgcaatctctgcatcccaggttcaagcaattctcatgcatcagcctcccaagaagctgggattacagacatgcaccaccatgcctggctaatttttgtattttcagtagagacagggttttgccttgttggccaggctggtctcgaactcctggactcaaatgatccacctgcctcgtggatcccaaagtgctgggattatgggcatgagccactgcacccggccaaaaaaaagaaattttttttttttgagacggagtcttgctctgtcacccaggctggagtgcagtggcgtgatctccgctcactgcaagctccaccttctgggttcaagtgattctcctacctcagcctcccatataactgggattacaggtgcccgccaccacgcccggctaatttttgtatttttagtagagatggggtttcaccatattggccaggctggtctcgaactcctgacctcaggtgatccacctgcctcagcctcccaaagtgctaggattacaggcatgagccactgcacccggccccacattttttttaaaggcttcatggtggaggtgctggggacccaggcatcccagttttctgtcttttatggacaaggcctgggggaaatttacatcctctttcccaatccatcagcatccctcagagcccgcccagcctctctcactgagcttcttttctacttggctcccttccctctgcaggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccgtgagccttagtcacacctggggacatgggttgagaagggatgggggcttcttgtctgctcggctctgcaggggcagtggggactgtagatcgggcttgaatgtgctcagggaggagttgggggagaagaagggaggtcgtatccatgccttacagggcagaagagctttaaacacggctcggaggagacccaggcacggcttctgagggtctctttctttctcgtttccttgtagccgaagctcaggcagcagctgccgccaaggctgccaagtacggtaagtgcccctgccctgcctgtccccaagtcctgctctcccgcggggctcagggtccaacctcagggcaaactggctcccaggcctccaggactgaaatggcctggaccaaggtcacgaggcccctgccccatcttccaaagccacactccactcttactgtccttttcagatgccccctgttaggactgttggtcactggctcatcaccccaccccccacccccagaattgaaggtgtctggcagggttgggtggctgatgcctgtaatcccagcactttgggaggccaaggcaggtggatcccttgaggccaggagttcgagaccagcctggccaatatggtgaaatgctgtctgtactaaaaatacaaaaattagctgggcatggtggcgggcacctatagtcccagctacttgggaggctgaggcaggagaatggcttgaacccgggaggtagaggctgcagtgagcagagattataccattgcactccagcctgggtgacagagcaagactccaactctaaaaataaaaaaaaaagaaaaagaaaaagaattgaaggtgccaggaagccattctcttcttcctccgattctcccacccacccttgctcccccaaaaagtgagtactgggaggggcaaggctgaaagttctccactccccgaggtgctgcaggagcaggagtgctgggtgggctagtgccaggtgccccaggcgcagtcccaggtgtgccgggcacgggaggagtgccaggtgagctgtgtctccagcccagagatgggtttggtttgtctcatggaagggtccctggagttgaccaaggtcgactgcaccattttacaaatgggaagactgagcctagagatgggaagcagggaggggtgtgagagattactctctcaccccttctcttcacacctccaggagtggggaccccagcagctgcagctgctaaagcagccgccaaagccgcccagtttggtaagtccccctcacccccgccactggctcacggagaactgctttctcctgtgccctgctctggggtctgaccgcccagcttcctgttcctttccaccccacttaagctgtcacattctggggtgggccctccttagaccttttggcccactgatgaatgacctctaggagtgtgggtgatgtttctgattaggggagcagggtgagcagtgtgagcctccctgttcctaaagcccctggtgcctcccaggctattggggacctgacctcatgctgagctccagctccccttgagggactccagttctcccccttctccttctctttctccttctccttcttcttcttgtgctcctcttccttcttcttcttcttctttcttctcctcctcctccttctccttctccctcctcctccttctcattcttcttcttctccttcctcttcttctcctcctgcttcttttccttctcctccctcttcctcctcctcctgcttctcctttcttctccttcttcttctttcttcttcttcttcctctttttctccttctttcttcttctttctccttcttcttcttcttcctctgcttctttctcctccttcttctcttctcttccgtctttcttctcctccttttcctccttcttctttcttctccttctccttttttcttgagatagggtctagctctgtcacccaggatggggtacagtgccacaatcatagctcactacagcctcaacctcccagtctcaagcagtctgcctgcttccgccccccaagagctgagaccacaggtgcccaccaccatgcctggctaattttttaatttttttgtagcgacagcggtctcactatgttgctcaggctggtctcaaactcctaggctaaagcgatcctcctgcctctgcctcccaaagtcctgggattacaggcgtgagccaccacacccggcctgcagtacttcttgttccccatctcttgctacatttgagggccaccctggcagccccaggtgcccacacttttctgaacatggcaaatcgtggcagcaccaattgtagagctcaactgtatgtcaggccctgggcatggggtctgtaggccttggccctagggacctgtgggctgaaaggttcagatcagaatctctaggactgaataggccagagagcatttcgactgcaggtctgctgagccccatattctcacacacagcaatctttattatttatttatttgagacggggtctcacattgtcgcccaggttggagtgcagtgatgccgtcagctcgccgcaggcctcaaactcctagcttaagccattattcccccttagtatccctagtagctggggctacagtcacatgccaccatgcccagtttaaaaaaaaaaaaaattgtatgcgatcctcccacattggcctctcaaagtgctgggatgacaggcatgagccaacgtgtctggcctacaaaaatcttacagagttgattttatttttcccattttacagatgtggaaactgaggttcccagagcttaagtaacttgcctacagttgcacagctaaatggtggctgagctgagatttgaacccaaagcctttctgtcttacaaagtcccttatataatgtaaatctgcctccatcagcctcaaatctccaaggggtccttgtcactgaaaaggttaagaactcctggccaaatgcagcagctcacaactataatcccagaactttgggaggccaagtcgggtggatcacccaaggtcaggagtttaagaccagcctggccaacatggtgaaaccctgtctctactaaaaatacaaaaaaattagccgggcatggtggtgcgcacctgtagtcccagctactcaggaggctgaggcaggagactcacttgaactcgggaggtggtggttgcagtgagtcgagatcacgccattgcactccagcctgggcgatagagtgagactctgtctccaaaaaaacaaagttatgaactcctgagcctgcacacacttcatattagggaggaggaagctgaggcccagcaagggaaagtaactgatccagggtcacacagcaaatctatgccagggccgaggctccagccctctttccataagcttctgtcctctttgatcaggtcttggttaatgatcagctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcaggtgagtttcatgagtcaatgagcctgaggggcccccgaagcctccatgggccccgcctccatctctaatccccctctctctccctccctcagctgcagcaaaatccgctgccaaggtggctgccaaagcccagctccgtgagtgcctcgcccacctttctctcctctccccaacgatctcagagctggttaggggcaacagccagggaggaggccgctgcttggatctgggccccttcctctgggactaggctcagctccctgggcaggacacctccttaggggcatgctccctgcctgctgtcgccaccactgccctctgtctgcaggagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccaggggtgcatagtaaaatccttgttaggttctcctaagcatctgggggtaacagatagcgggaggagggcagaccaggccaagggaccccaggctgcccaattgcagagtatctgcctcctcagtagaggggtggcagggctccagactgagaaaaagcctgccctccaaccagggaaggagcaggtagatcagcctggctccccttcagcagtgctctgtggccaggggaccactaggaactccagttcttcaccagctggtgactgagccccactctgtgcccagcctcaggcagtccatgctaggcctggggagagaaggaaggggcagacggaaggtggaggcactgttcagccctaaagctctgtgcctgtacagcttcagggctttgaggaagcaatagaggccaaggaagtcagggagggctctctagaggaggcggcagaactcccaggcacagagctcggctcctgaccactccccaacttttctttctccccagtacctggagccctggctgccgctaaagcagccaaatatggtgagtgcaccccacaaccacttgtggctcccttgccaccacaccatccctgacagcacaggactggggtggtcacaatagaaaaaggcagtttcggccgggcgtggtggctcacacctgtaatcccagcactttgggaggccgaggcaggcagatcacctgaggtcaggagttccagaccagcctgaacaatatggttaaaccccatctctactaaaaattcaaaaattagccaggcgtggtggcgggcacctgtaatcccagcactttgggaggccgaggtgggcagatcaactgaggtcgggggttccagaccagcctgaccaatatggtgaaaccccatctctactaaaaacacaaaaattagccaggtgtggtggcgggcacctgtaatcccagctactcgggaggctgaggcaggagaatcgcttgaacccaggagatggaggttgcagtgagccgagatcacgccactgcactccggcctggacgacagagcgagactgtatctcaaaaaaagaaaagaaaagaaaaagaaaaaggcagtttctaggacacgtttatgacagtttaaaaacctggcccctgcccactaaatgcttatggtgccttcaacccctgtgaccaccaaaaacacccttgaaatcccagttgccccccaggaggcaattccaccatccctaagcttgccctgaccctgacagttacatggtccctgtgtccaggaagggactgggcctgctgtgggtatgaggagtctgggcagtctctgcctccaccccagctctctggcccgagcaaaggagctggtattcctcatctgggcaccccgggcccccgcccgccttcctgtcctgccagcaggaccgctcccaccacgagccagcccagaggacgtggcagtcccacagcctctgcacttggcgctctggcagccctgcctggccagacccacgctgtctgtagcccctgaattcctggcctcctgtgagcagcgttggtgggaggtggaagactcccccagggatccaccaaccagccgggcaggtccacttggggccagtttctacctcggaaaatcctggcttcctcagcgccgacccccagcagccctggcctcctcccctgctcactgctgactgcttggcaggcctgagtcaacagacattgccagggaaacagagtgacgtcatgtggtggagccgcgaagggcgcaggctccccagccacttcccgtccctgaagccctgagcacactgcttaacctctgctctgcctcagcgttctcatctgcaaaatgggaatgacaatagtgcctacctttcctgctgcaatgcataaaaaatgggctgctaagtgtgaagcactcaaaatgttaagtgcctgctgtagatactattaccgttgtttgtttgtttgtttgtttgttttgacagagtcttgctctgtcgcccaggctggaatgcagtggtacgatcttggctccctgcagcctccatctcccgggttcaagtgattctcctgcctcagccttccaagtagctgggattacaggcgcccgccaccacgcctggctaatttttgtatttttcgtagaaacagggtttcaccgtgttggccaggctggtctcaaactcctgacctcaggtgatccactagcctcagcctcccaaagtgctgggattacaggtgtgagccaccgcacccggcttacaaaagaacttttaaggccaggcacagtggttcacaccttcgggaggctaaggcaggaggatcgcatgagcccaggagttggaggctgcagtgaactatgattgtaccactgcactccagccggggtgacagagcaaaaccccatctcaaaatgaaacaaaatatggactggacttcctgtccactgctcctccacagtgtcacatggcccctgccacctgtctgcttgccttgtgtccctggggcagggagacccatcgttcagaaatggaacactcattttccctcctctccccgcaggagcagcagtgcctggggtccttggagggctcggggctctcggtggagtaggcatcccaggcggtgtggtgggtgagttgaaaccccaggaggggcagggtggggagggaatctaaccagtacagagtgcctccctgaactcggtctgtgttcccaggagccggacccgccgccgccgctgccgcagccaaagctgctgccaaagccgcccagtttggtgagcactgggtggaggtgggagctgccgccaggcccccaggcccccagggtgtgggaggagcttctgaccaggcactgtagactcagagtccctgccccagacacctcctggctccactgtgccatcgaaggccaggggagacctcaggctccacctgtgtccccagaggacacctccgccctccacaggccgaggcttcagtcccacctttctgaccagcggagtctaatgctcagctgtctccacaggcctagtgggagccgctgggctcggaggactcggagtcggagggcttggagttccaggtgttgggggccttggaggtgagagttgttctgaaatcagtgagtgtgtgtggtgtgtgtatgcgagacagagatggagacagagacagagacagagactttcgttcccacccctggcacgtctttgctcaagatgtcctcttggccaggtgcggtggctcacgcctgcaatcccagcactctagtaggccaaggtgggcggatcactagaggtgaggagtttgagaccagcctgggtgacatggcgaaacctcatctctaccaaaaatacaaaaataagccgggcgtggtggtgggcacctgtatttccagctacttgagaggctgaggccagaggatcgcttgagcccaggaggcagaggctgcagtgagctgagatggtaccactgcattccagcttgggcagcagagtgagaccctgtcatctaaaaaaaaaaaagaaagaaagaaaagaaaagaggccaggcatggtggctcacgcctgtgatcccagcactttgggaggctgaggtgggcagatcacgaggtcagatcaagaccatcctggctaacacagtgaaaccccgtctctactaaaaatacaaaaaattagctgggcgtggtggcagacgcctgtagtcccagctactcaggaggctgaggcagaagaatggcgtgaacctgggaggcggagcttgcagtgagccgagatcgcgccactgcactccagcctgggcgacagagcgagactccgtctcaaaaaaaaaatatatatatatatatatatatgtatgtatgtatgtatataaattagctgggcatggtgacacacgcctgtaatcccagctactcgggagcctgagacaggagaatcacttgaacccaggaggcagaagttgcagtgagccaagatcacgccgctgcactccagcctgagcaacagagcaagacctcatcccaaaacaaaataaaaacaagaaatgtggcaaacgggagctggggctatcccttgccgccagggtcccagtcctccccctctcctctctctttcaacccacctgaccactgcggtgggagtaaattaggagaatgatggttatgccagttctccaagaaagaaatcaaagcttggagagaaattgctttccctaagtctccaccatggtggccgaccttgtgtggccatttccccctttcttgggctgtcattgtgtctccccctgtaaactagcctgcacagctcttcctgtgagtgccacaagaccagacacacagtaggagcttaacaattaagacttttggggccgggcatggtggctcatgcctgtaatcccaacactttgggaggcttaggtaggtggattgcttgaggccaggagttcaagaccagcctggacaatgtagcaagacccccccccaccaccacctctacgaaatatttaaaaattagctgggcgtggtgtgtgcctgtagtttcagctacttgggaggctgaggcaggaagatcacttgaacccgggagttcagggctgcagtgagctgtgatcaagccactgcattccagcctgggcaacagagcaagaagctggatagatgaaggagagatggggggatagactgggaggatgagtccatgggcagacggtaaagggtgagtaggtcagaagacagggcctagccaggtgcagtggctcacacctgtaatgtcagcactttgggaggccgaggcaggtggatcacctgaggtcaggagttcgcgaccagcctggccaacatggtgaaacctgtctctactaaaaatacaaaaattagccaggcgtggtggtgggtgcctgtaatcccagctgctcaggaggctgaggcaggagaaccgcttgaacccaggagatggaggttgcagtgagccgggatcgcgccactgcactccagcccaggcgaaggagtgagactctgcctcaagaaaaaaaaaaaaaaaaaagacagggcctgacaggtggcattggcattcctgagccgtcatgtgcctcatctccccaggtatacctccagctgcagccgctaaagcagctaaatacggtgagttcccctctgatgccttcctgccagtggcctgcaccccctgccatgcccatcgccaccctcccccagcccagctcaggcctccctctggctccccctacccctgaagatcttgtctgggacattccttaacccagaacccagcagggatatcagggcctcttcccgatgggggtgtcttatcctgaccccacctgcctcttctcaggtgctgctggccttggaggtgtcctagggggtgccgggcagttcccacttggaggtaggggtggccagctctgctacgtagtcctcagctctgtcccgatctagagggggcctgtccatctagcagtggggactcccagagcccatgtccacacaaggacaggagactggggctggtgagggcactttaggattgcagatgtactgggcaaacgggcaagctataaggttggggacagtgccaggctgagctcagggttgaggccatgaggtgccacacctggttgctaggtggcggcatgttgtgttgagaaagccactctggctgtagtgagggggattggctgggcgtggtggctcacgcctgtaatcccagcactttgggaggcctaggtgggtggatcacttgaggtcaggagttcgagaccagtctggtcaacatggtgaaaccctgtctctactaaaaaaaatgcaaaaattagccaaacgtggtggacgcctgtaatcccagctactcgggaggctgaggcgggagaatcactggagcctgggaagcggaggttgcagtgagccaagatcgcaccactgcactccagcctgggtgacagagcaagaccccatctcaaaaaaataataataaaataaaatataaaaaattatatagtgggggggatggagaggaggtgatcccagacagaggtcttgggtgagccagtgcaggcagaaagtgatgaggctggagtcagtttccacccctaccaacccaccaacctgaaatctctcctgcaggagtggcagcaagacctggcttcggattgtctcccattttcccaggtatgccaggctccctgcccctgggccctgccctggagctgcagccacctcctccctcctctcctgtgccatctcctgctcagaagggctgagccagcacccaggggtggaccccacagcctcaggtcacacgaggctggaccccgagctgaatgtagagcctcccctccttcttgctgacctcttataaacacagggaacatttgctttttaaaaacacagttcatggccaggtgtgatggctcacacctgtaatcccagcactttgggaggctgaggagggcagatcacctgaggtcaggagttcaagaccagcctggccaacatggcgaaaccctgtctctattaaaaatactaaaattagccgggtgtggtggctcacgcctgtaatcccagccctttgggaggccaaggcaggtggatcacgaggtcaggagatggaaaccatcctggctgaaacggtgaaaccccgtctctactaaaaatactatagtcttctttttttttttgagatggagtcttgctctgttgcccaggctggagtgcagtggcacgatcttggctcactgcaacctctgcctcctaggttcaagcgattcttctgcctcagcctcccaagtagctgggactacaggcatacaccactacgcccagctaatttttgtatttttagtagagacggggtttcaccatattggccaggctggtctcgaactcctgacctcgtgatccgcccgcctcggcctcccaaagtgctgggattacaggagtgagccaccacgtccggccgtctctactaaaaatacaaaaaattagccgggcatggtggcgggcacctgtagtctcagctactcgggaggctcacgcaggagaatggtgtgaacccgggaggcggagcatggtgtgaacccgggaggcggagcttgcagtgagccgagattgcgccactgcactccagcctgggcggcacagcaagactccgtctcaaaaaaaaaaaaaaaattagccaggtgtggtggtgcacgcctgtaatcccagctactctggaggctgagacaggagaattgcttgaacccaggaggcggaggttgcagtgagctgagactacaccactgccctctagcctgggtgatgacagggcaagacgattgcgtctcaaaaaaaaaaaaaaaaaaaaaaaaaaaccttcagaggcagatgtctgttcctgccccactctctgctcactgccaccaggtggcggtaaggagccatatctggctcaagcagggttaggaactgctccgggccgcgctactagacaatggtgccttacctaatacagactgatgccttgaaacagggttcacccatcagactattcccaggagggggtaggaatcctgggtttgagtcccagctcagacactatgtggataagaccctctctccctctactgggccttgatttacttatctgatgccctctcagatgtatgggtccaccccactccctgagagggccgtctcctgcagacactgactctcccttcatcccatgttccttgatggagctgctcttagcctttccccgaaaggcttcttggagcagtggagccaggagccagtgccaggccccgtccttccccagccaggccccatgacctgcccccttttctgcgagcgttggtttcatccaagtaatatcttgggggcttctcccgccccatctgtccagtggaagttgatggcatggatcaggtctgagtttggcctggggccatgacttggcttctcttggcttcttggagcctccattcgagtgggtcagagcaggcggggattagagccgaaactgagaggggccggactcacagtgatgtgcacctcctcccgtccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctg

SEQ ID NO: 37766 - DNA, 2309 bp, Homo sapiens
ccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggtgtgttcccaccccgcgccgacaccccaaaatcggtctcgcgccggtccgcctggcagctccactgtgagctcgcctgtcactggagtcaaagggcgctttgcttccccgcgcgctcccctcccctctgcactcccgcccccaatatatactctttcttgcctgacctaagtcacttctgccttctccgttgcctcggaccctgccccccatcatgccactccccaggtcaagcctagtgtcctccagacgcctcaaggggtagcctgagccttgggcaagaggcaagggggctatcctgggctggcagcggcaggaggtctcaccgcctggtgcccgctgggttagactgtggttacaaggtgctggtctggtaggacggctgcggctgggctgttctgtgggctagcctggagctccatcttggcgtgcgtgcaggctagcccgctttctgggctctgcttctccacccccatgactccctggttgttcagacggtgactcaggccccggggggcagggtggaggagtgggtttgcccggtgctgcctgcctaccctagcccagccctggaatgcagctgactacaaacaggataggggcttcctggggagggtgtggcagggtggtgggcatcccctccctcaccaaagcatgggctctttgtttcctctttgccaggcctgggtccttcccagtgacccctcagccttcacttcctcctcactcccggggagctgtgacaggtgtttgggggaggggaggggggtatgataagctgggacagctgcacccaccggtgctctggtgagatggggggcccggatgttggggagacacatctgctgggttcccagcccaaggtccccaaccctggctgtctggccttgtctgtcaccccccgtgcccactggcagggacaggaagctcccccccccaccccgctttgggcagtttgccttggcacgggcctgatctgttttcctccccagagcagctgctgttctgtctgctgggcagagggctgggttcctccgaggtaggcaggggcctcaacccagagcccctctcacaccctctctccaactcaggcttatgtctctccctcctcccccacccccaccccaggaagaggagatcccagaactggagattgacgtggatgagctcctggacatggagagtgacgatgcccgggctgccagggtcaaggtgagggggctggggggcgatgggttgcctgaggcactgccccgggaaagtgaggctgtggagccaggccctcaagccccagctcctgcctcaacagaatggggccaatgcctagctgtgaggttgttgtggcatctcctgtgcctcagggtggccccagtctcttggaagtgggtataggcgagctccaggcccccactcctgaggactcacttatccttcctcccccatcctctgctaggagctgctggttgactgttacaaacccacagaggtaagagatttcctggggggctggcgggggtggcagggtgaggggagcccggctcctgtcatcttggggtctggtctccttaatgtttaccctcccaccccatccaggccttcatttctggcctgctggacaagatccggggcatgcagaagctgagcacaccccagaagaagtgacggtccccgacccaggagaacggtggctcccacaggacaatcgctgccccccaacctcgtagcaacagcaataccgggggaccctgcggccaggcctggtgccatgagcagggctcctcgtgcccctggcccaggggtctcttcccctgccccctcagttttccacttttggggttttttattgttattaaactgatgggactttttgtgtttttatattgactctgcggcgcgggccctttaataaagctaggatacgcctttggtgc

SEQ ID NO: 37767 - DNA, 8971 bp, Homo sapiens
ggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgtaagtggggccgggtcgggtgggggcggcccgcggtgtcccggctcccggcctcctcgtggtccgacctgcggtttgggcccgcggctggtggggcccggcgactccatgggcctcagtttctcctctggtaacgtgagcttcgcttccagagacggggacccgccttgccgggttaggcgcacctcctggggcgggactggctccaacctgggccccttactgcggctttctctgtggccgaggccaggccgtccccggggtggccaggagagcaccgtaaactcttcagcctgctccgtggccgcgatctcggaaaaagcaccaattctgtgatgtgcagcagcatttactgggcatctatgaccctgtgataggctttggggtctttttctgtaaggagtccagtaaaggagaagtacatctgtattatgaacacctaaatatgtaagtgaaaaacacggtgaaataagtttcactgaggccaggcgaagtggctcacgcctgtattcccagcactttgggaggccgaggcagggagatcgcttgagcccaggagtttgggaccagcctgagcaacatagcaagaccccatctctacgcaaaattagctgggtgtggttgtgcacgcccctgtagtcccagctccatgggaggccgaggcaggagggtgtcgtgagtccaggaattcaaggctgcagtgagttgtgatagatcgcgccactgtacttcagcctgggtgacggcaagagcctgtctctgaaaagtttcatagaagaggttagtactagaaatgggaaacaccagagagtcagtgggcagccctgctctttttatttatttttcagacagagtttcgctcttcttgcccaggctggagtgcagtggcacaatcttggctcgttgcaacttccgcctgccaggttcaagcgattcttctgcctctgcctcccgagtagctgggactacaggcacacaccaccacgcctggctaatttttgtatatttagtagacggggtttcgccacgttggtcaggctggtctcgaacgcctgatctcaggtgatccactcgtcctggcctccaaaagtgctgagattacaggcgtgaaccactgtgcccggccagccctgcattttttttttttttttttttgcagggggacggagttttgctctgtcgcccaatctggagtctagtggcgggatctcggctcactgcaagctccgcctctgggttcacgccattctcctgcctcagcctcctgagtagctgggactacaggcgtccgacaccacacccggctaattttttgtattttttgagtagagacggggtttcactgtgttagccaggatggtctcaatctcctaacctcttgtgatccacctgcctcggcctcccaaagtgctgggattacaggcgtgagccaccctgcctggccgagtcctgttcttttatgggggaggtggttgttagggaaatcattactgagaatagggggcacatgaggtagtgtggggtctcaaaggatggttctagaagaagagtttgccagaaggccaaggaaaaaagacattcctgccaatggcaatacccgagaaggcaaggagtccccaaacagcatttggtatgacttaagtgtgaggaggggggcttgttagacatgcctggagagaaggaagcagaggacagattgtggctgtgtttgtttgcagggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggtactggagtgcagtggtgcgatcttggcttactgcaacctctacctcctgggttcaagtgattctcctgcctcagcctcctgagtagctgggattacaggcgcctgccaccacgcccggctaatttttgtatttttagtagagacggggtttcaccatgttggccagactggtggaactcctgggcatcaagatgatccagctgccgggccgggcatggtgactcacgcctgtaatcccagcactttgggaggccgaagcgggcaggtcacaaggtcaggagatcgagactgaggcaacagagcgagactctgtatcaaacaaaaaaaaaaaatgatccagcagctgcctcagcctcccaaagcgctgggattacaggcatgagccaccgcacccggcctccatagagcctttaatgcttgtgttcggtacttttgcttgtcactttgtagatatctcatccaattcaatctcccttatttttatttatttatttatttatttattttgagacagaatctcactctgtcgcctaggctggaatacagtggcacgatcactgcatttgaactcctgggctcaagcaattttccctcctcagcctccgaatagctgggaccacaggcgcacaccaccatgcccagctaattaaagttttctgtagagatggggtgtcactatgttacccaggctggtctcgaactcctgagctcaagcaatcctcccatctcagcctaccaaaatgctgggatcacaggcatgagccaccgcccccagttctcaacctctctttaagaaaaccaaggctgggccggacacagtggctcacgcctataatcccagcactttgggaggccaaggcaggcagatcacttgaggtgaggagttggagacaagcctggcccacatggtgaaaccccatctctactaaaaaaacaaaaaaattggggccaggtgccatggctcacgcctgtaatcctagcactttgggaggccgaggcgggtggatcacaaggtcaggagattgagaccattctggctaatgtggtgaaaccccacatctactaaaaatacaaaaaaaaattagccgggcatggtggcgggcgcctgtagtcccagctacttgggaggctgaggcaggagaatggcgtgaacccgggaggcagagcttgcagtgagctgagatcacgccactgcactccagcctgggtgacagagcgagactccatctgaaaaaaaaaaaaaaaattagctggatatggtggtgcacgcccatgatcccagctacttggaaggctgaggcacaagaattgcttgaacctgggaggcagaggctacagtgagcggagatcacgccactgcactccagcctgggcgacagagcaagactctgtctccaaaaaaaagaaagaaagaaaagaaaaaaaaaaccaaggtccagagcaattcactaacttacccaaagcagggccgctagagatggttgtgcacattactccctacatagggatgtctggccaaggatccacactccactggccgtgctgtgtacccgcccagcagcatcacccaacccagagagtgcgccttttccactctacatgaaggtgctctgtggacttactgtaaacagcctcctcagtagtcagtcagtagtagagacagaatccaaacccaggtctgattccaaagcctctgttttgtttctgttttctgtttgtttttttttgagacagggtcttgctctgtcactcaggatggaatgcagtagtgttgtgatcatagcttactgcagcctcgaactcctgggctcaaatgatccaaagcattgggattacaggcatgagccaccatacccagccagccaaagcctctgtttttgcccatatcacactcattctcctccagaagacaagggccatatctggttaatctcctgctgttccactcaatgcctggctcatcataggtgggcagtaaatgcttatcagtgagtaactggagaacaacatggcccttccttataggccaaaaagcaaatggatttccacctgacaaatcttcgggatccaagaagcagaaacaatatcagcggattcggaaggagaagcctcaacaacacaacttcacccaccgcctcctggctgcagctctgaaggtacgtggggtacctggcacagcgtgcaccctgagactcagccccacaggcttttcctctggagtattccatgcatgttacaggctctcctgcctctgatcagaatcagcgggggtgcttaattctgtcccctctcatcgcagcccaatctcagcttgctgttaatccaggccacagggccccatctccccggctccaggtttggcttccccatctcccccaggagctcctattgacacttcctgccacccttcccctagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcaggtgggacaagacggagcctcaggtttgcctgcagaggcctagtcccaggctttggccttcccatatctgctttgaggtagtgaggagggacctggacccagggcctcccttggggtgccagaaagagcatccacatagtttgcgcgctgcctggggctccctggagatctgggctgctatacagcaaggaaacagggggaggtctcttcctacctggaaataccttggcctggcttccagatgagccttagtttctaaaccctagagagaaactaaaggagccaaagctatcagaatcttaccttttgaggagttttatgagatttggaaccaggggcttaagttttaaggctagactgtggggcatgaggagagatcttgacttccccgagaacccagcacaggacctggaacacagagcctctttgtccagtgagagcgtgacttgtctgctgcctgtctctagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacaggtaagaggcattcagagggtggcgcctgcccaaagcatgaaggaaagatccagttctatttcctcaatgagttaatgctgcctgaaagttctgctcaacctgagaggaacaaggggtccctggctctgaacagcctggctctgtgctcccctggagtccctgggccacaccaggtccctagggaaggtggggaagggccacagtcttcagcagagtccttatctgtagtgacccttggcctgggaggagacatgtatacttcgggcagcagaggccttgtaagtgtctttggagagtgacagttggtcaggtcactgcccgtgacccacatcactcccttcccgctcagggaagtttatcatgactgcctccagtgacaccactgtcctcatctggagcctgaagggtcaagtgctgtctaccatcaacaccaaccagatgaacaacacacacgctgctgtatctccctgtggcaggtgggcaaggaggggtattggcgtctgggaccacgagaggctggggctggggagcaggcacagaacagagagccagcttcatcgcgtgggaagagcatacggggtggggtcaggaacccgagcttcaagtctcagctctccccacttgcagtagtgggatttcatgcaggtcgccccatgtccttagtcgctatttcttcatcttcagtgtttttgttttttagaaaattagtctcactctgtcacccaggctggagcacagtggtgcgatcatagctcactgcagcctcaaactcctgggttgtagctattctcccagctcagcctcctgagtagtcaggactataggcatgtgccactgtactcagctaatttttgttttttgtttgtttgtttgttgagacggtttcaccctcgcccaggcaggagtgcagtggcgcaatcacagctcactgtagccttgacttcccaggctcagaccatcctcccaccttagcctcccgagtagctgggactacaggcgtgcactaccacacctggctaatttttgtattttttgttgagatggggtcttactatgttgcccaggctggtcctgaactcctggcctcaagtgatcctcttgcctcgacctcccaaagtggtagaattacaggcgtgagccactgtgccaagccacctttgggcggggatgttacatatcttagaacaaggctagaagataaactgaggtcacatacataaaagaacttttttgttgtggttgtttgtttgttttttgagatggagtttcgctcttgttgcttaggttggagtgcaatggcaggatcttggctcaccacaacctccgtctcccgggttcaagcgattctcctgcctcagcctcccccaagtagctgggattacaggcatgcaccaccatgcccagctaattttttatttttagtagaggtgaggtttctccatgttggtcaggctggtctcaaactgtcggaccttaggtgagctgcccgcctgggcctcccaaagtgctgggattacaggtatgagccaccacacccggcctttttttttttttttttctgagacagtctcactctgttgcccaggctggagtgcagtggtgcaatctcaatctcagctcactgcaacctccacctaccaggttcaagtgattctcccacctcagccttcccagtaggtgggactacaggcatgcgccaccacgcctggctaattttgtatttttagtagagatgaggtttcaccatgttggccaggctggtctcgaactcctgacctcaggtgatccacccacctcggcctcccaaagtgctgggatgacaggcgtgagccaccgcgcccggccaaaataactctttaaaggtttatattatccagatatgaggattatcaactttctcaggaaagagattgaggggttttacaggaacaacatgctccgaaaatgaagttttaaaggcttctgggttgtatggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggtgagtgaatccgctctgatgtctgaccagtggctcttggcccctcttgacaaccagggtccttctgtctgtttgtgccatggctctgaagagggtggggtgcctggccctcggcaggaagctgacttagcttcctagctggagctgctcaagttgggccagtgcttaccctgccagggtgtgttggggcttgagctgtgattttctgtgttgcaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggatt

SEQ ID NO: 37768 - DNA, 31173 bp, Homo sapiens
cacttgccgcccgtgccctgcggccctgcacgccccacccgcggtcgcgcgccgcgctccccgccgcctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccaggtgagaccgcgtcgggcgggcggctggaccgagggaggccaggctgggtgcaggtgggcggcgcagcgctgcggggccgggatgcggggcgggggaacctcggctcccgggaagccccgagcctgggggaaccctgggcaccctgtgaaccctgtggtctgcactggctgccctgctgctgtcgcggggctgcgggcggacgacctgagcccgagctccgagggcccggagcggggcgccagggcctagggtcgcgggggccaggggcgcgccagggtggctgaggtaagtctgtgtggggaaaaggacaatggagccgaaagccggcgtctgccgtcccgccgggcccgcgcgagatgccctcctgccccccgccctacgaggcagcttagaagtgtccttctggtgcctgcggcgctgatcgttgccgagtggaaggagtgttggagaggtagaaacagctggtcagagccgcctctgcgggaggaggcttttgaggtcgcttgttagctttcatctgagattctggctatgggagtgggcgtgcgtgtgcgcaccgtggccccaggcgaggtttcgtcttttcccaatttgtaccaccacccattaagcgacttcaaggatccatcaaaaatgattggttcctaagcgaacagttttattttttgtattttaagattccattagttgtgtaatggtaggggcctggagcccaaaaccttggcgttactaggacagggcatgacccagctgacttggagtaaattttctgcctttaactacatttagattggaaattagggtaaaatgtttttgttgcaatctagtttcgagcatgtggtcctgtgattctgggtttgttttataacttatggactgagtaaaattacccagtttactgagagaattgagaactctgtgcaatggttgatctaatagaagcattttatttaaagcttccacccatccagttgctaatttatgttatttctcttttaaattatgtagattttgttgttgttgttgttgcagaaatggctccgtaaaatgattagttttgtgcgtgtgtgtgtgcgaacagttacacagttaagttcgttttcctgatagttttcttttgtctttagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggtaggtgaaaattatgacttggaatagacaaagactctcccctcttcaaactataatataatggtccttatagtgagtgctatgaaaaccaaattttagatttttccagttacataatttcttacagcattttatatagaacttctgcactaatacctagccaatcaataatattcaagaatttggtctgtattttgaaaacagtatctattattatttctgcatagttacccaataatttttttttccttagagttgggggcctaattatattgtctaggctggtcttgaactcctaggttcaagcaatctttctgactgggcctcccaaagtgctgggattacaggcgtgttacaccctgtgcccagccccccagtaatatctttaatgttctagcttatgttttactttgttttataaagaatgtgtaaggctgggcacagtggctcacacctgtaatcccagcactttgggaggccaaggcgagcagatcacttgaggtcagagtttgagattagcctggccagcaatggtgaaaccccttctctactaaaaatacaaaaattagctgggcggcggggtttgtgcctgtagtctcagctacctgggaggctgaggcaggagaattgctcaaacccgggaggcggaggttacagtgagccaagattgtgccactggactccagcctgggtgatagagtgagacttgtctcaaaaaaaaaaaaagaaaagaaaagaaaaaagtatgtatagagtggggtgcagaagaatgaactctctaacttgtcacttgtcttttcttcttttataaaacaagaatgattctatttatactgaatcatcatgatggttattaatttaccttatggttcctcaagcaaattcagaaaaatcacattatataatttttttaaggggcactgctatctttccccagaaaaagaacaaaactgggtagtatttttttcatatttcattaaaatcaggaatggttttgacggtttgtaaagtaggtagtgaaaaagatatgaattaaattccattttgtttggtgtttagtcaagtaggaacttttcattcatgtgtttcataacattatttagagtataactgagaattgtatgttgggagatttattttgaaatatgtacttcttttccccttttcaatccttgaaaggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggtattcttttgactctttttttacttattctttctttctcttatttaataatcttttctttcctttgtaatttattttgtgaaatttccagaaagactttggttctgtctgcatcacattataaaacataataaagcatttctatttacaagcaagtttcaggataaagtagtcttattttcagattttttttttttttttgagacggagtctcgctctgttgcccaggctggagtgcagtggtgcgatcttggctcactgcaacctccacctccccggttcaagtgattctcatgcctcagcctcccaagtagctgggattacaggtggccgccaccacacctggctaattttttttaaggggcactgctatctttcctcagaaaaagaacaaaactgtttgggtagtattttttttcatgtttcattaaaatcaggaatggtttgacggtttgtaaagtaggtagtgaaaaagatatgaattagattccattttgtttggtgtttagccaagtaggaactgttcattcatgtgtttcataacattatttagaatataactcagaattgtatgttgggagatttattttgaaatatgtacttcttttccccttttcaatccttgaaaggaaaatattgtaatgggagagttgttcctactgatttttattagagatggggtttcaccatgttggctaggcttgtctcgaactcctgacctcaaatgatctgctggcctcggcctcccaaagtgctgggattacaggtgtgagctactgtgcttggcctttttcagattttaaaatacgatggaaatggttgtggtgttttaaggtgtaaaaaaagaaaaaaatactccgggcctggtggctcacgcctgtaatcccagcagtttggggggctgaggtgggcggatcacctgaggttgggagtttgagaccagcctgaccaacatggagaaacctcgtctctactaaaaatacaaaattagctgggcacggtggtgcacgcctgtaatcccagctacttgggaggctgaggcaagagaattgcttgaacccgggaggtggaggttgtggtgagtggagatcgcaccattgaactacagcctgggcaacgagcaaaactccatctcaaaaaaaaaaaaaaaaactggtgggcacagtggctctcacctgtaatcccagcacattgtgaggccaaggcaggaggatgacttgagcccaggaatttgagaacagcctgggcaacaaagcaagaccccaccactacaaaaaaaagtacacgcgcacacacacacacacacacacacacacaaatacaaatgcaaactgtattatgctatggtcacaggattgatcttttttagcttttatttttcttgctctgaaaactgaaatttttctttaaattggagtagagcgttagtattttttgttgttgttgaaacaagagtgtcgttctgtttcccaggctggagtgcagtggcacgatcttggctcattgcaagctctgcctcctgggttcttgccattctcctgtctcagcctcccaagtagctgggactacaggcgcccgccaccacgcccagctaattttttgtatttttagtagagacggggtttcaccgtgttagccaggatggtctcaagctcctgacctcgtgatccgcccgcctcggcctcccaaagtgctgggattacaggcgtgagccaccacgcccagcctttttcttgtttttggttttttttttttgctttttttgtttttgtttttgtttttgtttttgagacagagtctcactctgttgcccaggctggagtccagtggtgcgatctcggctcactgcaacctctgcatcctgggttcaagcacttttcctgcctcaccctcctaagtagctgggattacaagcgtgcctcaccacactggctaattttttttttttgagacggagttccactcttgtttcccaggctgtagtgtagtggcgcgatctcagctcaccgcaacctctgcctcctgggttcaagcgattctcctgcctcagcctcccgagtagctgggattacaggcatgtgccacaatgcctggctaattttgtatttgtagtagagatgggatgggatttcttcatgttggtcaggctggtctcgaactcccaacctcaggtgatccacccgccttggccttccaaagtgctgggattataggcgtgagccaccgcgcccggctcacactggctaatttttgtatttttagtaaaaatggggttttgccgtgttggccaggctggtctcgaatgccagacctcaggtgatcttcctgccttggcctcccaaagtattgtgattacaggcatgagccaccacgcctggtctagaacattaatattaatatattaaaatgtgaacactaattatctagcgtagatgatggaattaggagtatttttccccctttgtcctggtgctactatcagttgtaatttcaaaataatttaaaaataggctgggtgctgtggctcatgcttgtaatcccagcactttgggaggccgaggcaggcagatcacctgaggtcaggagtttgagaccagcctagccattatggccaaaccccgtatctactaaaactacaaaagttagccgaatgtggtggcgggtgcctgtaatcccagctacttgggagactgaggcaagagaactgcttgaacctggggggcggaggttgcagtgagccgagattgtgccactgcaacccagcctgggcgacagagtaagacaaacaaaacaaaacaaacaacaacaacaacaaaaagatttaaaaataaatttgataaattggagtaggatattcttattgaaactcattaatacatagtattcttgttaataggttcagtttaataggaaagctactagagaactctaatgaaatgtgttttcttttaaggaaacttacatgcttgctgtaactttggatgaatggaaaaagaaactggaatctcccaacagagaaattattattttacacaatccaaaggtaaaacaaagcatttctcttgtcgggataaaaagttaattgcgctattagggagaactcaattggtttcttttgctaagcactctgtgtaggataacctttgtcaaattttatattgaattcacagttatgaaacttaaaaacttgtagccactactgttatttacccaactcagcttatacaaaataattttcttatggaaaattatgccactgtagaataagaaaatcactgacatattatgtgagcatgtcttccatgtagaaagggactattgacagatctgttagcctaatatattttcacggttctcatttcaagccatacgagttgtatatcaaaactccagttcagattttactgtgtggtttgaaagacatgattctacacttaaaactgcattgtatagagatgattgtattgcagaatatttttattgctctgatctgttctgtttaagcttatggtgcattaccagccagttgcagggtctgatgattggggttcaacacccacggagcagggtcgaccaagaactgtgaagagaggagttgagaacatctctgttgacattcattgtggtaatgttaatcgtttattttttcttacctttggatgtatttgtttactccttaaattgtgacctttttctgtggatttagattacctcaaggcttaaaaatcatctttaatcatatgggtttattccaagttgagattagcatcacttcgtctactaagaatcttaatagatgtaaaaatatcttttaaaacatatggtaggatgggtaaaatttggcaatactatccaggaagtcactaagtacagatgaactgatttagtcctaattccaagaagtgtgattccacctacttgactagaaatttatacctggtaataactccttgtccttgaagattttcaactaaggaaaactgtttttcagcaggacctgattatgcactgctatctaggtagggtcacttatggttttataatatatttaattggattataatattccttttttcttgtctcttggacaaaatcctagctttactgtaatttaaaaagatgagtttaaaatttcaggctttaaaaacataccaaacattgataaaaatgaaatactagataaaagtattttatcaatgttcagttgcctggattcaataactgtattatggttatgtaagataatatacttaggaaatacacattatggtattaaagggttaaagaggtatggtgcatgcaacctgatgatgtatgtagtctgctttctaatgattcagaaaaataaatgtgtgtgtgtgtgtgtgtacacacacagagaatcataaagcaaatgtaattgttaaaaagttgaatctctgtaaaaagtatgtgggagtgtctgtactatgctttctagttttctgtacatttctagttatttagaaataaaaagttttaaaaacctggctgcacgtggtagctcatgcctgtaatcccagcacttggggaggccaaggtggaaggatcacttgagcccaggagttcgagaccagcctgggcaatatggcgaaaccctgtctgtacaaaaaatacaaaaattaactgggcatggtagcacacatctgtagtctcagctattttggaggctgaggcaggaggatcactcgagcccagaaggttgaggctggaatgagtgtttatcatgccactgcactccagcctaggcgacagagtgagactctgtctcaaaaaaaaaaaaaaaaaagtttttaaaacctgaaaaaaggccaagtgtgttggctcacggctgtaatcccagcactttgggaggctgaggcgggcgggtcaggaggtcgagaccattctggctaacacggtgaaacaccctgtctctactaaaactacaaaaaattagccaggtgtggtggcgtgtgcgtgtagtcccaactactcgggaggctgaggcaggagaatcgcttaaacccgggaggcagaggttgcagtgagccaagatcgtgccactgcactccagcctgggtgacagagcaagactctgtcacaaacaaaaaaaaaaccataatttaaaaaaaaaaaaaaaagagtttttttttttggagacagagtcttgctctgtcacccaggctggagtgcagtggtgtgatctcggctcactgcaacctctgccacctccagggttcaagtgattcttctgcctcagcctcgcgagtagctgggattacaggcatgtgccaccacacccggctaattttgtatttttagtagagatgaagtttcaccgtgttggtcaggctggtctcgaactcctgacctcatgatctacctgccttggcctcccaaagtgctgggattacagccgtgagccaccgcgcccagccgagttttctttttcagagatcagaaaaaaaagaaaaaagtcctgaaaaaaattttacagacttatttcaagataaattagaaaccaagtaaaatcagtgtatttttgctaggtacttaaaggactattttgtatcttttaaattatctgttcatcttttaacttgctcatatttataaccttttcatgatgaatgatattagaatacatgactaattatacagaataattttctttttaatttcatttataggagaacctttacaaatagatcacttggtttttgtagtccatgggattggaccagcttgtgatctccgctttcgaagcattgtacagtgtggtaggtttgcaaagcatgtgagagaatattaatcagtgctcttgtgagctgagataaagccttgtctttggtctattgtcttagctgcataagaagatttggagagttaaagacaggtggcaaggtagtaaagcttctcagcttagacctgaagtgctaggaaattcctgagtctaatagtttatactcttaactattgtaatagtctcaaatgaacaagcagttaatccctataaaattgtgttttatgatgtggtggtcctatttctaactatttcaaatttacagggaaccataaagatgatagagtttaatgaataacagaagcatcaatcatttttgtaattcatactgtgataaacctttgatattgtaattggaggatttaagtcattagtataactagattttgaaaggtgtcctctaggctgggtgcggtggctcacgcctgtaatcccagcactttgggaggccaaggcaggtggatcatgaggtcacgagttcaagaccagcctggccaagattgtgaaacgctgtctctactaaaaatacaaaaattagccgggcgcagtggcaggcgcctgtaatcccagctactcgggaggctgaggcaagagaatcacttaaactcggagggcagaggttgcagtgagccgagatcgggccactgcactccagcctaggcaacagagtgagacctcaaaaaaaaaaaaaaaaaaaggtgtcctctaaaacctgatagtattcaaagtttaattgttccaattagggtgtcttattctaactggctaatggttctaaacataaactagaattgtattgtggaaggttgagactgatgtgatatgaatttcaaacaacagtgtatttttttttctttaaagtattgggtggtgcttgtttataagaaccagaaagttagggtaggaattcaactgcaagactgttgttatattgtcatgtgattaaaaaaaaaatgaaacagttctcatgatgccgacgttttgaagtttagctttctttttttttccttttcctttttttttgtttttaaatatattattttctttcctgagacaagagctttgctctgttgcccaggctggagtgtagtggtgtaaactcagctcactgcaacttctgcctcccgggttcaagtgattatcctgcctcagcctcctgagtagctgggattacaggcgcacaccaccatgcctggctaatttttgtatttttagtagatggggtttcgccatgttggccaggctggtcttgaactcctggcctcataaaatccacctgccttggccccccaaagtgctgggattacaggcatgagccactgctcctggcctgaagttagccttcttttgatgaaatattttgtatggtaaaagcaagttgttaggccaggcacggtggctcacacctgtaatcccagcactttggggggccaaggcaggcagatcacctaaagtcaggagttcaggaccagcctggccaacaggacaaaaccccatctgtactaaaaatacaaaaattagctgggcatggtggtatgtgcctgtaatcccagatcctcaagaggctgaggcaggagaattgcttaaaccagtgaggtggaggctgcagtgaggtgagatctcgccactgcaccccagcttgggttacagagcagtactccatctcaaaaaaaaaaagttattaaagaaacatcttttcctatatgcattcataatttttcctgaataccactttatttttgacggaagtcagtatgtgttctgtgcaaatgtagttagagtataattacatgatttgttgcatccagattctacagatttgttacttcattgttgatgcataagttaattttcttttccagttaatgattttcgcagtgtttccttgaacttgctacagacacattttaagaaagcccaagaaaatcagcagattgggagggtagaatttcttccagtcaactggcacagtcctttgcattctactggtgtggatgtgtgagtaatacttaataccttcgagttgttagctgtgattatattttctgatcattgctatgcttggggacgtttttatgctatagctgactgaatatttaaaatttcttagagatatgctattaaatgctgatcagtcccttggtttaattagccctggttaggagtggagagctgtgtgtatcttcagtatgttttactggctcactagtatttactgttacagcttcattgtatctttagcattaaagccaaatattgctatcttcccatagtgtataaccatttccatcttcagatgtcaaaagctagccataccccaagatgtacaaagtattttgttgttccttttgttattatatttaaataatatttgtccaaatttagaaaaaaggggggatttctcaaacattaaactactagcatttaaaacttgaggtataattggtacagtgacttttaagtgatggctttcttaaggtacaagaccattagttttgtttgtaaattttatggtaatgacagagaatgttgcttaaattgaggatatctagctatggggctctccagcaagtagtgtgtttctaatgtagttctagaatagaaccaggagatgcaggaagtagtcagcattgtttccatgctggtctcagaaatggcttttctgattctgtgtctcagttctcagtaccctgtgatttgggtatattctgtttgccaaacactgtggtggggtccggattcttcaatatttgagcagatgctaagaggttactaagggcacgtagcccttataaattgcagaagtggttgaatatttgaggaatctttctgggaattttaagaaacctttaactggatgttagattttgtcagcgtggtcttcctctcccagatatgaattctgtttgcttttggcacctggcactcacacctttttctgcttttagaaattgtgcattgagagagggagctgatctctttatcgtttgacctgtaattaaaaaaccttactgctgagaattccaggaaaagccttttacattttttgttttgtctttttagaaaacttttttttattagagataattttgttcacagaagtagtatatatgatgaatccttgtatactgattacccagccctaacaagcctcaacacatggctggttctgcctcaaccgtatcttcataccttatctaatgccccttcatcaccatatgatttttatcttagacatcctgtaatttcatctgtaaatgtttcagtttgtatcttttttttttggttggagtgcagtggtgtgatcacagctcactgcagcctggacctccctgggctcagatgatcctcctgccccagcctcccaagtactgctgggactacaggcatgtggcaccacttgcagctgattttttttatcttttttttttttttttgagatggagttttgctcttgtccaggctggagtgcagtggcgtgatctcagctcaccgcaacctccgactcccgggttcaagcagttcccagtcttggcctcccgagtagctgggattacaggcatgcgccaccatgcctggctaattttgtatttttggtagagacagggtttctccacgttggtcaggctggtctcgaactcttgacctcaggtgatccgcccgtcttggcctccccaagtgctgggattacaggcgtgagccaccatgcctggcccaatccagctgatttttctattttttgtagagatgggcttttaccatgttggccaagctggttttgaactcctgggctcaagcaatctgtctgctttggcctcttaaagtgctgggattacaggtgtgagccacagtgcctggcctgaacagtatattttattttttattttatttttgagatggagtgtcgctctgtcacccaggctggagtgcagtggcacggtctcggctcactgcaacctctgcctcctgggttccagcaattctcctgcctcagcctcccaggtggctgggactacagtcatgcgccacaatgcccagctaattttcgtatttcttagtagagacagggtttcaccatattggccaggctggactcctgacctcatgatctgcccgcctcagcctcccaaagtgctgggattacaggtgtgagccactgcgccggcctgaacagtattttttttgttgttttttttgagacagagtcttgcactgttgcctgggctggagtgcaatggcacaatttcggctcactgcaacttccgcctcctgggttcatgtgattctcctgcctcagcctcccaagtagctggggtaaaggtgcacatcaccacacccggctaattttttgtatttttagtagagacggggtttcactctgttggacagactggtctcgaactttggacctcgtgatctgcccgcctcagcctcccaaagtgctggcattacaggcgtgagccaccgctcctggccctgaacagtatattttaaaggacttaaaaaatgtataaccataacactattatcacacttaaaaatttcttaatatcatcaaatacctagtctgttcaaatttccagttgtctattatatttttatacatattttatacatatttttatatacattaattatataattatatacattaatttttgtatacatatttatataattacaaacatgttttaaactgggatccaaataaagcccataccttgcaattagttgatatgtcttttattataagtctctcttgggctgggcatggtggctcatgcttgtaatcccagcactttgggaggccgaggcaggtagatcatctgaggtcaggagtttgagaccagcctggctaacatgacaaaaccctgtcactactaaaaatacaaaaattagctgggcatggtggcacatgcctgcaattccagctatttgggaggctggggcaggagaatcgcttgaacctgggaggcagaggttacagtgagctgagatcgtgccactgccctccagcctgggcaatagagcgagagtctgtctcaaaaaaaaaaaaaaagaaaagtctctttaatttattttcttgattaccacttacctctctgtctacatctgttgttttcttgcagtttatttatggaagaaatgggtttgacttgagggttttttatactctgaattttgcttatcacattcctctggcttcattacacatgttcctttgtcctctttttgttttttcctataaatcgacaattgtttgttataaaatgtttaagcttgaaggcttaaaattggaagcagctattaagtgtatttaggtttcctgcttatattatttttccttttttcagagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggtaacaaaatgagttctgtgtgaccagagaagactatcacattttaaagacacctgtttttgaagcacaatgtcttttatcagtatgaaattcagaggtctagaagtggtctgtggtcaggaaatttggaaggggttggaagggtggcggtaaattggaaagaaagactccttgctgtatagatttgcttacatatgtaattggcttatgccttttttgtataacagagagccatttagtgctaatgcttagaaattgtcccttcttctattttacttataggttcgcttatattgtttgatatcctaacaaatcagaaagattctttgggggatattgacagtgaaaaggtaatttagatgttcagctaggttttcttgtagttttccttagtaaggatttatagattttagacttattttttgtttttagctgagtttagtttcatgtcatgacattacatttacacttattttcattttaacagacttttaattatctctgtcattcttggatgatagaaggaagatagtaacatgcttctacaaataataattgttatattctaaaccatagttatcttattttcttttgtgaatatgcaccactggctgggcgcggtggctcatgcctgtaatctcagcactttgagaggctgagactggtggatcaccttaggtcaggagttcaagaccagcttggccaacatggtgaaaccccatctgtactaaaaatacaaaaattagctgggcatggtggtgtgtgcctgtaatcccagctacttgggaggctgaggcaagagaatcgcttgaacctgggaggtggaggttcagtgagctgagatcgtgccactgcactctagcctgggtgacagagtgagactccgtctcaaaaatatgcactgctgatctgttaatagagttatggaatcattgagctaaatgaagtttgcatatgaacaaatgaatgaattggctacaaattgatatgatttatagaaactctgttcgaaagtattggggacttgatgtttaaacattattttagtaaaaattcctataaccatgtatcatctgtaggattgatttggtacctatttctcctgttggaccatgagttcctccagagcagagcttttgtcttagactattttatttctatttctatttcttttttttctttctttttttttttttttttgagacagtctcttgctctgtcacccaggctggaatgcagtggcatgatctcggctcactgcaacctctgcctgcagggttcaaatgattctcctgcttcagcctccccagtagctgggacaggcgcatgccaccgtacccggctaatttttgtatctttagtagagacagggtgttggtcagactggtcttgaactcctgaccttgtgatccgcccacctcggcctcccaaagtgctgggattacagatgtgagccaccatgcccagcctagactgttttatttcttaagcactgttttcctaatttcttaagcactgagctcccttaaaattcagcaaatgtttgttaatgatgatgaatattttactaatttctttaaaaacatattttcaattgaagttgcaaaaccttggaacctcttaatttatatcttgcataaatgacaatttgttaaagttaagatacattgctgtggaaatctatgtatttctttactgcaaaatagtattaaaggaaactaaatgaatttcaagaatatgagctttataatttaatttttaggattcgctaaatattgtaatggatcaaggagatacacctacactagaggaagatttgaagaaacttcagctctctgaattctttgatatctttgagaaggagaaagtagataaggaagctctggtaaaaataatcttttaaaactttatgccaagccattttcagtatttttgtttatcgtgtttactaagagcctaccctttagacactttttagtcataaatactttatgattaatgttccttagcattatttatttgctttttatcatatcaagtgacctttgctttgtggaagttcaaaggtcagatggccatattgatattcatagagcaatggagcagactaaccagtacggctcatagaaaacatgagtgcaagaacaaacaaataaataaccattagctattccaactctaattttctgttgtactttcaagagctctactgttatttgcgagtagctgggattacaggtgcccgccaccacgcctggctaattttgatatttttagtagagatggggtttcactgtattggccaagctggtctcttggccaggctggtctggaattcctgaccccgtgatccacccaccttggcctcccaaagtgctgggattacatgtgtgagccaccgtgcccagccagctgatttgtttttttttttttttttccatttttgtcgtgcctttttctggtttgtgatacattcactcatttaacagatatttagaaaatgcttactataccaagtactggatagactggtgaataagacatatgatccctgacctcatagtgtttatagtttactggggaagacacatgttaaataatcacacacatcatggcaattacaataagtaagtaggaaaagtacaccgtgttgtaagaattaacctggtctcataaggtgcaggaaggcttccctaatcaaatgagtgatagctggctgggtgtggtggctcatgcctgtaatcccagcactttgggaggccgaggtgggcagatcacgaggtcaggagttcgagaccaatctagtcaacatggtgaaaccctgtctgtactaaaaatacaaaaattagctgggtgtggtggcacacacatgtagtcccagctacttgggaggctgaggcaggagaatcgcttgaacccaggaggtggaggttgcagtgagctgagatcacaccactgcactccagcctgggcgacagagcaagactccatctcaaaaaaaaaaaaaaaaaacgatgagtgacacttgagatcttgattgttagtctgttccatacttgtgtgtttgctgtatgttctcagtgcttgcgttcatcagcaggagtataatccttctcaggcatgtgacatctaagtcagtatagaaatcaaggaagtttttttgttttgttttgtttttttgagacggagtcttgctctgttgcccaggctggagtgcagtggcgcgatctcggctcactgcaagctctgccttccgggttcacgccattctcctgcctcagcctcctgtgtagctgggaatacaggtgactgccactgcgcctggctaattttttttgtatttttagtagagacggggtttcaccatggtctccatctcctgacctcatgatccacccgcctcggcctcccaaagtgctgggattacaggcgtgagccaccgcgcctggccagaaatcaaggaagatttttatgtcctgaagtccttagatacccaacttctctgttttttttttttttttttaacaataacaatgtctatattattgtaacattgatattataagtattgatattttctattcttttttaggctgtttcatgaataaaacaggtccttttttctggaagttattctatgatgttttactactagagagacaggcagcaacagagtgcctaggccttgttcctcttaggggacaggattgattttattttgtctagaaataagaaagacttgattttctatgcctaggctttatgtacagaccgagatcttcaggaaataggaattcctttaggaccaagaaagaagatattaaactatttcagcaccagaaaaaactcaatggtatgtgcctaatacagcttgttggactaaacaattctttgatgtccatagtgtgtccttgtgctttgtgggatgtttactctggggagccaagcagttttttggtaattgatctttggctctttttttttgagacagggtctcgctctgtcactcaggctggagtgcagtggtgtgatcccagctcattgcaacctctgcctcccgggttcaagcgattctcctgcctcagcctctcgagtagctgggactacaggcgcccaccaccatgcctggctaatttttgtatttttaatagagacggtgtttcaccatattggccaggctggtctcaaactcctgaccttgtgatctgcccgccttggcctcccaaagtgctgggattacaggtgtgagccacccgcctggccgatctttggctctctttctagaaattaaacacattttcttttttacattcttttttttttcttttcctggaaatgaaatctcgctgtgttgcccggggtggagtatagtgggtggtctcggctcactgcaacctccaccttccaggttcaagcaattctcctgcttcatcctcttgagtagctgggattccaggtgtgcaccaccatgcccagctaactttttgtatttttagtagagacggggtttcactatgttggccaggctggtcttgaactcctgacctcagatgacccatgtgcctcagcctcccaaagtgctgcaccgctcctggcccttctttttttacatccttaaaagtattattagcttcagaagtcttctctcctctggaattctcctaccatttatttatttatttattttttgcttttttcttttcatgagagttttaccaatatctacttcacatcacataccataaaattcacccttttaaagtttacaatttaatggtttttagtatattcatagagttatgtaaccattaccactatccaatttcagcacatttccattgtcccttagggaaaccccatacccatttgctgtcactccccattgctccctgcccccagcctctgtcaaccactaatctactttctgtttctacagatttgcttattttggacattccatataaatggaatgtccttttgagccatgtgtctgacttctttcacttagcataatattctgaaggtttacctgtgttaacagtacttccacattcagtttttctggtcactgaatttctaactccatatcttattagttagtttttttctttttgagtcggagtgttgctctgtcgcccaggatggagtgcagttgcacgatcttggctcaattgcaacctccgcctcctggattcaagtgattctcctgcttcagcttcctgagtagctgggattacagacacgcgacaccacacccagctaatttttgtatttttagtatggggtttcaccatgttggccaggctggtcttgagctcctgacctcaagtgatccgcccacctcagcctcccaaagtgctgggattacaggcgtgagccaccatgcctggccagtagttagttcttttccaactttttagcaggtggctcatttctttttaaagactcagttcttggcccagcccatcgacatcctacttcccttgattacagaggcacagcacttcatagaactctagcaatcctcagcattatcttcccacagtgccctgctattgttttctcttatgattgttgcctaaagtttcaacgctactgaaatggctatgtacaactttcatcattttagagcatctaagaatgtcaattaacaatttaaggcaataatttaatcttgttttctgaggaaatcttcctagaatttttggctgccatttcagaactttcccaagggtcctttcaaaccagtagaaaactatataatcctttggctatacttttactatatagtagctccccatactttttttttaaatagagactatgttgcccacgttggacttgaactcttgggcttaaacaatcctacctacctacctacctcagggtcctgagtagctgggactacaggtgcatgccgtcatgcccagcttctccacataactattttttattctttagggtattaagagaccagccccgcagcctgcttcaggggcaaacatccccaaagaatctgagttctgcagtagcagtaatactagaaatggtgactatctggatgttggcattgggcaggtaactaattctctttgatcattttacagcctgctatttgtatggtagaaacagatgtaacttttgttattaatgagagatgcttttattttcctcctttgaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcaccctgtaagcattgtacagctattgtggttttacctaaatatcagggcttattgttaaagaacataggattttctgttgtgttgatttttttttcctattccattgtctagcaatgagacaacttataatagtattgatttggaagtgatggagcagaactgtacatttttttaaatgaacttatgattattgtttaagatacatagttctggttgtacatggtgactaatgcctgtcatcccagcactttgggaggtcaaggcaggaggattgcttgagcctaggagttgaaggctacagtgagccatgattgcaccactgcactccagcctgggtgacagagcgagacctcatctcaaaaaaaaaaaaaaaaaagttatatagtttccagactgtgcttagcagaggtaaatgtagctcttgtttttcctatgtagtttgatcctgtggcctataggattgaaccaatggtggtcccaggagtggaatttgagccaatgctgatcccacatcataaaggcaggaagcggatgcacttaggtaagtccgagcatagaacttgataattctagaccttttggccagtgcaaagggcatcattcactctgttcagctatgttggaccctaagctctttgtaaatcatttaatgttctttatttatatgtttcagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtggtcagtgacactgtacacattgaccagctgccagataagagggatgccatggtgtggcgtttttcatagttaatttaatttaatttcacatttaatttcatagttaatattgcattcttttgctttagttttcaacttctaaagagctctattcctgcttgcatttagtataaacccaaggcaaatgacctagctatcaatggtataggtaatgagatgtgttgcgcaaaagcaaaaaaggggattggacaaaattactgtgacctgagaaggagcttgaaggagattgagaggaggaagatgggagagagctctctgaacagagagtagctcattctctggtaaacttggagtgtgaggagaagttaacaggataaccctgaaggccaaaaggttttagattcttattatggttcttccatatccagatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactggtaaatgttgtttatttttgtctgttttgtttgtttacctgtttcatagatatttgatagatgtagaaaaaggaggataggccaggtgcattggctcaggcttataatctcagcactttgggaggccaaggtgggaggattgcttgagttcaggagtttgagaccggcctgggaaacatagcaagacctcatctctacaaaaactaaattagctgggcgtggtggtatgcgcttatagtcccagctacttgggaggctgaggcaggagagtcacttgagcccaggagtttgagaccacagtgagccatgatcacaccactgcactctagcctgggtgacagagcaagaccctgtctcaaaaaaaaaaaaagacctgtgtacctttggaattaaaatgacttctcatttagacagcacaagcacaatcatgtcatttcaagaatctggtttaaacacactgttgttttattttgcagctgggtagaacatggttgaggctaatgatgccaacaaccataagttcaattatcttggtgttaaaaatgtgtcttttggccatttaggtgcacatgaatgaactggaacaaatattactgttgctggaagtcttatagcaaacccatttgaaagcatttatggtagctgtgacagaattaattattattattttatcattatttgagacagggtcttgctgtgtcacccaggctggagtgcagtggcatgctcatggttcactgcagccttgacctcctggactcaagtgatcctcccccctcagtctccctaataagtaggatgaccgttgtgcaccaccatgcccagctaatttttgtacagacagggtttcgccatgttgcccaggctggtctaaacttcaagcaatcaatccgcctccacctctgcctcccaaagtgctggaattacaggcatgagccaccacgcctgggcagaattattattaaatataattggttacctgatggattgtagaatggattaatgatgcttattgaaattcaggccgggtatggtggctcatgcttataatcccagcactttgggaggccgaggaaggaggattgcttgaggccaggagttgaaggctgcagtgagccatgatggtgccaccgcaccctagcctgagtgacagagcgagaccatgtctgaaaaaaaatagtataaaataatactaattaatccctgaagaagttgacataaaaataaagtaagggaaataagatgggtcagagataagtgttttaaaaatgaaagctcagaccagcatggccaacatggcgaaatcctgtctctaccaaaaatacaattagccaggtgtggtggtgcatgcctgtagtcccagctactagggaggctgagacaggagaattgcctgaacctgggaggcagaggttgcagtgagcgagatcacggccaccgcagtccagcctgggtgacagagcgagactccatctcaaaaaaaaaaaaaaaaaaagcaagctcaaaggtcctaagaataatttttcccttgaattctgatgaggaattatcatctgatgcaatcactatcgtttgtatataatatatacagtagaggccaaaagcaatcttgtaaggggctaaaataatgctaagaatgatctctggtgatctggcttgatagaaaagaaagcagagttcttttaatatttctgtgtgggcagtacattcatatggtttgaaattcaaagaaagaaaaataatgaaaagcctcttttttattttgtttcttgcaatcagtttcttccccatatacaactaatgtaaaatgtcttccagccatctattttatgcctccataataaatatatgtatgtgaatatattctttcccttattttaaaaacataaatagtaaattaaaggcaatgttctgtgccttgttttttctactagtatatcttggcattttttaacctattatatgttgtttcctcatttttttttttagctgcatagtcttccgttatgtaaatacaccataatttatttaagccgtcctctactcatggactttcaggtttccttttcttttgcacacaccttgttcatgtcatttcacctactcatgagtatatctgtaatgtaaaatacttcgaattgaaatcaatggcataaagggtatatacatttgtaaaatttgataaatattgacaaataagaggttgtacctttttatactcccagcaataatgtacgaaagtgtgtgtttctccacagcttttccaacagttttaatatttttaaatctttgccaatttgttgggtgaaaatgtacaatatactgtacatattaaaagaatacacatttgatgagttttgacatgtatacacctgtgaagccatcactacaatcaacttaacatattcatcactctcaaaagtttccttgtgccttttgtaatccctcccttcttttctcttccccactcctcctaatttccagggagccactgctctgttctgccactgtagattagtttgcttatgacttgtatttggaatcctacagtatatacttttgttgtttggcgtttagcttatttatttatttatttatttttttgagatagtcttgttctgtcatccaggctggagtgcagtgacacaatcatggctcactgttgcctagatctctgggctcaagggatcctcttaggctcaagggatcctcccatctcagcctcccaagaagctgggactgcaggcatgtgccactgggcctaattttttttaaatttattttcgtagagatggggtctcactatgttgcccctgctggtgtcaaactcccggcctcaagcagtcctcttgctttggccccccaagctgttggtattatagacatgatcaatgttgtgtatatcaatagcatatcctttttattgctgagtagtattccattatatggatatatcagtttgtccatttacctgttgatggatattttgatagtttccagtttttggctattaacaaagctgctaggaacattcatgtataagactttacatggacatattcttgggtaaataggaatggaatgggtggatactatatggaagtgtatttttaaaagaaactgccaaactgttttgccaccagcagtttacatctccatcagcagtgtttgagagtttcagttgctccacatcaacttttttttattttttatttttatttttgtgaggcagtctcactctatcacccaggctggagtgcagtggtgcgattatagctcactgcagccttgaccttggactcaagccatcctcccatctcagcctcctgagcagctgggagtagctaggaccacaggtgtgtaacactatgcccagctaatttttcaaatttttttgtggaaatggggttttgccatgttgcccaggctggtcttgaactcctgggctccagtgatcctcccacttggcttcccaaagtgctgggattacaggtgtaagccaccatatctggccaacaagttttttttttttttttttttttttttttgagaaggagtctcactctgtcacccaggctggagtgctgtggcacgatcttggctcactgcaacctctgcctcccaggttcaagcaattcttgtacctcagcttcctgagtagctgggattacaggtgtgcgctaccatgcctagctaatttttgtattgttagtagagatggggtttcaccatgttggccaggctggtctcaaacttctgacctcaggtgatccacctgcccctgcctcccaaagtgctgggattacaggcatgagccactgcgcctgctcaaaatttttatttttatgtaatcaaatgtgttgtcatttgctttttggtttctggaatttgtgtcatactcagaaagatcttccttactttccaaaaaaattcttaccacagtattttttttttttttttttttgagatggaatctcaccctgttgcccaggccagagtgcaatggtgtgatctcggctcactgcaacctctgcctgccaggttcaagtgattctcctgcctcagcctcccaagtagccagcattacaggtgtgcaccaccatacctggctaattttgtctttttagtagagacagggtttcaccatgttggtcaggctggtctcaaactcctgacctcaagtgatcccacctcagcctcccaaagtgctgggattacaggcgtgagccactgcacccagccaacacagtatattgttatatatataattttttttagaaacaggatcttgcatgcagtggcttctcacaggcatgatcttagtgcactagacccttgaattcctgggctcaagcaatcctcttgccttggcctcctgagtagttgggactgcaggtgtgcaacaccatgcctggctattctaatattttatatctaatttttacatataaatctttgattcagattcaggtccttttttccccacgtctcaacactattaatagatttgagattctaaattaaattaattaaattcttttttttttttttgagacagagtcttgctgtgttgcccaggctgaagtgcagtagtgcagtagttggctcactgcaacctacgccatctgggttcaaatgattttcctgcctcagcttcttgagtagccgggactataggcatgtgccaccatgcccagctaatttttgtatttttagtagagatggggtttcactatgttggccaggctggtctcgaacgcctgacctcaggtgatctgcctgcctcgacctcccagtgttaggattataggtgtgagccaccgtgcctggccacttaattaaattcctatacataaatgggactatttctcaacttcttacttgttgatttgcttatttatgtaccattttaatatctgatagagctaattcccacttgttgatacaggaatttcttaagctggggtctgtgtatatgagtttgtgggagatgagggaagtctgtgaatccaatgaaatacacatttataattgtggttgcaatgtgatcctttctggggaagaatccgtaatttcattagattctcaaaaggatgcatgactcaataaatgttgaaccacagatctagaagaataatagaggcttatatccttaaggcagtccctcatgagtgttaatctttttaaatcaaattttgttatgaagtgtggatataagtaattgcttgtgcatacgtagaataatatctggaaaacgcatgagaaattgataacattggttgtcagaagatgggaactggtggtggttgaggaacaaaggtgggagggagacttcgttactttcttatattgttggaatttggaaccttatgattgtattaccttttccaaaaagtgcataatattttaaaaattaaggtgaccaactggataactcttcaatagtgtctctagaatgatctctgtggaaaaggaacaattcttggttatttcttactggctttttttttttttgaaatggagtctcactctgtcgcccaggctgaagtgcagtgacactctgcaaccttcggctcactgcaacctttgcctcctcggttcaagcgattctcctgcctcagcctcctgagtagctgggactacagtcgcatgctgccacgcctggctagttttttttttttttttttagacggagtctcgcctatctgccaggctggagtgcagtggtgcaatctcggctcactgcaacctccgcttcctgggttcaagcaattcttctgcctcagtctccccagtaactgggactacaggcgcataccaccacaccctgctaatttttgtatttttagtagagatggggtttcaccatattggccaggctggtctcaaactcctgaccttgtgatccacccaccttggcctcccaaagtgctgggactacaggcgtgagccaccgtgcccagccctagtttttgtatttttagtggagatggggtttcaccatgttggccaggctggctcaaattccagacctgtagtgacttgtccacctcagcctcccagagtgttaggattacaggcatgagccaccgcacctggcctctcttcctagcttttttatattactagacttaatgccagagttctttgccaggtcaccttccaaaccactgccaattacattacttctgaatctcatttctttgcagaagtaaaaaataaacttgcaagatggttgtatggattaaatgagataatatatgtaaaacatttggcacaagtgttagttccttttctcaacataattttttctctttatagggagtctgaagatacagtattgctcgtcctcaaagagatctaccaaacccagggtatcttccttgatcagcctttacagtaaaaatgacccatctatggctgcttaatgtaagttttaaaatgtcatatatatagtgtaattcttacatattaacatgttataatgaactatggagcctcaagctctttttaaatatactagctgttgcctgtcaccaagatctaggctgctattcatttttagagggactggtagaaattcatggggaaaaaaacacagtagcccatttagaggaagattagtgtatgtctgttttgctagagattttgtccaatgacacctgtcattttttaggatctaaactcagagttttaatggttctgttatctaagagttactgtggcaacagttatgattttaattaccaaccacccatcctgagatttaaattactcagccttttagatgtgaaattacaaagtctgtgtattcgactctggcattctctgtggttgccttccagttgtgactgcagctcttctcccactttcttccctagacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatg

SEQ ID NO: 37769 - DNA, 79866 bp, Homo sapiens
agcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgagtgagtcctgaggggcctaagtgagtcccgcccctggcgtccgcgacctatcactgcgtgcccggcttgcggcgtccgaggcctccctgccaatccgcacggtgcctggaggggccggagcaagggtgttcaccttgaaaacctgtagcgtttctcgtggaggcgggtataaccagcagaagcacctgtgtgctttttcatactgtttaacccttgggatttagacggatctggctcgtctctagccagctcaacacttaacataagcttttgggcaacttattaaatctctgtgggtcattttaataataattcttccttcacaagtgtatcgttagaccatagatagcaaaatgataggcgctcagtaaaaaccatgtgcttattctcgtgccccatgaaagagtgatggtaggttctttctcctttgtggaagcaggaaaactgaacttgggcatactccactaacatgaaatgggggatgtgcgcgtgcaggaacttgtggaacttctgcccgcagaatgcctggtcgagctctttagggccttagcatgcctcgccttgatgggtagcaaaggcacgtgtcggaagcaggtggcctttctgggagtgcgcaggctactctcgatgtttggctggactgagcagttgaaacactgccacccaccgcctgggttttgaggcgagaatccagctggccttcagagataagctgggcggcccattttggagaggtgatccctgacttgaaaccaggcttgcccagtgtgtccgtgactggtgggtgagtctggaccgttgtgctgaacgaattaaccaacgggaaggtgcagaagtgaaactcttacagatgaagagtattcaggcacaactcacaaccatgagggaggcactgggggagggatggggtcttaaagtgaggagatttgaacagctctatatttgtctaatattgattcagatgtcataaattcgcatttgacaagggtccaaaggtaacagttccttttgacacttgagagtgaaatgtaaatttagtgatggtttgtggtgctaggagtgctttctctcccctggggctacttctaacctactctgttagggctgagggagatgttagatcatcctctggaaaggcctgtcagtgctcctgtacactctttctgttggggcctattgctcaattcttccctggaacatcgcctagccctttcccaggtagatcctactaggtttagatgaagcctccagaagctgtttttcttttgccaaagttaacttaggaggctgatttaatatgaaccccctcctgcacccctttttatttttatgttttgatacggagttttgctcttgttgcccaggctggagtgccatggtgcgatcttggctcattgcaacctctgcctcccaggttcaagctattctcctgcctcagcctcccaagtagctgggattacaggtgcccacgaccatgcctggcaactttttttttgtatttttagcagagacagggtttcaccatgttggccaggccggtcttgtacgcctgacctcaagtgattcacccaccttggcgtcccaaagtgttgggattatgggtgtgagccactgcacccggccctgcaccccttttaaaacaatttttgaccatttccgtagattttcccagaagaggaattagtgggtcaaagggtgtaagtttatttattttttttgagacagagttcactctgttgcccaggctagagtgcagcagctcactgcaacttctgcttcccagcttcaagcaattctcctgcctcagcctccagagtacctggggttacaggtatgtgtcaccacatctggctaatttttgtatttttagtagagatggagtttcaccatgttggccaggctggtcttgaactcctgacctcaggtgatccacccgcgtctgcctcccaaagtgctgggatgacagaatttttttttttttttccttgagacagggtcttactctgtcacccaggctggagggcagtggtgtaatcatggctcactgcatccttgaccttctgggctccagtgatccttccacttcagcctcctacccagctaatttttttttttttttttttttggtagagacagggtctcgctttgttgcccaggctggtctcaactcctgggctcaagcagtcctcccaccttggccttccaaagtgctgggattacaggtgtgagccgcagtgcctggtcagtataaatatattttaaaaatctgtatatatgttgccaaattggtttcctgaaaacttactctactttacatgacagtgtataggattgcctgttttttgttttgtttttttttttttaaatgcaacctcaccagctttggctactttcctaaggggaaaataatagccaatttgaggtattttttgtttgtttttgtttttttcggggagggggggataggacagtaggctagggtatttgcctcgggttgagagcttgggagtccaagcaatggaggtttttttttttttttttttttttttaagatagagtcttgctctgtcacccaggctggagtgcagtggcgcggtcttggctcactgcaagctccgcctcccgggttcatgccgttctcctgcctcagcctcctgagtagctgggactacgggtgcccaccaccacacctggctataattttggagttttagtatagacggggtttcaccatgttagccaggatggtctcgatctcctgacctcgtgatccgtctgcctcggcctcccaaagtgttgggattacaggcgtgagccactgcacatggcctctttttttttcttaagacagggtctcaccttgttgctcaggctggagtgcggtggagtgatcgtggctcactacaacctctgcttcccaggttcaagtgattctcctgcgttagcctcttgagtagctgggatttaaggcacgtgccaccacacctggctaatttttgtatttttagtagagacggggtttcaccatgttgagcaggctggtctctaacttttgacctcaggtgatcctcccatctcggcctcccaaagtgctgggatgacagaatttttttttttttttttttttcttgagacagggtcttactctgtcacccaggctggagggcagtggtgtaatcatggcttagtgcatcctcgacctctgggctccagtgatcctcccacttcagcctcctaccctgctagttattttattttattttattttttggtagagacagagtctcgctttgttgcccaggctggtctcaactcctgggctcaagcagtcctcccaccttggccttccaaagtgctgggattacaggtgtgagctgcagtgcctggtcagtataaatatattttaaaaatctgtatatatgttgccaagttggtttcctaaaaacttattctactttacgtgacagtgtataggattgcctgatttttgtttgttattttaaacacaacctcaccagctttggctactttcctaagggggaaataatagccaatttgaggtatgtggttttttttgttgttgttggggaaggggacggtaggctagggtatttgcttggggctgagagcttgggagcccaagcaatggcggcttttttttgtttgtttttgttttttgagacagtgtctcaccctgtcacccaggctggagtacagtggtgcgatcttggctcactgcaacccctgccccctgggttcaagcgattctcttgcctcagcctcccgagtagctgggactacaggtgggtgctaccaagcccagctaattttttttgtatttttagtagagatagggtttcgccgtgttagccaggatggtctcgatctcctgacctcatgatccgcctgccttggcctcccaaagtgctgggattacaggtgtgagccactgcggctagcttttttttttttttttttttttttttttttaaaagacaggttctcgctttgttgctcaggctggagcacggtggagtgatcacagctcaccacaacctccgcttcccaggttcaagtgattctcctgcctcagcctcttgagtagctgggattacaggcacgtgccaccactcccagctaatttttgtatttttcagtagagaccaggttttgccatgttgtccagctggtctcaaactcctgggctcaagcgatgctcgtctcagcctcccaaagtgctgggattacaggtgtgagccactgtgcccagccgaggctcctggtagattgagagctctgacctcatctcctcaaagaagcttttttttttttttgggacggagtttcactttgttgcccaggctggagtgcaatggtgcacaatctcggctcactgcaagctctgcctcctgggttcaagcgattcttctgcctcagcctcctgagtagctgggaagacaggcgcatgccaccacacccggcttattttgtatctttaatagagatggggtttctccatgttggtcaggctggtctcgatctcctgaccttgtgatccacccgcctctgcctctcaaagtgctgggattacaggcgtgaaccaccgtgcccggcccaaagaagcatttttaaactcttctcaagtgagctctttagcattttgtgtcccactccccttctactcagccactccctgctgtggggtcatctctgtgtcacagtgtcactgtcaggtgtggggtccctaaacaggggataggatagtaggagaaggagaagcccacagaggaggcaggagaagaaccaggaagtagcgtgtccttgaggtgggagctgggagcagtagggaccctcgtgaggtgaggtgtgcttctgtaggtctccctagaaaaaacctgtgtcagatccttcactaagcctgctttagtttccaccacctgcttctgcattctttttatggctccttaggtctccagtaagtatttgtggaactaattaattgtgttccagggtcaggttctccttatccccacttctctctaccttttcctcgtcctatttccttattcatcttccacagttgggtggcttctggcgcacactgtctgtcctgatttccatgtcatctaaagtctactaataacacctatctgccttgggcaggttggatagaatgaaagtacttgcattgagatcaacgggcaaatctgcccttcaagccctcccatgaacagcccttgctttgcttactaaattgtctgtgatgacatcactgagtgatctttgttccattgtagggaaagctaacagccagggagaggatcagtctcttgctggaccctggcagctttgttgagagcgacatgtttgtggaacacagatgtgcagattttggaatggctgctgataagaataaggtatttgttcaaatggtggtgtgaacactttttaggtgtggctcagctggcctacccactagaataataataaatctataaggcttttatctgaagtcctctgcagaggcactgcagacatcaagcccagataatttttgtatttttagtagagatgggctttcgccatgttggtcaggctggccttgaactcctggcttcaagcaatccacccacctcggactcccaaagtgttgggactacaggcgtgagcgaccgtaccctgccttgtgtttctttatacgtcctccttcatgtaagcatagagaagtggtggccctgggtcttgattgttttgcttttaggagggtacataaggcctaagatgacagtgccattcactcctattgatgaagtagtagccctgtgcttgctgttgtagagctgggaaagtggggtgggattccttcatgttccttgttcatattgacgttttaggaatttgggttttgtttttgtctttcattgaggcatagtggccaaactcattagaagaagtatttggattttttaacctttatttttgcatttttctggtagtttcctggagacagcgtggtcactggacgaggccgaatcaatggaagattggtttatgtcttcagtcaggtatttcataactccaatagtctgaacttttcttggagggcagagccaagaggaaaatatgtgaaagaagccaatcttggggaatgaaaacttgcttgtagtttggggaaaatgagggatttgctttgcttttcagtgcgtgtttccagaatattgtgtgttttttacttaggaagagtccttagtctgttttgggggggatcacagggcactagccttgtacaaaggtatcccaagaaccaggaatttattccaagtgaatgagattcctcttagctgggttgggtgtgtgcctgtagggcatctgtgtcctgggcagtgtatgtggactagagagagtgcagtgggtgcagcctcgcaaaggggacttgactctcagaaccagagtccccctgagctttgggctttcatgaatatgttcagaaaattttatcagggtgcatcaagacagatacagtttgttcacacacatagccaaagctatcaatatgttattttacacgcaaaagggaatgaaggttgttaatcagctggccttgcaatagggagagtagcctgatttatccaggtgggcccaatataatcacagggtccttaaaagtggaagagggaggtagaagaggagcttataaggatgtgatatgagaaggacatgatctgcagtacctggctttgaagatgggagaaggggaccatcagcaaaggagtgcccatggtctctaggagctggtaaaggcaagaaaacacattttcccctggagcctccagaagggagcacagtcctgccaaccttaattttagcccagtcaatcctgtgtagcgcttctaaattatagaactataagataatacatttgtgttgtttcaaggcactgaatttatattaatttgttatagcggtaatagaaaactaacacagaatatgttgtgtactattttggatttgacttttttctctccagaggtggaaatatgtatataatttaaaatgcttaggtctttttacagacctaaagtttgatattaaaattggctaggcgtggtggctcatgcctgtagtcccagtactttgggaggctgagatgggtggatcacctgaggtcaggagtttgagaccagctggccaacatggcgaaactccatctctactaaaaacacaaaaattagctgggtgttgtgggtgcctgtaatcccagctacttgggaggctgaggcaggagaatcgcttgaacctgggaggcggaggttgcagtgagccgagtttgcgccactgcactcgagcctgggtggcagagtgagactccatctcaaacaaaaaaataataaaatagttatacttggttaatttaaaatctgtcgtagttagtatgcatttaccaattaaattacctttgaaatgttttaaaactgttataaattggtctaccaaatgccgaaatagaaggaatcacatttgttttgtgcaatttatgagagctgagaaaaacttgtacagaaggaaccattgaaaagagagatagaacaaagatgttttctggacatgatgttcactcaccactattaagcagatggaagaattcactgaattgatacttttgaccacctcttatgctcatgtggtagggtgggagtgaggagaaggtggagatgactgagacaagagttcccaccctgaagaagcgaatcattttataggcagaatggcacagaacggatgtaactacagagcacatggagtgagaggttccaggcaaatgctgtagacccaagacaagggaaaatcacatccagggttgaggaaagctttaggaacaatggggcaattgagacaggccctgaaggatactgagggtagggagtgatgagctagtgttttttaatagtgatctccaagatgttaatatcttaggtgctttttctggggagcttctgttcttctggggagcctcctcagtcccttgcctgataattggctgttggtgtattctgagggggagagaaaaaaaggggccagcactcattcagtgtataggctcctaatcttgcatgttttcagcctcaccttttcctcttttaggctagcgattgtgagtttagaacccttctggttaatttcctttagagaacaaacattctctgtcctctcaaggtgaaggagaggccctgtggggtctgactgcttctaacagagacttctgttagtctctgttttcagcctccttctcacctccactttccatggttcctgggttgtcttctccttgattacccccactgcaggtgtgtaagcttccattctctccctctaaatcaggtattttcttgtgctttcagttccccccaaatttgtttaatccttcctatgctattgtctccttgttcttattctcacagctgattctgttcttaattcctaactgtctttttgagggggttttaggagaggttatgcccacaataagccctttacatctgaacataatgaagatccataagcagaagaagcagtgagagctctgattcttgttttttaacctttctttttaaaacagcaaataataggctgggcacagtggctcccgcttgtcatctcagcactttgggaggccgaggtgggtagatcacttgaggccaggagtttgaaactggcctagccaacatggcaaaactgtctctaataaaaatacaaaaattagctgggcctggtggcacgtgcctgtaatcccagctactcgggaggctgaggcaggagaatcacttgaacctgggaggcggaggatacagtgagccaagattacgccactgcactccagcctgggtgacagagcaagacttggtctcaaaatgataagtaaaataaaacagtaaatatttcttaaaaacagaagtgcttgactgtttgatatccatagaatctgatattagagttaattctgtgtgataggttttccttcagaactgcaaatcatttcttttttttcctttcaaatcatttttgtagagcaaagactagctcttttgctcttgacaattcatgaacttcctttaagatattttattctatggaataatctataaatcagacttcttttctaattttttaaacttctgaaaatgctttaaaaactatatgtatgtatttttttaaatacagagtctcgctctgtcgcccaggctggagtgcactggagcaatctctgcccactgcagcctccgcctcttggattcaagtgattctcctgcctcagcctcccgagtagctgggattacaggcacacaccaccacgcccagctaatttttatattttagtagagatggggtttcaccatgttggccagggtggtctggaactcttgacctcaagtgatcctcctgccttggcctctcaaagtcttgggattacaggtgcgagccaccatgcccgggcaactttttttgttttgttttgttttgttttgttttgttttgagacagggtcttgctctgttgcataggctggaatacagtggtgctgtctcaactcactgaagcctctgtctccagggctcaagcaatcctcctgcctcagcctcccgagtagctgggattccaggcatgtgccaccatgcgcagctaacttttttctatattttttgcagatacgggcttctgccatgtcgcccaggctggtctcagactcctggactcaagccatccacctgccttggcctcccaaagtgttgggattacaggcatgagccaccacgcctggcctaaaaacttttatctgtgaattttctatttcttcctcccactgggttttcatctctagccagtcactatatttgacttgctgatttgtattttctttttaggattttacagtttttggaggcagtctgtcaggagcacatgcccaaaagatctgcaaagtaagtgtttaatactcaaattcaatccattgctttcctcagttacatagtgcttattgagtatctttggggtacaagacactgagctaggtacttggggtagggcagaggtatgcaagatgtgctaccaacccgaaggggtgcataacaattttcgtaccatggatctcttccatgggctggcaaagcctgaaccctcctgtttttacatgcctaaaataaaatttgtaggattttaaaggattaaaaatgtttttaaaaaccacatttagaatatacgtgctcccttgttaatgcatttaataacaagatttagcagtagatctagtaactaccgtaatttcaaagtagtcaaaggtgaaatatttcagggtatctgcaacaactttaataggacgtaaaaatatctgtggcttctaataatggcaaatcacagatatttctaatactgaggctcattgcctatatcaataatgaagagaaatgttaacgatcagctagcgttagtaaagataaagatgtaaattttttcctgttcaagttcatggactcccgttcacagatctcttggggttctgaggatttcaagtgaagaacctcttgtctaggtggaagggccaggtgctagaaggtaaagaacagtgcgagcattgtatgctgatatttaaaaactactgctagagattagatgctctggagaggaataaaactataaataatagagaattttggaattaaagttggagctactagtaactggaacatctggattatagacatggtcctgtcatgtattactcctgagaccttgggccagtcacttaacttttaaaccttaatttttctcattttactccctctgttatgatgggtaaatgaggtaatggaagtgaaagtactttttaaactgtcaaggactgtaggaatattgcttattatgctgtcggaattactaacccatgaggaaaatctgtcacattagaagtaaaagcaggcccgggcctgccctcagattaacagatgggtcaacatctgctttcatgaaagtactactttgccattctgtctactgtaagttctgtcaaagcagtacctgggaacaaaactggctgctggaagacgttacaacgtgagcctgtggttctagaaatggttgccatgagttgttttatcccctgctaatgggaagtgctttggctcttgggtgtttgggggctttaatcagcctattaaatatctggtcctttgtcttccatgaaggtacccaatcgtgatggggagtgaaaccagtgttactgcctcctgttttgaaaagtgcactcagaacgttttccagaaaacactgtggtattttgtgaatgtcgttttttatatcaagaacatttgtctcaataaaagatttctctgctgtctcagatcatggaccaggccataacggtgggggctccagtgattgggctgaatgactctgggggagcacggatccaagaaggagtggagtctttggctggctatgcagacatctttctggtgagaaacctgttaatagagaataaaaaaatacagggcttaagttctctaagccatggcctggccagagcttctccaactctcctcattgttctctgccgcattgtgtctgttctgtgggtcctttctgtgtcactgggggtgggatgaagggtagatgaaaagcaagagagagtgggaagagagggttttcattttttctaacagagggccactcacaggggaaattacagttaaagatcgttcataagggaaaagcacttgaaaatgtttttctttttttgaaagcaagggagaggaaatatgaaaagttaaaatgaactgatgtgcttgaattagaagttttaaaaaatgtagcaccttttttattttttagttaaaacactacaggattattaaataaagtccaagccacagtgcaaagaagaatgaaatcaccccagatcctaccattcagaaacatttggcgaacctcattactgatatctctttgcttatttacagactgaaattatgagagaaagaaatgaaaagaaacataaaataatgtgttatgtgaagtataaagtatatttgtgagagatacagtaagaggctgggatgagggagagagatactgcagacagaaactggcaacatttccagggagaagaaaggaaggagacaggcagacattgtttttaatcaggccagccactcttatcatccctgctctgcaggcttacttctgtggatggcttggcctaagcagtttaggcctggaagtcattcctgtttagaaacaaaagagcggccctcagagacgtggtgataaaccaccacattttagagcttgactggattttagaatatcatctagttgaatacatctttatgggtctggaggaggttttttttttttttttttgagacagagtctggctctgtctcccaggttggagtgcagtggcccgatctcggctcacttcaacctctgcctcctgggctcaagtgattctcctgcctcagcctcccgagtggctgggactataggcgtctgccaccacgcccagctaatttttgtatttttagtagagacggggtttcaccatattagccaggttggtctcgaactcctgaccttgtgatccgcccacctcggcctcctaaagtgctgggattacaggtgtgagccaccgcgcccagctggtttttttttttttttttaatatttatttatttagagacagtgtcttggttggccaggctggaatgcagtggcatgatctctgctcactgcaacctcagcctcctgggctcaagcgatcatcccacctcagtctcctgaatagctggcaccacaggcatgcaccaccacatccggtgaatttttttttgtattttttttatagaggcggggttttgccatgctgcgcaggcttatcttgaacttctggactcaagcgattggcctgcgtttgcctcccaaagtgctgggattacaggagtgagtcaccacgcctggcttttaatttttgttttcaagggctagtctttactttcagatcttcattgcttaattaattgcttactaatgctgcttgtcatattgatacctccactcacttattcctgcctgtgttattttttggtaactttttattttgataaaatttcaaacttcagcctgggcacggtggctcacacctgcagtctcagcactttgggaggccaaggcaggtagatctcttgacgtcaggagttcaagaccagcctggccaacatggtgaaatcctgtctctattaaaaatacaaaaattagctgggcatggtggcacatgcctgtaatcccaactactcaggaggctgaggtgggacaactgcttgaacctgggagacagaggttacagtgagccaagattgtgccattgcactccaacctgggtgacagagcaagactctgtctcaaaaaaaaaaaaaaaattcaaacttcacagaaaaatgacaagaatagtatgggaactcctatatgtccttttcccagattcaccagttgtttacattttctccatttgttctgttattctctctccatatatacatatttgcatgttacatttttctgaaatatttgagaataaattggagatactatgtcttctttacctcctaagttcttcattgggtatttctaaagaataaagatattctcttaaataaccagaatacagtaataaaaatcaggaaatttaacatcgattcatcgatgttattctaattcattatccttattcaggacttaagtcctttatagtgtgtgctctgggcatgtgtgcactttctatgtgcgcgctctcgctctttctgtctctgtctctcatatatatgtgtgtgtgtatatatgtatatatatatatgttcctcctggccaggatccaatccagaataaagcattgactttagatgttatctctttttaatcttttttgatctggagcagttcctgtctttgttctccatgatcttgatattttaaaaaatagctttggccaggtgtggtggctcacacctatgatcccagcactttgggaggccgaggcaggtggatcacgaggtcaggagatcaagaccgtcctggctaacacggtgaaaccccatctctactaaaaaaaaacaaaaaattagccaggtgtggtggcgggcgcctgtagtcccagctacttgggaggctgaggcaggagaacggcatgaacccgggaggcagagcttgcagtcagccaagattgcgccaccgcgctctagcctgggcgacagagcaagactccgtctcaaaaaaaaaaaaaaaaaaaaagagcttaatgcttaatagggccgggcacggtggctcatgcctgtgatcccagcactttgggaggccgaggtgggtggatcactaggtcaggagttcaagaccagcctggccaagatggtgaaaccctgtctctactaaaaatacaaaaattaggcgggcgtgatggcgagcgcctgtaatcccagctactcgggaggctgaggcagggaattgctcgaacctgagaggtggaggttgcagtgaactgagatcatgccactgcactccagcctgggtgacagagcgagactccatctcaaaaaagaaaagtagctttattgagatataatttacaaaccataaaatccacccattgtgaaaatataattcagtaattttaaattaatttttagagttgtacagccataatctagttttcaaacctgccactcactccaaaaataccttcttgcctgtttgcagtcagttcccacctaaccacagtcaattcctcacccaactttcttattttacaaatttttccatctgactcctttcactaagcaccatgttttttgaggttcatttatattgtaatatgtatcagtttgttcctttttattggtgaataatatctattgaatattttatgtattttcatcatttaccagttgaaggatatttggattgtttctggttcctggctatcatgagtaaatgctactgtgaacatttgtgtattactttgtgtggatatatgttttcataacccttggatagataggtacctaagagtgggattgtaggttttatgataagcttgtttataactttttaagaaattgccagatggttttccaaaacaactaaaccatttacattaccatgagcaatgtgttcagggttgcaggttctccatatctttgttgatacttggtattgtcagtctttttttgtttttttttttttgagacagagtcttgccctgtcgcccaggctggagtgcagtggtgcgatctcggctcactgcaagctccacctcctgggttcacgccattctcctgcctgagcctcccgagtagctgggactacaggcacctgccatcacgcccggctaattttttgtatttttagtagagactgggtttcaccatgttagctaggatggtctcgatctcctgacctcgtgatctgcccacctcagcctcccaaagtgctgggattacaggtgtgagccaccaccatgcccagccttggtttttttttttttttgagatggagtctcactctgtggcccaggctggagtgctatggtgcagtctgggctcactgtaacctctgcctcccaggttcaagtgattgccctgcctctgcctcccgagcagctgggattacaggcatgtgccaccatggctggctaattttggtatttttagtggagacagggtttcaccatgttggccaggctggtcttgaactcctgacttcaaacgatccatctgccttggcctcccaaagtgctgggattacaggcgtgagccaccgcacccagccagtctttttttgagacagggtctcactctgttgttcaggctggagtacagtggcatgatcacagctcactgcagcctcgacctcctggggtcaagcgatcctcctgcctcaacctcccaaagtgttggaattacaggcgtgagccactgtgcctggtccagtctttttgactatagccattttagtggtgtgtaatggtatctcactgtagttctagtttgcatttctcagatgactaatcatgttgagcatctttatgtacatattagtcatttgtaaaccttctttgctgaaatgtctattcagatcttttgtccatctcgtaattgggtttttgagttgtaagagttcttcatatattctggatacaagtcctttatcatatatatgatttgtaagtattttctcccagtctgtggcttgtcttttctttcttagtggtagctttatttttatttttattttttattttttgagacagcctcaccctgtcctccaggctggagttcagtggtgtgatcttagctcactgcaacctccacttcctgggttcaagtgattctcgtgcctcagtcacccaagtagctgggattacaggtgcatgccaccacgtccagctaatttctttgtatttttagtagagatagggtttcaccatgttgcccaggctggtcttgaactcctgagctcaggtgatctgcctcccttggcctctaaaagtgctggggttacaggcgtgagccagcacactcagcctatttttattttattttttagagacagggtcttgctctgttgcctgggctagagtgcgttagtgcaatcacagctcactgcagccttgaactctgggctcaagcaatcctcctgccttagcctacggagtagctaggactataggcacacactagtacacccagctaatttttgaaaaatttcttttgtgtgtagagatggggtcttactacattgcccagcctggtcttgaactcctggtctcaagcgatctgcctcggcatcccgaagtgcagggattacaagccactgccccaagcctgtggtggctttttttttgagctagggtctcactctgtcacccaggctgaagtgtagtggtgtaatcatggctcactgcagcctggacttcccggggtcaggcagtcctcctgcctcatcctcctgagtagctgagaccacaggcacatgctaccacatctggcaattttttttcattatttgtagaggtgagggtcccactatgttgcccaggctgttctcaaacttctggacttaaactgtcctcctacctcggcttcctagagtgctggtgttactggcatgagccgatgtgcccagcctctggtggcttttgaggtggagaagtttttaattttgaagtccagtttatcaagttttcttttgtgggtcatgcttctattgtcatatgtaaaaacttgtaatacaaagtcatgaagattttgttttcttcatggagttttttttgtaggtttggctctttttttttttttttttttgagatggagtttcactcttgtcgcccaggatggagtgcaatggcgctatctcagggattatgggtgcctgccaccaaacctggctagtgtgtgtgtgtgtgcgtgtgtgtgtgtgtgtgtgtagatatatatatatatatatatatatatatatatatgtatatatatatatatatatctacatacacaagtacatataagagagcccagccagctttcttatagtaggtctgtgatccattttgagttaatttttgtatatggtgtgacagaagagtctaacatcactcttgtctcccaccattaattgacataactattctttccccattgaattgtcttgacacattgataaaaatatcagttgatcataaatgtaagggtttgtttctgaactctcagttcttccattgttctatgtctgtccttaaaatagaaccacactgtcttgattactgtagtttataggagttttgaagttgtgtaaaatcctccaacttggtttttttttttttttttagatgtagtctcgctttgtagcccaggctggagcacagtggcatgatctcagctcactgcaacctccacctcctgggttcaagcgattctcctgcctcagcctcccgagtagctgggattacagtcacgtgccagcacacctagctaatttttgtatttttagtggagatagggtttcaccatgttagtcaggctggtcttgaacacctgatctcaggtgatccacccgcctcggcctctgaaaatgctgggattacaagcgtgagccaccgcacccagcccgatcagctcttaactctacaaaaatgcctgctgagatttgataggaactgcattgagtctgtagatgaatttggtgagaatttacatcctaacatattgagtcttccactccacgtagatggaatgtttctctgtttatgtagctctatactttgtctcagcaatattttgtaatttgcagcatacctgtcttgcacttcttttgttaaacttatacctaaaatatttcactctggccaggtgcagtggctcacgcctgtaatcctagcacttggggaggccaaggcagggggatcacctgaggtcacaagttcgagactagcctggctaacatagtgaaaccctgtctctactaaaaatacaaaaattagccaggtgttgtggtgcatgcctgtaatcccagctactcagaaggctgaggcaggagaatcgcttgaatccaggaggcggaggttgcagactccagcctgggtgacagagcaagactccgtctcaaaacaaaacaaaatattttactctttgtgatgctatttagaatggaattatcttgttaatttcctatttggattctttgcaaatgtatagagatacaattgattttcatatgttgatcttgtatactgctttgctgaggttgtgtattagcttgaatagggggtgtgtgtgtatgtgtgtatttctttggattttctatatacacaatcatgtcttctgcaaatagaggcagttttacttattcctttctaatctggatgccttttatttctttttcttgctaattgctctgcttagaacctgtagtacagtgttaagtagaagtggtaagagtggacatccttggccgggtgcggtggctcacgcctgtgatcccagcactttgggaggccgaggtgggcatatcacgaggtcaggagatagagaccatcctggctaacacggtgaaaccctgtctttactaaaaatacaaaaaaattagccgggtgtggtggcgggtgcctgtagtcccagctactcgggaggctgaggcaggagaatgccgtgaacccgggaggcggagcctgtagtgagccgagatcgtgctactgcactccagcctgggtgacagagtgagactctgtctcaaaaaaaaaaaaaaaaaaaaaataagagtggacatccttgtcttgttcctaatcttaaggagaaagcattcattcttcaccattaagcatgatgttaactggtgtgtgttttttttttttttttggacattctcttgaaggttgaggaagttcctttctacttctaattttttgagtgtttttatcatgaagggtatttaatattgtcaaatgcttttttctgcatctgtgagataatcatgtgttttttgttctttattctaatgatatggtatgtaacattactggtttttagaatgttaaaccaaccttgtatttctgtgataaatcctacttggtcatggtatatcatccttttttggaaggtgctgggctctgccagtatttccttgagtacttttgaatcaatattagtaagaaacattgacctacagttaccttgtgattttttcttttggttttggtattacagtaattctcacctcatagaatgagttggaagggttgcctctgtgaggtaggttccctatgcactggttatgaacttttctgatttcagtaagacagaacactcacacaagttacatgaagtgcccggccacatctgttgttttttgacatttttttttttcccgctgtaggcagagtcttgctctgtttctcaggctggagtacaatggcgcgatctcggctcactgcagtctccaccttgtgggttaaagcagttctcctgtctcagcctcccgagtagctgggactacaggcacacgccactacacccatctaatttttgtatttgtagtagagacagggtttcaccatattggtcaggctggtctcaaactcctggcctcaggtgatccacctgccttggcctcccaaattactgggattacaggcatgagcccctgcgcccggctgttttttgactttttaattatggccgtttttgtaggagtaaggtggtatctcattgtggttttcatttgcattttcctgatagtgatgtgagcattttgtttcatgtttgttggccatttgtatatcttcttttgagaaatgtctattcatgtcctttgcctactttttgatgggattattttttcttgctgatttgagttccttgtagattctgcatactggtcctttgtcaggtgcatagtttgcaaatattttctccagctctgtgagttggctctttgctgattacttcttttgctgtgcagaagctttttagtttaattaggtcccatttatttttgtttttgttgcattagcttttggggtcttagtcatggattttttgcctgggccagtgttcagaagagtttttccaatgttgcagaatttttatggtttcaggtcttagatttaagtcttggaagtctggtaatgtgatgccttcagatttgttctttttgcttagtattgctttggctatctggactcttttttggttccatataaattttaggattgtattttctagttctgtgaaaaatgatgatggtaatggtagtgttttgatgggaattgcattgaatctgtagattgctttgggccatatgatcgttttcacaatattgattcttacctccatgagcatgagatgtgttttcatttgtttgtgtcatgtatagtttctttcagcagcgttttgtagtttcacttgtagagatcttcacctccttggttaggtatattcctaggtattttattttattttttgcagctgttgtaaaaggaattgagttcttgatttgattgtcactttggttattgttggtgtatagcagagctatttatttgtctatattaattttgtaacctaagactttactgaattcctttatcagatctaggagtcttttggatgagtcgctagagttttccaagtatatatgatcatatcactgataaacagtacttgtttgacttcctcttttccaatttggatgccctttatttctttctcttgcccaattgctctggataggacttccagtactatgttgaatagaagtggtgaaagtgggcatccttgtcttgttccagttttcagggggaatgctttcaacttttccccattcattacgatgttggctgtgggtttatcatatattgcttttactattttgaagtatatccctcctatgcctagtttgagagttttttgtcataaagagatgctggattttattgcatgctttttctgcatgcaattgagatgatcatatggtttttgttttaaattctgtttacgggatttatcacatttattgacttgcatatgttaaaccatccctgcatctctgggatgaaactcacttgatcatgttgtattatctttttgatgtgctgtgggatttggttagctagtattttgttgaggatttttgcatccatgtttatcagagacactggtctgtagttttctttttttaatgtcatttcctggctttggtattagggtgatactggcttcatagaatgatttaggaaggattccctctttctcaatcttttggaatagtttcagtaggattggtaccaattctttgaatatctagtggaattcaactgtgatccatctggtcctgggcttttttgttgttggcagtttaaaattactgattcagtctcactgcttgtttttggtctgttcagggtttctgtttcttcctgatttagaggattgtatgtttccacgagtttatccatttcctctagatttttcagtttgtgtgtgtaaagatgttcatgttagtcttgagtgatcttttgtatttctatgatattggttataatatttccagtttcatttttcattgagcttatttggatctattctcttcttggttagtctaatggtcgaccaattttgtttattttttcaaggaaccaagtttttgttttattttttgcttcaatttcctttagttctgctctgatctttgttatttcttctgctggcattgggtttagttcgtacctgtttctctggttcattgaggtgagacagtagattgtcagtttgtgttctttcagactttttgatgtatgtacttaaaactatgaactttcctcttagcactacttttgctgtatccccagaggtttttataactgtgtcactactatcattcatttcaaatttttaaatttttatcttgatttattgttaacccagaaattattcaggagcagattatttaatttccatgtatttgtatagttttgagcatttcttttggagttgtttctagttttgttccactgtagtctgagaagatacttgatatgatttcaattttcttaaatttgttgagacttgttttgtggcctgtcatacagtctatcttggagaatgttccatgtgttgaggagaagaatgtatattctgcagttgtttggtagaatgttctgtaaatatctgttaagtccatttgttctagggtatactttaagtccattgcttctttgttgagtttctgtctcaacaaaaagagtctagtgctgtcagtggagtatcgaggtcccccatttcactttgttgctatttcatttcctaggtctagtagtaattgttttataaatctgggagctccagtattaggtgaatatgaattcaggattataatatctttttgttggattgttccttttattatataatgaccttctttttctttctttttttttttcttttttcttttttttttttttttttttttactgttgttgctttaaaggtctattttgtctgatataagaatagctactttgcgaggccaagacgggcggatcgcgaggtcaggagatcgagaccatcctggctaacacggtgaaaccctgtctctactgaaaatacaaaaaattagccgggcgtggtggcgggtgcctgtagtcccagctacttgtgaggctgaggcaggagaatggcgtgaacccaggaggcggagtttgcagtgagccgaggttgcaccactgcactccagtctgggtgacagagggagactctgtctcaaaaaaaaaaaaaaaaaaaaaaaaagaatagctcattctgcttgcttttggttcccatttgcatgggatatctctttccccccctttaccttgaggttatatgaatccttatgtgttagatgactctcttgaagacagcagatatttggtttgtgattttttaaaaatccattctgccattctgtatctaagtggatcatttaggccatttacgttcaacattaatattgagatgtgagatactgatctgtttatcattttagttgttacttactttgtttttttttcattgtgttattgttttataggccttgtgggttttatctttcaagaggttttattttggtgcatattgagcttttgtttcaagatgtagaactcttctgaagagtaatgctggtttggtagtggcagattccctcggcatttgtttatctgaaaatggctttatctctccttcatttaggaaacttagttttgctggatgcaaaattcttgggtggcagttattctgtttaaggaggctaaagatagaaccccaatcccttctagcttgtaaggtttctgctgagaaatctgctgttagtctgattggttttcctttataggttacctgatgcttttgtctcatagctcttaggattctttccttcatgttgactttagatagcccgatgactatgtgccttggtgataatctttttgcaatgaatttcccaggagttctttgagcttcttgcatttggatattgaaatctcaggcaaggccagggaagttttcctcaatgattctctcaaataagttttctaaacttttagccttctcttctccctcaggaccaccaagtatttttaggtttggttgttttacataatcccatatttcttggaagctttgttcatttcttctttctttttttttttttctttcttgagatagggtcttactctgttgcccaggctgtagtacagtgttgtgacctttgtctcctgggctcaggcaatcctcacacctctgcctcctgagtatctgggactacaggcacatgccaccactcccggctaatttttatgttttttttgtagagatggaaatttgctatgttgctcaggctggtctcaaagtctgggctcaagcagtccacctgccttgccctcccaaagtgctaggattataggcatgagacactgaccccagcctatttatttcttttgattcttttttctttatttttgtctgattgggttaatttgaaagccttgtcttggagctctgaaattcattctttgacttgttctggtctattgttgaaactttccattgcattttgtatttccctaagtgtgtttcatttccggaaattctgattgttttttctttatgatatctatgtagaaaatttttccttcatattctgaattgttttttaagttttttttttatgttggttttcacctttctatggtgtctccttgagtagcttaataatcaacctactgaattatttatctgattatttcaaatatttcgttttagtttggatccattgctggggagctagtgtgatctttcgggggtatgatagaaccctgttttgtcttataccaaaattacttttctggttctttctcgtttgtgtagagtatttcttctaattgttcttgaatttatttttgatttggctgtggtttttttaagtttctttttcctcttcactaaggatgtgactttagtgtttatagtttattatagcctaatgtgattcttaatgcttttagggggaagactgtatgagttccttggctatagagagtctttgtatgatggcttctttagatgctggttgtatttatttatttatttatttatttttgttgagatggcgtctcgctctgtcactcaggctggagtgcagtggcacaatcttggctcactgcaacctccacttcccgggttcaagtgattctcctgcctcagcttcccgagtagctgggactacaggtgtgcaccactacgcctggctaatttttgtatttttagtagagacggggtttcaggatgttggccaggctggtcacaaactcctgacctcaggtgatccacctgccttggcctcccaaagtgttgggattacaggcgtgagccactgcccctggcctgtatttaatagatatgtacttgatgtgtgggcaagttcactgtctcctatggggttgagatggaaaggtctcttgaagctcatctcattcccctgtggtgtgtgcttttttatttatttaatttttcccctgtattttatttactaagttgatggttaaggcttcaggccagtaggggagctgtccctgggtaggaaccagttgtggctaaagcaaatgggtaaatgcaatactcagtaaggcagagaggttccacccttgatgaaagtggctgggggaactctcaattagatgcactgaggtcttatcaaggggaagggtgggagccacctcagctcctttgccaggccagtaggaaagctattcacctcccagactcgctcctgccctagtgttccagctattcggatcagacaggcatctcttttcatctgtaggactgttgttgttccacacagagaggaatttgtgactctgcctctcttgcaagcctgaacttgggccagggcgggggtgggggttgggggattcctcctgtggagatgcagtcactctgtagtgttccaggaaggctgtctataggttcacctttgccaagctcctgtggagaagccccaactgtgtctgtgtagtggtggacaaggtgggagagaagataccttctccaggacccttcatgagcagcaaagctgcctgattgttggggtagagctgcagactttcccttctgagcccagcactgcaattgtgtctctgctgaaaggaacttcccatcagtggaaagatctggaactcaaggcctgccatctgaattcttttgtcccatggggtattcccttggtgtggtggtctcctccttcccttaggagtaagaattcctgagagccaggataagttgattgctattcttctgggtctagccacccagtggggctgcccaactccaggctggtgctggggaatgtctgcaagggatccggtaatgggacctgtcctcaagtctcccagcaagggatataccaacactagtgctgatgggagtgtcaggtgagtgaggtagactctttgaggttccttggttacagaaagccttagtgtgctggctttctcgaatgctggttataatagtagtgaactggtcacgtggacagatgcaggacctcctggttagccagggttttgcaggcaatgatgatagcttaggtcatgcactggttttctcctttctgttcacagtgttattctacctagagatgctgtagtggactgtgttggttggcatccagcctggaggtagcgtttacaaaagggcaccagctgcagtagtagcagtgggattcgagcttgtcctgtgttgcccaggaggtattctggtttctcaggtgacaacggggtccataaagctgccaaaagtttctgtcctttgtattaagtaaccagggtgggtggaggggtacagccaggtgggggctgggtcaggtgggtctacactctgtctctccatgtgtggggaaagccgtggctcctatgagggttgggggggcggttctcaggtcattagggtaatgttccagagaggaatataactgcctctactgcacagaagagatcgcacagtgtgtggggagtaacaggtggcactaagcctcacccagatcccacacggtcggaaaggcagatctcactccctctgtgctctgctagctgcactgggctaagttccaggcagcctaggctcagaactcaaacctgccccaggccataagctttccctgtgggaaagcagctgtggctttcaggccatgctcctcccaggccacctgcagggccaggcacctggctcctgcacttgtggctgcagtgcacttccccctgcccctgggaggtatgggttctggacaaaggagttcatcctcactcagtgttatatcttgaaatggggagattctttcaacctgcgaccactacctgagcttgttggctgacttccccaaggtcccctgtgaggtacaataaagaatggcttaccttggtctgcactggagactgggaatgcctgcaaagcacttcccgccactgtttctacttttatatttcttactgctccctaaatcagtcccagccctgggtaaggttaaggccttcccccatggcctggattttcaggttccccagtgggaacctgaaagcagcttctctctatctcacactctggagacttacagtttttcccttgtcttatggtttaggctgcagactgccacttctttaaaaggtctgtggattctttcagttttcctgttaagttcctgcgtggcttcttggaaaaagagtcaccatgtgattctcaatacactattctgttcttctaagtgggagaggcatgctaacactgcttcttatctgccatcttggtgggggtggaaaaaccaaaacctctcaaagtattttctaacttctcttgtagattcttcttttgcctattgcttatttagaagtgttttgattaatttttacgtgtttgtgaatttttcagttttcctattgttattgaattatagttttattccattgtgatcagaaaagatgttttttatgattccaatcattttaaatttaagatttgttttgtggattaatgtatggtctctcctggagaatgttgcatatgcacttgacaagaatatatactctgttgttgggtggagtgttctctataggtcttttatatgtattagttcatagtgttgttcaagtgtactgttaacttaccgatcttctgtctagttgttctgtctgttattagaagtgaggtgttaagtctgcaactattattgtgcacctatttctccccacaattctgttaacttttgctttgtgtattttagggctcttgttgcttcatagattttggggctctgttaggtgtgtatatttttttaactggtatattttctagatgtgaaccttttatcaatatgtctctctagtaagtttttgatttaaagtctctttagtctgatagtaatatagccacctagggtctattttggttaccctttgcatggaatatttttttccatcctttagtttacctcttcatgtctttgtatctaaagtgaagctcctgtaaatagcatacagatagattctgtctgtatgcaatctgtcaatccctgtcttttaatagaagagtttaatccatttatacttagcatgattgctgaaaaagaaggatttacttctgccatttagttatttctgtatgtgttttggttttttatgcctcagttcctccattatggccttggggtggtgatatttagttgagttgtttgcctttttgattcacttctttcattttaatcatattttaaagtttgttttcttagtggttaccttggggattataattaatatcttgaactagttggaagaataccaggttagctttagtagtacatagacatactgcttctgtaactctccatccttccttttttatgttgttattgtcatagattatatctttatacatgttatactcattaacaacagatttattgtttcatgcatttgcattttatttttatttatttatttatttattttttgagacggagtttcgctctgtcgcccaggctggagtgcagtggcgtgatctcgactcactgcaagctccgcctcccaggttcacgccattctcctgcctcagcctcccgtgtagctgggactacaggcgcgcaccaccatgcctggctaatttttgtatttttagtagagacggggtttcaccgtgttagccaggatggtctcgatctcctgacctcgtgatctgcccgtctcggcctcccaaagtgctgggattacaggcgtgagccaccgcgcccggcctttttatttatttttgtaaattttattttttgtgcagactcctctgctggggccgcaactgctgagaggagcagcacatttgccttttaaatcacataggaaaaagacattacaaaccaaagtacaacactacttttatatttacctaggaagttacatttattagtgttctttattttttctcatgacctcatgttactgtctaatatccttttgtttcagactaaaggactccctgtagaatttcttgtatggcgtgtctattgcaaatgaatgctctcagcttttgttgacttggaaatgtcttaattttcccttctttcttgaaggatagttttgctggatataaagttattggttgaccagttattttgtttcaatacttctttttttctttttgagacagagttttgctctgttgcccaggatggagtgcagtggtgcgatcttggcgcacagcaactctgcctgccaggctcaaatgattctccctcctcagcctcctgagtagctggggccataggcatgcaccaccatgcctagctaatttttgtatattttgtaaaggcagggtttcaccatgttgcccaggtgggtctcaaactcgtagactcaagcagttcacctgccttggtctcccaaagagctgcaattacaggcatgagccattgtgcccagccttctttcaatattttgtttttatttttattttagacacagggtcttgctgtgtcacgcagaatagagtgcagtggcatgatcatggctcattgcagcattgaccttataggatcaagcagtcttcctaccttggccttctgagtagctagtagaacaccactatgcccgaccaaccaaaaaaactttctgtagagatcagggctcactatatcgtccaggctggtctcaaactcttggcctcaagtggtcctcctgcctcattctcccaaagtgctgggattacaggtgtgagccagcgcacctgacttttcagtactttaaatatgtcccactgccttccggcctccatggttaatcttgctgaggatcagttgcatgggatcagttgcttctatcttgctgctttcaagtttctcttattgtgttttgacagtttgactataatatgtctccgtgtagatctctttgagttcatactgcttggagtttgttgagcttcttgggtatgtatacttatgtctttcatcaaatgtgggaagttttcagtcattatttcttcaaatctttgaccctttctttctgttcttctgagattcctataatgtgtatattggtatgtttggtttcccacaggtccctcaggctctattaatttctccttttcttttttctggttccttatactagattattttgttttgtattccagtttcctgatccttttttctgcttgcttaagtctgctgttgaacccctgaaatgaatttttcatttcagttattgtcaactccaggctttctgcttggttccttttcataatttctgtctctttgtggtgttctcattttgttcagacattgatttcctgatttcctgtagttttttccccccacagctttctttagctcattgaacatatttaagacagttcatgtgccatctttgactattaagtccaatatctgggtttcttcagagatgatttttgttaaattatttttttcttgtgaatgggccatacttgcttatttctttgtatgatttgtgatttttgttgaggatgagaaattctgaatattatgtttggaagtttggaagtctagttctcctacttttcaggaatagccgatttttgcttgtcaactgctgggtccatctgtttgaacttttgcaagctgtttttgcaaagagtatgttccttttttaatatggacattgaaattttagttctcttatcactgtgtttaaccagcaatctgacagtaatttccttaaatgtctgtctcccagaagtgtggaggggtgtggaacaaactacctttttaaatcccttgtggctgggaagctgcttgagccaatcagggttgaaacaatgccagcctctatgcttagcccctcagccatcaaaagcagtggtcagtaatcagaacatacaaccttgatttttcaaggttgaaaaaccaagatgcaaaggttctaatttcccaatctggcaccaactagctacactaggaacatcctcgtggctacctgccatgggttgttggctgggggattatagcagccatgttattaataaatgtgaagtttactgaaatttacttgctgttttatcaaattctcctctgggccctgaagtgtttgagtagactccagagttcaaaaatagttgctttagacagctgaatagttgttttgatctcagatattcttggagcttcctgttctctcttctgtgatgtcactcagtttttttatggtaagcatatagttttagtgtaccattttaatttctagtgttttttagctgtattttttgagttatttttagtagttgctctaagggttactatatatctcttaatttatcacagtctgcttcaaattaatactgacttaattctggtaagacaggaactttgctccaatgtagctccattttctcccccttcatttgtgcttttattgttatgtaatactcaaaacagtgttaattattgctttatacagtcttgtttttcaaagtattaagaaaagagaactatacttatgcagtgtttataatcacatatttatcattttcagcactcttaattggttcttgtggatttgaattatagtctggtgttattttctttcatccagtaggacattttgagctggtatgggcaatggtggcagccttggttaagaatgccacaggctttcactgttcttatctcaagtttagtagtttttcatgaataaacacttctcaatttgttacatttggctcatttttagaaccccaaaatactcgtttttgacaatgctgtccagttgtttttggggagagaattttctgaactcttcactctgccacagctggaagtctcccctactaccttgatatctttgcagaaagcatagattacattttgcactgtccttagctgtgtatagattgggcttagagccaaggcaggctgaaaagtgaacctacttttcctaagctgatgggacttaggagaaggaaagaatttggaagtagggcaaagaataattgggccttttatcatcttgcctgggtcttttgagcccccacatcctatctttcctgaggcttagtccttcacaacacagtgtccttatggaggctttctggctccttctaccgccttctctcctgcattccttgtctggggatgggcagagtagacactgggtactcagtgtcaagaagcacctgcttgtacccttgcgtgccttctgtggagggtgtggagggactcaaaatagaggtcagggtgccaagataagtgttggctctgcaaactctgcatgaggttttcagtcttctttcaggcagctttgcacagatggggggctttgcatttggagctgtggtgaggatggtgggatacactctgtacctcatgcccttagtgaaggttttagggaactgctgcccaggaggggaggggagagaaaatacttgcctcagaaagtaatatgctgaccatcctaccagttacggggagaaaatgcacatataattcttaaagaacttcactgattaggtctgttgcctcctgtatagaatttctgtgggaaaaaagccaaatgttatcttattgttgtctttatctttccacagataatgcctcaaacatctctgtaaccagatgcttttgcttttctgttttggcagaggaatgttacggcatccggagtcatccctcagatttctctgatcatgggcccatgtgctggtggggccgtctactccccagccctaacagacttcacgttcatggtaaaggtaagaaagaagggcctgtttttggtgccgtttgagatttgtgcagttccttacctgcaataaaaataattcctgacccagatctaggttgttacctgcattctcattggctttcagcatagtgatgataaggtgttaatggagagagggttttggcatgaaatctgtagcttgtgggggttcagtggcaggggatgcttatgtacttcattggtgggtgattttacttgttgatctgaattgcaaatgattttcaggtaatcaaagaatcctgtcctttgaccagatagatgactgtttactgagtcctattcaagaagtttctcatggaaggcttttctgtaatctgtttattgggaagttgtttcttcctttatttcttcagctccttgccattttattacattgtgtccataatggtaaaggataaatctgatctcacacttcattttcagaggtacatatctttattacatgactttaatggacttatattttaaaaatatttttaaatgaagtctatttgaagttatacatgagtaattaccattcatctcaaaccttgctttaaaaaaatcagccttttcttcttaaaatattaataaaaatgaacattggatgccaagacagaatggttggggggaaaaagtagtgatagccatccaacttgaggagaggagttctagagggagtgtaaatgggaaaccctttgttctcaagggaagttaggcagtaggaattcaaaagtttcacaaagtgcttaccactttgacccaactattctgttcttagtgatataccgaaagtagtgtaagtgttcaacaataagagtgtcttttattaatcaaatttaagatgggccatacacagtgtctcacgcctgtaatcccagcacttgggaggctgattcaggtggatcacttgagctcaggagttttagaccagcctaggcaacgtagcgaaaccccatctctacaaaaaaatacaaaaattagctgggcgtggtggtgcatacctgtggtcccagctacttgggaggctgaggtgggaggatcactcgagcccagaaggtcaaggcagcagtgagccaagatcgtgccactgcactctagctctgggtgacagaggaagaccctgcctcaaaaaaaaaaaaaaaaaaaaggtaagatgaccacttctcttacttggtggacaatgcagaattttctgaactttgcttactaagtctatatatacacacctagctggtgctacccccattctctcctccttcctgcctgttacgaagggaggtgtgggatcaattcctctggctagagccatcctttcctcctgctacacacatccacattgctgaatataactctccacccttcttcaggacccttatactgttccttttctcctttctctttagtatcttcagtctgtccgttggtactagatcctcccatcaaaacttaatcacactcaggtctttcctatcatcaaaacaaaaactgtcctctagttggcatactcctgtagctcttgctgtgtttctctcttgccatcccattctttaacacgtgttaatttagctttgtcccctagaccactaaatcgttttttttttttaaggtcctcagtgacttgcatcactgtaaatgcagtttaactctcattttcctgtctttcaacagtattcccttggcttccattataccatactctggcatttcttctcacaactctgaccataccttcctggtttccattggcaatttacatgattccattcagactctagatgctggagttcatttcaactgctttctcttttaattctgtgttttattctaagcaatctcattttctgcttacaaaactttagttaataattgcatattagtgagacttcctctcttgtcctcagcaccattcttaagctgtcaccattctacatcttaaatattctgtgtatttaataagagtgcagtggaaaatactaagtcttttttaaaggactacacaaggtaattataaagttcttatgggaggaagaaacaccatgcaagaataaacattctatgaaagtagtgtaatgaggagttagccctaccaggtgccaggatataaaactacaataactaaaactgtctgaagaacttgtaggtaaatggacagaaagaccaagggacattacagaattgatacatagatctatatctatttggacattatgatgaaaaggatattattctaagcagagtcactgataataacaatttcttatgtcagagataccagtgattgctgcatcactaaatccagttgacatttctcaccctttgtcttacctgttgacaacatttgctctagctgatcactccagtctcatgactttaaatactgatccgtatgctgacaactctgaaatctgttcctccaggattatatttttaagagcctaccagaatttccatttggactttaatgggtatctcaaacttaacaggttttgatttctaccaagcttctcctgcattgctctcctgcagccttcgccattttaaatggcaggtctagtcttccagtggctcaggtaaaagctttgacactgccttgactcgtcttttgctatcacatcccaaatttagtcagaaggtcctgttggctttactttagaatataatccacaatataatcaaattgcttcttagcacgactacttacttcttactaacaaaactgctaccactttgattcaagcacatcatttcccacctgattattacagaatcctcctgactggtctccctgcttctgaacctgggagctgaaggttgcagtgagcgctttgggaggctgaggcgggtggatcacttgaggctagtagtttgagaccagcatggccaacatgatgaaaccctgtctctactaaaaatacaaaaattagccaagcgtggtggtacgtgcttgtaataccagctactcgggaggctgaggcaggagaatcgcttcaacctgagaggcggaggttgcagtgaaccaagatcgcgccactgcactccagcctgggtggcagagcaagactctgtctcggaaaaaaaaaaaaaaataataaaaataacccaggtcaggaaatagctcttcaagagccctgtcatcatgatcctttctaaggatcattgtagcctccatcctgcttagaatttgttattaataataattctttattgtctcagcttttatggtagtgtttttatttgctttgcttcatagttgaaaataaaaattgcctccctaaacaatgtggattagcgtttcctgttttgacctttacgttaagtgaaaccatataatatgctttcttgtgtgcatggcttctggctcattatgttgttaagatttatctatgttgttctttgaaaatgtagttcattcactttaatagctgtgtagtaagtgtgtgtgtgtgttttttcttttgtgtgtgtttggtgttttttgttttttttttgagacagagttttgctctgtcacccaggctggagtgcagtgacatggatctcacctcactggaacctttgcctcctcggtttaagtgattctcacacctcagcctcccatgtagctgggactacaggcgtgtgccaccacacacccggctaattttttgtatttttggtagagatggattttgctgtgttggccagggtggtctccaaactcttggcctcaagtaatctgccggcctcagcctcctaaagtgctgggagtataggcatgagccactgcgcccagttatagtaaatatttcttaacatattcattcattccactgcagatggacatttgaattatttcaagatttttgccattgcaaatgatgctgatgtaaacatttttctatatgtgtcttggtgcgcacattttattttctggtgctgatgtaaacatttcacattagaggcaatcttaggtcataggatatatatgtcttcagcttctctaggtaatgcccgtctgtttactaaacaggttgcagccagcaatttgagaatttcacttgtttcacatccttgccagcacttacattaacatagtttaattgtgccagtttgatgcttgtggtatagtctcttattgtgttgtcaatttgcattgactcaatttgcattagtccatgactgataaagctgagtgcctttttgtatgattcctgttcttctaaattaaggtatgtttatgactcagaatgtagtctatcttggtgaatgttccatgggagcttgagaagaaagcgtattttgttgttagatgaagtatgtccatcatatcctgtttattgatactgtttttcttttaattttaaaaatgatttctatttattttacttcttaaaatgttttttattatttttttttattttttgagacggagtctccccctctcacccaggctggagtgcagtggtgtgatctcagctcactgcaaccttcggctcccaggttcaagtgatcctcctgcctcagcctcctgtgtagctgggactacaggcacacactgccatgcctgcctaattttttttttttattttggtagagaactggtctcactgtgttgcttagactggtcttgaactcctgggctcaagcaatcgtcctccctcccaaagtgctgggattacgggtataagccacagcacctggtctataaaaatgtttagagacagggtctcactctgttgcccaggctggagtgcagtggtatgatcatagcttaccacagcctcgacctgctgggctcaagtgatcctcctgtgtagctgggattacaggcacatgccaacacacctggctaattttttatttattttatttatttttttgagacaaggtcttgctgtgtcgcccatgctgaagagcagtggtgcgatctcggctcactgcatccttgacctcctggggtcaagcaatcctctcaccttagcctcctgagtagctgggactataggtgtgtgccaccatgcctggccaatttttttatttttgtagagacagggtttcaccatgttggccaggctaatttttatttattttaatttttgtagagatggggtcttgccatattgtcataggctggtcttaacccctggcctcaagtaatcctctcacctagggcccttgagttgctgggattataggcatgagacactgtgcccagctgattggtgttactgagttcatctatgtctttactgtttctgcctgctggatctgtccacttttgatagaggagtgttaagatcttcaactgtaatcatggattcatctatttctccttccagtgctatcagtatttgcctcatgttattttgatgctctgttgttaggtgcatacacatgaaggactgtttgtctccttggagaattgacccctttatcattatgcagaattcctctgtataataactttccttggtctgaagccttttctttctgaaattaatatagctactcctgatttcttttgattagtcttagcatgtaattaatatctttctgcattcatttacttttaatctttatgtctatttcaagtgggttttttgtagacatcccttatagttgtgtcttgtttcttgatctagtctgacaatccgtcttttaattgatacatttagaccattgacattcagagagattgttggtatagttggattagtatctaccatatttgttactgttttctttttgttgtatttgttcttatttttgtcttccacttttctgccttttgtgattttaattgagcattctatatgattccatttttctcctttattaacatgttatactttttttttaccttcttcagtggttgccttagaggttgcaatataatttacagctattttaagttaatttcagataacacttttctgcttcccaggttgtatgagtaccttataatagcaaaatcattctaattccttcctcctatccctcatatgatatatataaaatatgtgtacataattgcacttggtcttagccaaaaggctgagaagcgatgtgcacataattcaattgtacataattgaatgtgtacataattgaatttttgctactattaatttgaatcaaaagttttcattttaccttcatttattccttcttgaatgctctttctttctttatgtagatataagtttctgatctttatcatttaccttttctgtaaagaattttgcttaacattttttgcaaggcaggtctactggcaggagattacctcaagttttgtttgtttgagaaggtctgtatttttccttcacttttgaagaataattttgcagagcacagaattctaggttggtaggatctttcccctcaacactttaaatatttcattccactctcttcgttcttgcatggtttctaagaaaaatttggatataattattatttttggtcctctataggcaaaatgtttttttcttgtggctgcctttaggatattttctttataattgattttctgtagtttggaaataatgtcctaagtgtagttttttgtttttgtttgtttgtttgtcttttgtttttttagagatgggggtctccctgtgtttcccaggctggttcaaactcctgggctcacatggtcttcctgcctcagcctcatgagtggctgggacaacaggtgtgcaccactacacctagctttctctgtgtagtttttttttttttttttgtcattcatcttgcttgatggtctctgagtttattggatctgtggtttggtgtctgacaatttggggaacttttctgtcattattgcttcctatattctgttcttttttctctttctgctccttctggaattctcattatgtatatgttacatcgtttgtaatttgtgccacagtttttagatactccagttttgttttgttttttttgatccatttttttctcttcgcttttcaatttgagtggtttctcttgagatatcctcaagctcagagattctttcctcaagcatgcccagtctaccaaaaaacatcaaatgcattctttatttctgttgcagtgtttccaatccctggtatattttagttatttttttagaatttccatttctctgcttacattgctcatctgcttgctgtctactctatccatgagagcccttaaaccattttgtttgtttttgttttttgagatggagtcttgctgtcttggccaggctagtgttgaacgcctgggctcaagtgatcctcccacctcagcctcctgagtacccaagactacagacacatgccattacacctggcaaacatcttaattgtagttgtttcaaatttctggtctgataattccaacatttctgctacatctgattccagttctgatgcttattctctcttcaaactttgttttttgtcttttagtgtgtcttatgacttattcctgatagctggacatgatacactaggtaaaaggaactattgtaaataggcccttagtaatgataaggagctggggaagaggaagtgttctgtagtcttatgagtaggtgtcagtcttttagtgagcctgtgcctctgaactatgaatgtcatgtgtctcagtctctcgtacttttttggtgggacggtggctagagcgggttggggctggccatttcccctcttccacatggaaagcaagagctggcttgagtttggtatttttcttccctcgcgtcagcagtttctgataaaacttcagcaggttaggctcttatcatatagttttgcctgagagaagaccctgttaagaatgatgctctcgtgcgtttcagaagggtctttttttcccccatgcatgtcagaagcatgagggagttttctctgattatcactgtgagaaccttgttgagttcctagaggtaaaactcacaaaagtgtgggagcccccaatgattggccggccctggagtcttgatctctccgacttgtccatgctgggcctccagcaatttgtcagctatagttccggttttcctacatcagccctggctctggaggagatttgtgcttgtgggtttctgccctgcaaggctcaattttctgcatttgccagttggtctccagttttggggtgctttgttctgcaaagacctcacctctttgatggacctaagaaaaactgttggtttttcccctgcaactttttcagctttttatttgttaagaaggagtatcaacttttagcttcttatgtgctggactagaaacctgaaattttgtgtctctagttttttttttttttaacagtttcaaataaggctgctataaacatttgtttagaagtctgtgtgaagtggggaagacctttgtagctagacctttctagcaagatttcaaaccaagaagccataagataaaagactgatataatgcatatgatagactaaggactaatttccttagtacataaaaaagccaatgatgtattagaaatgggcaaagaacatgaatagtgagttcagagagcactgtagtaatatttattgcagaattgcttattatactaaagttttggaaacaaccttcatgaccatcaattggtgaaagttatgatacaaatcctactatactgatatggaatagaatgatcttcaagctagaaaaacaaatttgagaacagtgtgtattgaactctatgtgtattgaacacagtgtgtattgaacactatgtgtattgaaagaatgtgttgggaagaaaatgtttgcattagaaagtgtttgtgttagataatgtttgtgttagaagataagagggcaaagagggcaaatatatatataaatgcacatggatgcatgggtgtctctgtagagagaagaaactgacagggtatgccttaggggaggcgaattggaggcctggaagtaagggctgggctgtagactttccactgtatctcctgttcctctgtttaaattttatgcagtatacttatattatctatatattagaaactaaaaattaaaagcctatcactctttaatagcaaagcattgatttattagtttttttgtttttgtttttgagacaggtttttactctgtcacccaggctggagtgcagtggtgcaagcaatcatagctcactgcaactcaagtgattgtcccgcctcactctcctgaatagctaggactacaggcacatgccaccaggcctacctaattgaaacaaatttttatggagactgggtctcgctatgttggccaggctggtcttgaactcctggcctgaagtgatcctcctgccttggctttccaaagtgttgggattacagatgtgagccactgtaacccactgatttatcaatatttttaagtagcttcatttaaagtgactggttgcatacagtctccatatctcagtttcctcatatgtaaatgagggtgataatagtacttaggctttagtgacacagttttgtgaagtgcttaaaaaacttcttggtgcacagcaagctctgagtaagagccacctgttactgtgttctacagatgaatgaccttgagatgttagccacattgcaagttaacttctgaggtagaactgtgcaacagaaattttttaaaaaagacaataaggcagggaaaacttgggtctttagtttggagtcgtatctttaagctacatcctatcctcattcagccacgtcactatcttctctgcatttgtcatcttggctgaatcaactctaaggctgtgaccagctctggtgctctgaggttgactgttctggaaatcttttatttcaggacacctcctacctgttcatcactggccctgatgttgtgaagtctgtcaccaatgaggatgttacccaggaggagctcggtggtgccaagacccacaccaccatgtcaggtgagaggccttgaagatgaccttgttgttttcaaacattgagaagagggcattgccaaagagcctggtggcagtttttaagaaatattacttaattggcagaccttatttgggaagactgtggtacagtctattgtactacactacagtgtattgtttacagatatagtgataaaggtagatttagtatataaaatttattaaataacacgctattagtaatgcttggttattctttaaaacaatttagagctagttgctggaatggtgattataagtaggtatgatttatgtatgtacagttgaacctttgaaaaaaaattttatcttattgtgacattttttattctaaggttggtatatatcttagagtacataagtgttttccaatcattggccaggtgcatgatggtcatatatcatgtgttgatgaatttggtcatagttgttaacttctttttttttgagacaggatccagctctgtggcccaggctggagtgcagtgacacaatcttagcttattgcaacctccgcctcccaggctcaagcaatcctcccaccacagactcttgggtagctaggactacaggcatgcaccaccacacccagcaaatttttttttttttgtagagatggggttttaccatgttgccaggctggtgtcagactcttggcctcaagcaatctgcccaccttggcttcccaaagtgctgggattacaggcatgagccaccatacctggcttttgttttgttttgtttttgagatagggtctcatgctattgcccaggctggagtgcaggacacagtgatagctcactgtagcctcagtcttccgggctcaagtaattcttctgcctcagcctctctagtagctgggattacaggtatgtcacatcatacccaggtaatttttatttttaatatttttttgtagagatgtggtctcactgtgttgtccaggttggtctcgaactcctgggcttgagcaatcctcccacttcgacctcccaaagtgctgggattacaggcgtgagccaccatgtccggctagttgttcacaactttaagattacgtaccaagtttaaaatgtataaagattattctgtgcctcagcactgaaacaaaaagttcttgtttaaacagaaaggcatggaattggaagtagggcatgattctgatattagtgaagacatgttagctgttggagtaattattgcaattccatgttttcctgtaaaagaaaccacccagctgtgaatggattacctaccacacagcaatgtaactaaagacaggagaaattgcttctctgagagattttacagcagtgagaggctggcatgcctgatttatgcacctcattgtactgtggttaaggcattgggtcagcatttaattgtcagcatttcttcccagtgtccctaaagtagagatgtgtcttatcagtgaagtcttagattagatgaaatgtagttttaaaaaagttagggctcttgatcccccacccacaaaaattgtttctccccatgtcaggttggcatcgatcttgactcattcctttcccttacctatcagcatcatttagccccatctttaagacatgtctagaatcagaacacttcttagcatcaactccagcacggcctgatgccatgctattgtctcagggctttattggcagcagcctgtttttcttgctggtatataatataaagctgggtcttgatggtgtcttagatttgatgaaatatgctgtttatttttccccattttaatagcattatatgtttgtagtacaaaacttagaaaacatacaaagcataaaaactgctagatattccatcatccacagataatcactagtgattttttggttatacccttgcagtcttttcacgcacatgagcgtgaatacacaaacacttactcaaacataggtatggacatactcttatgtaacctgagttttttttttttttttacttgacagcttaaagtaatgaatgtctgcccatgacattaaagtttcttctgtagcacaatctcaagtacgttttgtttgttttttgattgtagggcagtatgtggttttctttctgggcctgaggctctttgatggactgtgtctgatgcacttggccctgtatccccagggcaaggcacaaaaaggtgctccgtacatatatttttctctcttttcttttttcttttgtggtaacagctttattgagatgtaattcatataccgtatattttaaacacctatttatagtgtacaattcagtggtttttaaaatacattcagagttggataattattaccacaatcaatttcaggacattgtcatcaccccaagaagaaaccctgtgcccattagcagtcactctgcatttcaaccacagatacttctgctctaggcaattaccaggctactttctgtctctgtggattttttcattctggacatttcctagaaatggaatcatataatatgtgatcttttgtaactggttgcttttacttagcataatgttgttaaaggctcatccatgttgtatcatgaatcagtactttattcatttttatggccgaataatattccagtgtgtggatataccacatctagtttattcattgaccagttaatagacactgggtcatttccacttttcggctatcataaatatgcctgtattaatatttatatgcaagtttttgggtagacatatgttttcatttctctttgatttctgagttaaatgataactcgatgtttaacttttaaggaactgacagactctcttccaaagtggctgtacccatttataaatattttttgaatgaaagaattctgtcatgctgaaaatgctttttattcaacaaatactcatttagaatatgtggaaaaaggcaaatagcaaaggaattaaaaatttaaaatagaataataaaaatgtaaaaaaagaaacaaaacaaaacaaatattcatcgagtacctatgtgtgaagcattgttttaggtgctaggaatacatctgtggacagaacaaaagaaagacacctgcccatatggggcttatattctagtagaggagatagacaataaacattgtaaataagtacactatgcagtatgttagaaggcaatacgtgctatggaaaaagtataacagggtaaaggggactgggattgttgtagtttcaaatagggtggtaacagtaggcctcactgaggttaggagctgagcagattttaaggagttaactgcattgatatgtaagtggggagcattgcaggcagaggggaacagcttatgcaaaggctctcggtaggagagtgactggcccgatcagtgaacaaggaggatcattggagtagagacatgacacgatctgacttaaaaagctctgtctgtcagctttgtggacaagagaccgtaggggcaatggtgaaagaaaggagtctggtgggatgaacctggggagagagttcttggctccgctttctccatcatacctatggccttgtttggctgctctgtgatttcagagtgctcttcaagaattatggcttgattctcactaggggcaggtggctcccctcctttccttccactgttgctgtgcacctgtttgccaggtacattattcttaatgttggccaggcctgatcttaccctgttggagctgatattccaggagagatgtccggcagtaaacagggaaataggtgatgcagagaaaagtacgggaggagaactcccgcatggtatagggatggatagtgaaggatctgggagtgggtatggaggtgacattagagcaaggacctgaataaagaaaggtgtgacccctgtagaggtgtggttgcagaacagagggaacatgtgctgcatgagttgaaggatcacccggaaggtatgtattatgtggcattacatcctcagtggagggtgcagagaacagagctatcagcacggtctgctactgacatgccctagaagggcgcagtcaggcatgaagcagcaactttgggctggctggtaccctgactcaatcatatatgctccctgttctcttaggtgtggcccacagagcttttgaaaatgatgttgatgccttgtgtaatctccgggatttcttcaactacctgcccctgagcagtcaggacccggctcccgtccgtgagtgccacgatcccaggtgggttgtaggccggtgcaccttctctcattttgcagtgtagcttgcctttctctgccctgacaggacccccagggtctgccttgttgggcaagttgcagcagagtgtggtagagtggctcccaggtgtggggatgatgtcatgtttggctataggagcaaagaaagatgattttattttcctttttcctctctgtaatatctaatgtatatcttggtggtgaagagtggcccaaaacagttttaaagaaaaattttttgatttctaagaaactctcaagttatctagaattagagattcaagttttttttggtctggcctagtccccatgaagaagtctcccatttcctttccttcccctcacccacaaaaggaagagccatgattcttcttatgctgactatacctggcttttttctgtctaaagtgactggttcctgggctctacctagttgtccttttgaaataaataaatgtaaaatgatgcaaacagcatgccctttaggaaacatgtttatgcatactgcttatagccagaggctgggacagtcctggggaagggtgtgttgctggccatctggtgaagacctttccttttgctgttggagtctaccacctgttgtggaggcaccatagagtaaagtggaggccctgcccaggaactgctccacacctctagccgttccattttatttcctctccaaattataagcactcacttggcctggactttcttctgcagaagggatttgaaattgtattgtttgggaagaggtcattttcagatgctatcctgtagcttaaacctggactccttcctgtggggcctggtctgggccagggatgctctgaagagttgtgttgccagggcctcactctgtctgcctctgcccactccacaagggacatacccagtggcccactgtgtgtagtcatggaggggagagtggtcacaaggtccagagctgtgggtatagcctttctgagtatacagtttggagttcctgaagggtttaggacatcacttgaaggtattatggcccaggagcccagaaatgtctgcatagcccgctttggcccagctatacctcttctgcatatgattccaagggagatatatatccatatatatgtatacatatatatatgcatgtgtatatgcgtatatatgtatacgtgtatgtgtatatacatatgttcatgtgtgcatatgtacgtatatgcatatatatgtatacatacatgtatacatatttgtgcatacacacatacacatgcatacatatgcatgcataggtatatatgcatatgtatgtatatgtatgcttatgtatatgcatatgtatgtatatgtatgcttatgtatatatgcatatgtatgcatgtgtatgtataggtatgcatgtgtatgtatgtatatgcatgtgtatgtataggtatgcatgtgtatgtatgtatatgcatgtgtataggtatgcatgtgtatgtatgtatatgcatgtgtatgtataggtatgcatgtgtatgtatgtatatgcatgtgtatgtataggtatgcatgtgtatgtatgtatatgcatgtgtatgtataggtatgcatgtgtatgtatgtatatgcatgtgtatgtataggtatgcatgtgtatgtatgtatatgcatgtgtatgtataggtatgcatgtgtgtgtatgtataggtatgcatgtgtatgtatgtatatgcatgtgtatgtataggtatgcatgtgtatgtatgtatatgcatgtgtatgtatatgcatgcatatgtatgtatatgcatgcatgtgtatgtacgtatatgcgtacatatgtatgcatgtatatgtatgcatatgtatatgtatacgcatatgcatacatatatacatgtatgcatgtatacacacatgcatgtgtatatatgcatacccacacatatgcatgtgtacacgcccacacatgcatatatgcatgcccacacacatgcatatcaacacatatatgcatatacgcatatctacacatatacatacatgcatatctacacgtgtatatatgtatatctacacatgtgttcacatacatatatacacatatgtatatgtgtatatatgtatgacaagtaaaaagggaggactttattagcagatggggctacccttagttttctttccagcgtagagctttttgcgaagttgggcttgatggacacatggcctgacccaaggccaaacctcagcccaggagtacgtctcagggtcactgtagcccctggctgcccacactgggaaggagggaatgaaagcctattggagagaagaggttggagaggggcaagttgctgggtcctcctgtagagtgggagtgggctctggcttagtttttctgctgagacacttggatgcaggaggaaggagagagtccatgagcctgcatgtgacaggttctgtggtgattttgcccagagggcctgcagttttgctttttgaaggagctttagcagattaacctaacagggaatgtgaacccacagtggtttatgcagagctctgcctttgcatttccaagtccttgttcttttaatgttccaggaagttgggctgggctctcccagggctgtgtcttgttcactataatgtccttcagtgccctacacggtacctagaatgtaggaggtattcagagaagataaatgaaagaataacgtttagaggaataaactcattttttcctctaaaagagaaccagaagatcttttggattgatacttgtcccaggttcagttaatatggtggttaaaaaggaatgactctttggtgactgctttgtaagcccagcagggacagaactggcccagtccctatgacgtgtcaccccatttcctttcccaccccattcccacaaaaggtaactggctcttcctatgttgactatacctgccttttttctgcctaaagtgaccgtctggttcctgagcttgacacaattgtccctttggaatcaaccaaagcctacaacatggtggacatcatacactctgtaagtgccacatctgtttgtcttgcctgtcctagtcagccacattcatgggcattgtgcttcggcttagtgaggaagcactggaccacttggcctccatgtcagacagcacaggtcgggaatagggtgggcacaggaccagtggccactgagtagtgtgttctggaaagacctagtggctatagataccctagtggcacagatggacttgagggctggagataggagtagtaagggccagcagagctcaggagtctttagaaggccctctgaggatcataaattaggggccatgtccacagagtctagagtgaggccagagtgatcattgttaagtatcattggggccctctgctcagagggggttttgtctttatagagaagagagtacacagggcatcctagaaggttggactgtgtgtgtggaggtccgtgggagacaggagccatttgtacctttttttggtacagcagattcctgggtcattaagtaaaggggacagtgttgggcaaactgaaggcatctgtagatggccaatgccttccttaagggtacactgtgctctcggtagtccttgtgcaacacatcgtgatggctctctggtaactctagaagtcagattctccctcttccctagggtttgctgttttctgttattgtttttgtcttttttattcttgtagtctcttcctgcaccaaggattagcctgagatgtaaccttaaggtcttccttaggtcttttctgagcctttgcaggggcacgtgcaatcactttctaattttccctgcatatgcagttgtttttgagtgtcctagttgttaacgtctggctcccaaaagtagaaaaagagaaaaaaaatgaagatggtaaaaagatgtcagccctttaaattccttggaagtcagttcagcccaaagcaggagagcctcgcaacagtgtggggagttgtagcaacagtgaccacccatctctttgcacctctgtgatcagaagcagcagtcagcaagcacagattctcaatatttggaggacagggtccttttatgcccaccccggctcctgcaagctgtgtgcaaactgctgcaggaacacttgcggaaatatctgtcatggagctggggtgggggatgggtagctgctactatgctaagagctgaaattaactccaattttcagtccaatccttcccctggaagttgcagtctttcaacagacgccagagtcaaaatagttccatcagacagattctgccaggcaattgttgcctgggtggggagacagattcctggtgcttcctactctgccatcttctaactttttcttaaggtacatatgataactcttgattctcattataaagttttatatcctgctacctattaaatactcttgtttgtaatttttttctgtcatttatttagggttttattttatttatttatttttattttattttattattattatactttaagttttagggtacatgtgcacaatgtgcaggttagttacatatgtatacatgtgccatgctggtgtgctgcacctgttaactcgtcatttagcattaggtatatctcctaatgctatccctcccccctcccccaaccccacaacagtccccagagtgtggtatttagggttttaaaaatgtggttgtatactgtctatgtataaataagagttctgtcgggtgcaggggctcatgcctataatcccaatgctttgggaggctaaggcaggaggatcctttcatgccaggagctcaaaaccagcctggacaacataatgagtcaccatctctataaaaagtaaaaaaatttgctgggtgaggtggctgtcgcctgtagtcccatttacttgggaggctgagatgggaggattgcttgaacccaggtgtttgaggctgttctgagttatgatcattgccactgcactccatcctggtgtgcaagactccatcgccaaaaataagtaaatgaataaaattttatctttccagttattttacatgtcatttctttccttgtcttgcattggctacaactccctatatgtcaaatgtaatggtgaatcatagttgtgattctgggcatctttgtattgtttgtaagtttagcaagactgctgtcagtgtttcctaatttatatcttttttcatgttgaagctactactggcttctgttttaaatatttttgttgttgtttattttgttcttaaagttaggaatgagtgttgaatattgttgaatgcactttcagtgtttttggagatgatcatgtgattttcttccttagatctatttataaatctatcctagtagatttctgaatactaaacttccttcattcctgaagttgtatattctgtttgctaatgttttgagtttctgcattgatattatgtgatactagtgcgtatattttaaggtattttaaaatcaggttttggtatcgatgttgtatttgctttacttatttatttatttaaaaaaaatttttttttgagacagagttttgctcttgtcacccaagctggaatgcggtggcacaatctctactcactgcaacccctgcctcctgggttcaaccaattctcctgcatcagactcccaagtagctgggattacaggcgagccctaccatgtccggctaatttttgtacttttagtagagacacggtttcgccatgttggccaggctggtcttgaacttctgacctcaggtgatccacctgccttggccccacaaagtgctgggattacaggtgtgagccaccgtgcctggcctgtatttgctttatgtattagtgttctagtgctgccataagaaaataccataaactgcatagcttaaacaacagaaatttattttctgtcagttctggaggctagaagtccaagatcatggtgttggcagggttggcttcattctgaggtctgtgtctctttggcttctggactacactcttgctgtgtcctcacgaggtctttgctctcagtgcatgcagaaagagatctctggtatctcttcgtcttttttttttttttttccctcagagacagggtcttgctttgtcacccaggctggagtgcagcggtgtgactttgactcactgcaggcttgacctcctgtgctcaagtgatcttcccacttcagcctcctgagtagctgggactatagctgcatgccaccacatctggctaattttaaaattttttgtagagatggcaactcactatgttgcccaggctggcttttccaattatttatttatttttttttgagttggagtctggctctgtcgcccgggctggagtgcagtggcgtgatctcggctcactgcaagctctgcctcccgggtacacgccattctcctgcctcagccacccaagtagcagggactacaggcacccaccaccatgcctggctaattttgtttttgtatttttagtagagacggggtttcaccgtgttagccaggatagtctcgatctcccgacctcgtgatctgcccgccttggcctcccaaagtgttgggattacagatgtgagccactgtgcccggctggctttccaattcttttcttttttttgagatggagtctcactctgtcgccaggctggagtgcagtggcacaatctcagcttagtgcaacctctgcctcccgggttcaagtgattctcctgcctcaacctcctgaatagctgtgatttcaggcacccgccaccacgcttggctaatttttgtatttttagtagagacggggtttcaccatgtttgccaggatggtcttgatctcctgacctcatgatccgcctgcctcggcctcccaaagtgctgggattacaggcatgagccacgggcgccaacccagcttttccaatttttaaaagaattccagtcctaacagattagggtccccctcttatggccccgtttaactttaattacctctggaacatccctctctccaaattcacttttttttttctttgagacagagtctaactctgttgcccaggccagtgtgcagtggcgagatcacggctcattgcaacttccaccttccaggttcaggagatgcttctgcctcagcctctcaagtagctgggattacaggtgtgtgccaccatgcctggctaatttttgtatttttagagatggggtttcgccatgttggccaggctggtctcaaactcctggcttcaagtgatccacttgcctcggcctcccaaactactggcattagaggtgtaagccactgcacctagaccatatatttacttttaactcaaaaagtattgtattattacacttttttattttgctttttaaaaaaacttcttctggccgggcgtggtggctcatgcctgtaattccagcactttgggaggctgaggcgggtggatcacttgaggtcaggagttcgagaccagcttgaccaacacggtgaaaacctgtctctattgaaaatacaaaaattagccgggtgtggtggtgtgtccctgtaatcccagctactggagagactgaggcaggagaatcacttaaactggggaggcacaggttgcaatgagctgagattgcaccattgcatttcagcctgggcgatgagtgaaactgtctctaaaaaaaaaaaaaaagaaagaaaaaaagtgaatatgctagaaaagagtcaaagcagtgactttagaagctacttaagagtgcacacacaaatcaatacggtagtcaggggaaggcattacttctggggaagaagagtacaaaggaaagagagaggtacctttggaaattgtgaagggaaaatgaagcaagggggttacatttatgtacctgcaagacatacaaaatcgaatacactgaaggacactacatctttccccatcaccctccctaaaattagtcacccatgaactaaactgcactttgctatactgacagaagagggtgctcttgaactaggatttttgttcatttgttcatctgccagctttggagaatgcagatacaaatagttttcatttatataaagctacaataagaaaacaaaaagtgagaatgaaacatgtcagttgatggaactcccttcactgtaaaagtcaatcatgaagcagctgactatgcttcaatctgagtgcagtagcccctgataagcatttgaggttgtaaaaatagaaaattcagaaactaatgacaagatggagagataatagtaagaagttaaagctgattgaattaagaaaatgggcaggggagacaaaattgcatcagaaatgatatcaaaattgcaaggtgctcaaaggagaatgtatttcaatgaaaatttaataaggaacattaaagaaaagtagataaatagcctaaaaaatgaatgaaataatataaaaaagtaaaagtagattttacattctcaccacaaaaaagtatgtgaggtggtggatatgttaactagctttagtcatcctacactgtatacatatatgaaaacatgtacgttgtacatatatgcaattataaaattttaaaatagtacagatacctttaatacaattattggttatattgtcacatctgggattaattttttaaaattcttagttaaatgtatgagaaaaaagtgactacaatgaaaggcaaagaagaatgaacatacatataattggagtgtctgaagaaaaaccagtagaacagacttaatatttaaaactgtaatccaagaaaatagtccagaaataaaataagattcagatttatataatgaaagagcacactgagcacgtgggaaaattgacccagaattgtcaaactagagaaaatattaactgttcgatttttaaaataaggagaaatactcaggacctttgggcagaaatcaaatgacttacaagggcaagagaataaaatggcatccaacttctccaaagcaacgtagaaaagcaaggaaacaacagaaaagcactttcaggaggctgaaggaaagaatctgtgactaaggattttatgtttagcaaagctcaccttcatgtattaagactgcagaaaaccagttttaaaccaagaaccgagggaagtttgtgttaatgaggctttcttgaggaatctactagagaatgagctttatccaatcaagaggtagctggagaaatttcaacaaaaggattggtagtgattatctaatatacttaattataattctaagactaaaacagaagtggggatgagggtagagaacaatgtataagtactatatgtttagtttcagaaaaaaatgcaactgaaaaatgggaggagaagagaggggaagaatattgcagaatcagctcactgattattgttagctaacagatatcattaaaaacaaactagttaataaaagattaaggaaatgaactaaaggcatcaaaaggcataattacaaaggtaaccactagactaaaaaatacaaacattctttaatactactcacataaacagtatatatcattgtgggtaatgataaaggggaaaaataaaaaaaaaggtaaaagacaataaatatagaatacatagtaattataaaaaataatatgacaggccaggcgtggtggctcatgcctgtaattccagtactttgggaggctgaggcgagcagatcacctgaggttggaagtttgagaccagcctgaccaacatggagaaaccctatctctactgaaaatacaaaattagccaggtgtggtggcacatgcctgtaatcccagctacccgggaggctgaggcaggagaatcgcttgaacccaggaggcagaggttgtggtgagccgagattgcaccattgcactcaagcctgggcaacaagagtgaaactccatctcaaaataataataataataataataatatgatagtaaaaaagtgtcataccaataaatatggatgggtttgattcacttgttaaaaatatgtctaatttgttatggaccaattatattcagtatataaatgtgattcagaaaggctaaaaataaggaatgggcagaaatatactgggagaatggaaacaataacagcagtatttgtgacactaatattgaacagagtaaagttcaggtattaaccataataaggaaggactttttttttttttttttgatatggagtctcactctgtaacccaggctggagtgctgtggcacaatctcagcccaccgcaacttccacctcccaggttcaagtgattctcctgcctcagcttcccaggaaggacattttcaactgctaaaagccatagttcacaatgataatgtaaagcatatcgaatatctgtgccagaaataaccaccatctttataaagctgaaactataggagattcaacagacttaggtagaaagactgaataggagatgtatacacagcattgttattacaaagcaggtcaaatggacaaaagtaataatttaggagacctaaataacgtaataggtagatcttacacatttcttttggactttacaccctggtaatgaacaataaatcttattctgaagtgcacatggaatattcacaaaagttgatcatatgtattagatcagaaagaaaacatcattaaatcccatagagcaaaaaatactgtgaaacaacattgcttaaaattagaaacttttgtagcaactaaaacaaaagtagcctccagccgggaaataaatcttctagtaaacaattcttggatgaaaggggaaaatagaaaccaaatgacagaattctaaaagaaaaaaagacaaaacactatgtgtcaaaacctatagaatatgtttaaaacgatgaacagatgaaaatctgtttcctgaaacagtaaaaatcagagaaggaaaataaacaggccaggtgcggtggctcacacatgtaatcccagcactttgggaggccgaggcaggtggattgcttgagctcaggagtttgagaccagcctgggcaacacggtgaaaccccgtctctactaaaatacaaaaaattagctaggcatggcggcatgtgcctgtaatcccaggtactcaggaggctgagacaggagaatcgcttgaacctgggaggcagaggttgcagtgagcccagatcgtgccactgcactccagcctgggtgacagagcaagactccatctcaaaaaaaaaaaaaaaaaagaaaagaaaaacagattcccaactggaaaagccaggggaaaaaaccctgtaaaatatttcagaataaatccaagaaataatttaataaggataaatgcagaaatttatgatggaaatagaagaatagctgcaattagtaaacactggctaacttcaaaaaagagacagtaaaagcagaagtatgaagtgagaaagggaataaccattgaaaaagaagaaacttaagaatcgttaagaggccaggtgtggtggctcatgcctataatcccagcactttgggaggctgaggtgggaggatcgcttgaagccaggagttgaagaccaacctgggcaacatagtgagtccctgtctctacaaaaatttttaaagttaactgggtgtggtggcatgcacctatagtcccagctacttgagaggcctcagtgtaggagaattgctagaacacaggagttcaaggctgtagtgagctgtgattgcaccatcatactccagcctgggcaacatagtgagaccctgtctcaaaaaaaaaaaaaattctaagagacaagatacattggaaaatttgtttggaaaacacagtttaacagaaattgatcccatcagagataggaagcttaaatgaaccaccaaattccacggaaggaattacttcaccaaaaagcacaaggagctggattcagtggctcatgcctataatcccaacattttgggatgctaaaacgggaggattgtttgagcccaggaatttgagaccagcctgggcaacatgacgaaactctgtctctacaaaaaataaattagggccaggcaaggtggctcacacctgtaatcccgcactttgggaggccgaggtgggcggatcacctgaggtcgggagttcgagaccagcctgactaacatggagaaacctcgtctttactaaaaatacagaattagccaggtgtggtggtacatgcctgtaatccccgctactcgggaggctgaggcaggagaattgcttgaacccaggaggcggaggttgcgatgagccaagatcgtgccattgcactccagcctgggcaacaagagcgaaactccatctaaaaaaaaaaaaaagccaggcatggtggtatgcacctgtagtcccagctactggggaggccaaggtgggagttcacttgagcccaggaagttgagggagcagttaaccatgtttgtgccacggcactctaccctgggtgacagagcaagactctgtctcaaacaaacaaacaccaggcccaaatagtttcatgtggaatttctgagacctttaagggccaaatagtcctagtgccacataaattcttccagagcatagaaagtaaacaaaacacacaagaaccttccaaaattttttaaaagaagtatgatatcagtacctgaacctgataaaggtagtacttaagatttcagtttcatattgcttatttctttaaaattatatctgtggcctactgggatgtattctaggaatgcaagattggttctaggaaactcaataatatactgtattaacacatataggggagaaaaatcacaattatttatatagacgctgaagaaaacctttaagaaacatcaatacctattcctgatagacttcataaaataggaattaatactttcttaatgtaataaaatttggtatagaccttttcaaaagcctgcatctcacctaataaagactagcttctactaggattaggaacaagtataggatgcccattattcccattattatttaacattgttctggaaatattaaccaatacagttatccaagaagaggaccaattagagacaaaagccttgggagagatgtcaagctgtaacgtaggtgatatagtattgtagtattcaagaaaactctagagaatgcattattatactaaaacaatacttgaggaacaggatacaaaattaacatatagaaatcttcatatacgcaagcagtaaccaattatggtagagtaaaagcctctcttacatagcaacaggaagataaaatatttagtaataattttaacaggaatgtacagaagctgttttagggcaaatttatttttttagacagggtttcactctgtcacccaggatggagtgcagtgacccagtcacaactcactgcagcttcaacttcctggtcaagcaatcctcccacattgccaggactacaggcatgcatcaccacacacacctgatttaatatttttttttttgtaggaagaattcctgctatgttgcccaggctggtctcgaactcttgggctcaagcgatccttctgccttggccttccaaagtgctgggattttaggtgtgagcccccaagcccagcccagggtgatcttaaaaacacttttgaaaatcaaaagtaggccaggcatggtggctcacacctgtaatcccagcactttaggaagctgaggagggaagatcctttgagcccaggagtttgagaccatcctgggcaacatagtgagaccttgtctgtacaaaacaaaacattaaaatagacttgaacaaatggaaagacattccttgttcctggggttaatgttattaacaaactggtgattcttaagttgttctataaatttaaggcaatcccaataaacagtttttaaaaactagaactagataagtttatacaaaagtgcacatggaaaaataaaagtgcaagaatacctaagaatatactgcaaaagaaaagctgtaagtggggactagccatgctttatattacagcatcctatagttaaaactgtggtacaggcacataaatagaccagtggaatagaataaaagagccagaaatagactcaagtacatacagaattttagtacagtcacgcgttgcgtaacaacagggatgtgttctgagaaatgcatcattaggcagtttctttgtgcgaccatcatagagtgtacttccacaaacctagatggtataacctattacacacctaggatctgtggtatagtctgttgctcttaggctgcaaacctgtatagcacgttactgtaccaaacactgtatgcagttgtaacacaatggtaagtatgtatctaaacataaaaagggtacagtaaaaatagggtattacaataggaccaccttcctataggcagtttgtcattgaccagaacctctttgtgtagtgcccaactgtatatgataatgatattttatcaaatctcaggggcaaaaattagcttttaataaatgatgctggggcaactgactagccatttaggaaaatataaaattagattcatactttacaccatgtacaaaaataaactacaaatgggtcagaaaactaaatataatctgtgaatccatacaagcactaaaagaaaacacagatgaattcctctgaaaccttaggggaaggtttagaaatgcttttgaactgtaactcaactagtttcagtgaaagatagacaaagctgactgtgaaaattttaaaatcccactcttcatagcaaaaaactataaataaaatcaaaaggcaaccaatatgctagaagaaactcttggcagcatgtatcccagagtatgaatattcttaataaagagctcttatgctgagggattaacaaccaaaattgatagaaaagtgggcaaaaaaccacggatagatagctcacaaaaaagatataaaatggaccttaaacatgtcaaaagattttcaacttcatacataatgctagaaatacaaattcaaattacactgagtattttctcatatgttagattggctaaaaataaaaaccccgaaaacactttccattggaaagtcagtggagaagcaggcactcctgtgcattgctggtaggggactctggtattatccaggactaaattagcatttgccctttaactcagcaatcccattcctagcaatttaccctgaagatacacttcccaccatacaaaattatagatgtacgaggttacgaccattacgttgtcatttgtaattgcgagatactctaaataacctaaatgtaaattttaaaataatgtaagccacgtgtagattggttgaataaactttggtacatcacacagtacagtactatgcagaagtgaaaaagaatgatgatctctatgaactgataggaagtgattcccaggacatattaagtgaaaaaattcaaagtgcaagagtgtctgtactgttactttccatgtaagaagggtaaattaaaagatacaaatgcaaacacacacataatacatcagaaaataatgagattaataacagggtaggtgggactagggtggaagggatggggaaggaacactattaaactgtattagtattttacatattaaaaaataaaatcaagactggggaaaacctttaaaatgaaatacaaacatgaacctgttttaaatgagtgtcttttgaacctatattttgactatatacctttaatctaaagaccaaaatagctgtaaaaaaattctagctagtaggtctgttttttgtagctaagttagcagttctgaaaccattttctctgtatttgaggatcgaataaataagtacattttgagggtagtagcagccagattctgctatcggagaagggagttgtgaatatggcaagagaaaaaaatctagaatgaaccctatagttgcactggagtaggattagaattatcagcatgaactcatggtttttcatatagctggactttggacgttttagaaggagtcacacacacacacacatccctaaaaggaacccaggccttttggagaaatggctgattgtagggctggggcaggaaagaaaccaagatgaaccagaaagtaagatacttccaaaatataaggtagtgctcaaagaatgatggggacactttagaaggacacaggaaccagcatgaaggaactttggtaaatataggacaatttaaacataaaatgatggtgaaagattataatccatagaataaaacaatctataagttcatattgatacctataagtaaatgggaaaggcaaagatctttcttgtggtagatgtcagctaataaatggagaagaaaagtggaattggaaaactcaccctttgggctgggtgtggtggttcacacttgtaaggagggcggattgctcgagcttcggagtttgagcccagcccggccaatacggtgaaaccctgtctctactaaaaatacaaaaattaaccaggtatggtggcatgaacctgtggtcccagctgcttgggaggctaaggtgggaagatcgcttgagcctgggaggtggaggttgcatcgagctgaggttgctccactgcactcccacctaggtggcagagtaagaccctgtctcaagaaaaacaaaaacaaaaacaaaaaaacaaaacaaaaaaactcaccatttggcagctatcatgacagtaatgagtcaggcaagaatcatggctgcttggtggctgctaggatgctaaacctagtggatgaagaactagattaatgattaaagtttgaagaacaggattttatgtagtctcaacgtatttcctcacaaaattcttattaaattggagaaatagtaactttacaaggaaacctgcagatatcaccatcattaatggacaaatcaacacattgtgccacttgatgagaatgctccttctgtggtactcctgtggaaaggcttagctcaaaattaaacatgaagaaataccaaaggaacccaaatagaagtcatgctttacaaattaactggtctgttgtcttcaaagatgtcatgattatgaaagacaaagatggagggggaaagttaaaggagcctaaagagatataaccactaaaagcaccaggtgatcctggctcaggttctggaccagaattttgttgcttgtgctgctataaaggatactattggaacaattggcaaacttgaataatgtcatataataagaaatagtggccgggcgcggtggctcacgcctgtaatcccagcactttgggaggccgaggtgggcggatcacgaggtcgagatcgagactattctgaccaacatggtgaaaccatctctaaaaatacaaaaaaattagctgggcatggtggtgcgtgcctgtagtcccagctactcgggaggcttaggagaattgcttgaacccagggggcggagattgcagtgagccgagatcgtgccactgcactccatcctgggcagctaagcgagactccgtctcaaacaaacaaaagaaaattgtgaattgggcacagtggctcatgcctgtaatctcagcactttgggaggctgaggcaggtggattgcgtgaggccaagagtttgagaccagcctgcgcaacatagcaagaccctgtctctacaaaaaatataattttttttttttggtggcatatacctgtagtcctagctacttgggaggctgaggtgagagaattgcttgagccctggaggttaaggctgcagtgagctgtgatcatgcttctgcactccagcctgggtcacagagcaagacctgtctcaaaaaaaaaatagtattgtggtaatgtttatttcctgattttgataatatcactgtagttataaaaaagaatgttcttatgtgtttatatatatataaaagagagagtgatggtcgggcacagtggctcacgcctgtaatcacagcatgttggaggccaaggtgggaggattgctcaaggccaggaattggagaccagtctgggcaacatagcgagatctcatctctactaaaaattaaaaaattaactgagcatggtggtgcacagctgtggtcctagttgcttgggaggcagaggtggggaagatcacttgagcccaggagatcgaggctgcagtgagccataattgcaccactgcattccagcctgggtgacagagggagaccctgtctcaaaaaaagaaaaaaaaaaaaagcagaatagtttgtagtaaaataataatgaagaatcggggtgaagggtatatgtactgttcttgaattttttatttttatttatttattttttgagataggatctccctccgttgcccaggctagagtgcagtggcataatcttggcttgctgcaacctctgccttccagtttaagcgattctcctgcctcagtctcctgagtagctgggattacaggtgcctgccaccacaccaggccaattttttgcatttttagtagagatggggtttcgctacattggccaggctggtcttgaactcctggcctcaggtgatccacctgcctcgacctcccaaagtgctaagattacaggagtgagccactgggcccggcctgacatttttatttaggttggaaataatttcaaagtgaaaaggtaaagttgtcacaaaaattccacactcaaataggacttttaaaacaaacttcattggtgtgtccatcttagcagcagttgaggttttccacaccatttctccccagcagggaggaggtgctgcctctgcctgttgtcctgcttccttggagaacctgtgatagagctggagctgtctacctctacctctgtaattctgtaatagaaatgtcattctgtagtgtcattacatcttatacttgtctttaccattttgagctcagaagtaaatttattcctgcaggttgttgatgagcgtgaattttttgagatcatgcccaattatgccaagaacatcattgttggttttgcaagaatgaatgggaggactgttggaattgttggcaaccaacctaaggtggcctcaggtaggatggagctcttataagccttggttttggggttggaggccagggaagcctgggtccatggtatcctttctgtcttttgcctgttcttcagacatggccttccatgaccagaggaaaaaatctaaatggttgttataaaagctaattttttttttttttttttttttttttttttagacagggtcttactggtgtctaggctggagtgcagtggtgtgatctcagcacactggaccctctgcctcccagggtcaagcagtccttccacctcggcctcccgagtagctgggactacaggcacataccaccatacctgactaattttctttttttgtatttttggtagagatggggttttgccatgttgcctgtgctggttttgaactcctgagctcaagtgatccgcccacctcagcctccgaaagcgctgggattacagacatgagacaccacaactggcctataaaagctacttttaatatctcaaaatgcttctttcatactccttttcaaaggtttataggaaacttacattcttagtgtataaggttttcaattttttaggggtcagttttctgttcccccctacccccagctaaatatatgactcacccactaatcatgagctccatgagggcaggggtggtgatgtcgtattcacagtagtatctccagtgccttcaacagtgccaggcacatagatggtacgtgacaagttaatggcatcttaccatgtctgtgccccacagctttctggtgatatggccagacctgattcgcagccaagtgagggagactcttccatggctgtgctctgggagggattgggagtgctggggtggggactgtgaataccacttctctcctcaatatttttcctcttagatttgttttgtatccttgtttaggaagaatctgtctttcttcatgacctaacctcatcttatttctgccatggaaattttttattgtctttagaaaactgttttggctgggtgtggtgcctcacgcctgtaatcccagcactttgggaggccaaggcgggtggatcacgaggtctggagttagagaccatcttagccaacatggtgaaaccctgtctctactaaaaatacaaaatacaaaaaatgagctgggcgtggtggcacgtgcctgtagtccagctacttgggaggctgaggcaggagaattgcttgagccggggaggaggaggttgttgtagtgagccggggattgtgtcactgcccgggaggcagaagttacagtgagccgagatcacgccactgcatgacagagtgacactgtccccacctccccaaaaaaaaaattttgtcatggtaaaatatatataacaaaatatgtctgtttggcccatttaaagtagtgcaaccgcagtgattacatacaaagtgtatgcaaccatcaccactgtttccaaacattttcatctcctcagagactgtgaacctgttaaacaataactcactatttatctcagcctccagcctttgctattctaaatctactttctctctctatgaatttgcctattttagatatttcatataaatggaatcatacagtgtttgtccttttatatcaatcttatttcacttagcataatcaggcttatttcatttagcaagattcatccatattgtagcatatgttagaacttcatttatttttatggctgaataatattatgttgcatgtatataccacattttgattgattgtccatttgtcagtggacacctgggttatttccacctttgggttactgtgaataatgctggaataaacattgatatataagtatctgtttgaacctcagttttcactttttctgggtgtgtacccagaagcaaaataactgggttatgtggtaattctaggtttaactttttggggaaacaccatactgttttctacagtgtctgcactattttacattcccaccagcaatgtgcaagggttccagtttttccacatccttgccaacacttattattaatttttaaaaatagtaatcctagtggatgtgaagtgaatggaattgtgtttttgatttgcatttctcatcaacattagtcttggtgagcatcctttcatgtgcttattggccatttgtatatcttctttggaaaaatgtctattcaagtccttttccattttttaattttgtgtgttttttgttgttgagttggagttccttgtatattctgtatattaaactcttacatttgacttacaagtattttcttctgttctataggttgtccttgcactcttttgatcatgtcttttgatacacaattttttttttttttttgagatggagtctcgcgctctcttgctgtctccagcccgggctggagtgcaatggtacgatctcggcttattgcaatctctgtgccccgagtttcaagccattctctcacctcagcatcccaaatagctgggattacaggcatgtgccaccatgctgggctaatttttgtatttttagtagagacggggtttcgccatgttggccaggctggtctcgaactcctgacttccagtgatctgcccaccttggcctcccaaagtgctgggattacaggtgtgaaccactgcacctggctgaaaagtttttagttttgattaaatctgatttctgtattttttcttctgttgcatgtgcttttgttgtcgtatataagaatttaaattcaaggttgtgaaggtatgttcctgttgtttttttcctgagagtattacggttttagcccttacatttagcttttaatttcgagttaattttatatgtattggataggagtgcaacttcattcttttgcatgtggaaatccagttattccagcaccgtttgttgaagagattattctttcctcattgaacaggtgtggcgtgcttgtgggaaatcaacaggctgtgggtgtatgaatttgtttctgtattcttaacactattctgttggtctgtatgtctgtccatattccagtgtcacactgttttgattactgtagctttgtatatgttttgaaattgggaagtgtgtcttccaactttattgttgttcttaggattgttttaggcatttggggcccttttaaattccatatgaattttggtagtgactttcccatttctccaaaaaaggctgttggaattttgatagggatggtgttgaatcagtagattactctgagtagtattgacaccttgacaatattgtctttcaatccatgaacacagaatgtctttccatttttcttctttttttatttctttcagctgtgttttgtagttttcagagtccaagcctatcacctctttggttaaatttattcctaaatgttttattcttctagatgtcatgtacatggaattgctttctcaatttctttttcggattgttcattgctgctgtatagaagcacaactacaaaactgatttttgttgatcttgtaacttgcaactttgctgggtttattaactttgttagcttttgtttcaaaatttatattgctacattttgtttgattgttgatctgtggacatggggtattttcaccttttagttgtgaataatgctggtgaatattgtgaatattatgaaagttgatgaatttgttcattagccctcttgtggatttgctgggattttctatatatagggtcatattttctgcaaatagagatagttttacttcttcctttccaatttggatgctttttatttttcttgtctaattgctctggcaagaatttcttgtacattgttgaattgcagtggtgaaagtgggcatggttgtcttgttcctcatgttaagggaggaaaacctaatctttcattattgtataatgttagctgtgggtttttcatgaatgccctttataatatggaggaagtttccatctgttcatgattttctttgttttatcatgaaagggtgttggattttgtcaaatgccttttttgtgtcaattgagatgatcatgtggtttttgtccttccttttgttaacatggtgtattatgttgattttcttatgttgaactgcctttgcattcctggaataaatcccactggatcacagtgtataacctctttaaaaaaatagacttacagaacagttacaggtttgcagcaaaattgaatggaaagtacatagaattcctgtacaccttctgctcccacatgcacacatgcacagcctccatatgtccaaaatcctgcataagagcagtatatttgaggttaatggttgtattaatctgttttcacactgctataaagacaccacccaagcctgggtattctataaaggaaagaggtttaattgactcacagttccatatggctgggaaggcgtcaggaaacttacaatcatggtggaaggcaaagtggaagcagacgttcttcacatggcagcaggagagagaagtgcaggcaggggaaatgccagatgtttataaaaccatcagatctcatgagaactcacacactatcacgagaacagcgtgaggaaaaccacccccatgatccagtcacctccctcccttgacacatggtccctccctcaacacatggggattacagcttcctctctcaacacatgggtattacaatttgagatgagatttgggcgggcacacagagctatcccataccaatagtattttgttttaaatttcagattctactggtttattgccaatatataggaaagtaattgatttttgtatattagccttttatcctgcaaccttgctatattattagttccagcagttattttttggtcacttctttcagattttctgtatggacaattttgtcatctgtgaacaaagacagtttgatttcttccttctcaatgtgtatacgttttattttcttgtcttcctgcattagccaggacttccaatacaatattgaaagatagtggtgaggggacatttggtcttagcaggaaaacttctagtttcttacaagtaagtgtgatgttagttgtaggtttttcatagatgttctttataaagttgaagaaattcccctctatacctagtttattgagagtttttgtcatgaatgtattttggattttgttacatgctttttttgtattcatatgatcatgtgatttttcttctttagactgttgatatgatagattacgttaattgatttttgactgttgaactaaactcacatacctgagataaatcccacctggttttgatgtgtaattctttttctgcattgttggatttgatctgctaatattttgttgaggattttttcatatatgtttatgagcaatattgagatatagttttcttgcaatgtctttgtctggttttggtatcagagtgatgctggactcatagaatgagttagaaagtattctttctgcttctgtcttctggaaaagattgtagagaactggtattaatatcttccttaaatgtatggtagaattcactagttgaaacctgggctttatttgctttttaaattatgtaggaaataaaaagtgaagttagaaaccaaaatactcaaatcctggtttttatatttgcccatgtagtcatctttacttgagatatttatttcctaatgtagctttgtgataccgtctagtgttcttttcttttaacctgaagggcttcctttagcatttttctgtggagtaggctggttggtactgagggcctcagcttttgtttatctgaaaatgtcttaattcttaaattttctctcatttttgaaggacagtttgccagatatagaattcttggttgacacttttattcttttagcattttaaatatgttatcctgctgtctctggctttcagagtttctgctgagaaatcactggataatcttaatgaggatttcttgtaaatgatgagttttttttttttttttttgctgcttttaagattctcttttgtctttcagtaatttgactataatatgtctcagtgtgggtttctgaatgtattcttcttagagttagttgagtttcttatatttctagtttcacatcttgcatcaaacttgggaagttttcggacattatttcatcagattatctccttgccactttctcttagtcttctcctggtgctcttatcctgtgtatgttggttcacatgtgggtgtcccacaggtcccttaggttctgctcatttaatttttttattttctcctcagagtaatttcaattgttttatcttcatattctctgatctttcttctgcctgctcaaatctcctattgaatccttgtagtgaatttttcatttcatttattgtacttttcagctccagaatttttcattattttcctgatttcctttagttctttgtccatgttttcctttacctctttgaatatatttaagactagtttaggctgggcatggtggctcctgcctgtaatcccagcactttgagaggccaaggtgggcagatcacctgaggtcaagagttcgagaccaacctagccaatgtggtgaaaccctgtccctactaaaaatacaaaaaatgagccggacgtggcagagggtgcctgtagtcccagctacttacgaggccgaggcaggagaatcacatgaacctgggaggcagagcttgcagtgagctgagatggcgccattgcactccagcctgggtgacaagaagcagaactccatctcagaaacaaaacaaaacatctcaaaaaaaaaaaaaaaacccactagtagtgttttatagtctttttctagtaagttcagtgtctatgcttacttagggatagtttcttcattttataccttgtgatttttttaattgaaaatggggtatttatacattataatgtggtaacgctggcagtcaaattttcctcttttcccaagctttgttttttttttttttgatatttaatgtcatatatgtttgcctagtgtctttttgcaatgacttttccagagactatattttttgtcatttgtggtcactgaagtccctgtttcttcttattgtttctttctttcttttgagacagggtcttgctctgttgcctgggctggtcttgaactcctgtccttaagagattctcccaaagtagcctcccacagtgttaggattacaggtgtgagccaccatgcccagcctgtttcttaacttgtatatttgacagaaattttcttgaacaccaggaactaaaaccaagaaacaacaaacaagaaaactcctggtcttgaaattgtctctgtgttggggctctcctttgatgcttagccaaacttgaactaaggtttgagatcagctcaaggttaaagtttaaggttttctctggtcttttattttgtaatagtgttttcattttcattcaacttcttttcttatttcccctctcagatcttttctgatcgtgtatctcatcctaggcatacatgtgtctttctgaattctccctattcacgggtgcttttgaatgcactaatttcctaaagacactctctgttttttttttctcccatatcttaggtggtttcaacagtaatcttttgcccagacatctgcaggttgttcctctaccttaccatgatttaaagaaatgcctgctacatttccagcctggataagttctgagttaggtgaaacagagatgtgttccttgtgtcagtccttcaggcagcccacagacaggttagagcagacatatgcggaaatttgtgaatgaggtctgctctgcttcctccagaaccagggaggaaatgggacaagtgtaattaaaaaggcacagagctttcataccattttcttttatttttttgagacagagtctcactctgtcacctagtctggagtgcagtggcatgatcttggctcactgcaacctccttctcccaggttcaagcaattctcctgcctcagcctctgaggtagatgggattacaggtgtgcaccacgctcggctaatttttgtatttttagtagagacagggttttgccattttggccaggctggtcttgaactcctgacctcaggtgatccgcccaccttggcctcccaaaatgatgggattacaggtgtgagccaccacatctggccatttttttttgttcttttagagacagagtgtcactatgttgcccaggcaggtctcaaactcctgggcttaagcagtcctccactttggcctcctgagtagctgggactacattgtctttttattgttgatttctagggcctggcttgtgacttgcctatttatttcctttcctttccttttttttttatttgagatggagtctcactctgttgcctagagtggtggtgcaatcttggctcactgcaacctctgcctcctgggttcaagtgattctccttcctcaagccttctgagtagctgggagtacaggtgcctgcaaccacgcctggctaatttttgtattttttagtagagatgaggtttcaccatgttggccaggctggtcttgaactcctgacctcaagtggtctgcctgcccgacctcccaaagtgctgggattacaggtgtgagccactgtgccgggccatgtttttattcatgaatggatattaaattttttcaggtattttctctacatctattgagatgttcatatagtttttttcctttatttaataatttcattagttttcacatgctgaaatcaaccttgaattcttgggataaaccccacttggacatgatgtattactgtttttttgagatggagtgttgctctgtcacccgggctggagtgcagtggcatgatttcagctcactgcaagctccgcctcccgggttcacaccattctcctgcctcagcctcccaagtagctgggactacaggtacccgccaccacacccggctaatttttgtatttttagtagagacagggtttcaccttgtcagccaggatggtctcgatctcttgacctcgtgatctgcccgcctcggcctcccaaagtgctgggattacggtcatgagccaccgcgcctggcctactgtttttgtatatattgctggacttgataatgtgccttacttaaaaagtaaaaatttttcatttatgtttttggtctgtattcttttctgatgatggtccttgtcttgctttggtattggggtaatactggtctcatagaattaagttggaaactcttctaggaggggagatttactagtaattgagctcctactctgtgctgctttatagattccatttcctttactccttggaactatgctaggaggcagtatcgtccctactttgcaggtaaggaaccttaggtcaaaaggcaaagtaatttctcaagggcacgttgccatcatcagtggagccagaatctgattggaagctctgaggactctctaagaccagcccttgaatgctgcctcccactgatggctccctgcggcaaggccggctgtgtctcagctggcggcagccctttggtctgtagtgagtctgtagtagtctagttctgggcctctttggccagtgacagacaggtggattcttcatcttccctgtttcctggagtttgaggggtccttgttaccattctgcaacaaagaagtgttggtgcctccacagaaaccagctttggatggctgctgaggacaaatccccattgtggatagaactgggaattgcctggatactcagtatggataatctctctctttctaggatgcttggatattaattcatctgtgaaaggggctcgttttgtcagattctgtgatgcattcaatattccactcatcacttttgttgatgtccctggctttctacctggtaagtttttgacagagtgggggctaggagagttgcctttcccagtaaggtgcccactttatttggagatcttcttgcagaactccccgaggacttgtgacttctccatgtattctgggtgtccagaagatagggctgtgtaaggaatggccctctccagaggtgggaaagacctcacagctgagagtggcaggataaccatgtgaggacttgtgggtatctagtaactcttcctcatgtctaggcacagcacaggaatacgggggcatcatccggcatggtgccaagcttctctacgcatttgctgaggcaactgtacccaaagtcacagtcatcaccaggaaggtgaggacctcatgttggaggccatgaccctgctcactttcctacagcatagccgtggtgggaggtctggcagagttttaccagggctggaaggagtacaccttgctcatccttaaaaagatctcttgaggatgttgttcccagccccgcagaaatgtctgtgcttttttaacacaggggaactgaaggcagtagtgggaaaaagccagaaaagataatgagcattaactttgaaaggtcttacagaccgtgggccttcaggagcccagtagggctattcttgttctttgtcccaattttacctggtttcctggggtctttcagggacatgatctggctgtctcaggctctaacactcagcatttggatctgttttaggcctatggaggtgcctatgatgtcatgagctctaagcacctttgtggtgataccaactatgcctggcccaccgcagagattgcagtcatgggagcaaaggtgagggcctcttgcttttccctttctgggtccaaggactcgactctaccagcgagagctcaaggcatagctgggaaatgttggagagaggccagggcccctaggttgagccaggactgaggtgaatgggacctagaccttggtaagtctccctcttggggctccagagatagctctgcctcctgtcctataccctttcttcaggcccacgctggtgtcttcatgccaaggtgggtgcggcaggtgaaaggaaagtgagaggggtccagagtggttttgagattgtaagtaaagggggcaaagggttgagtcaactgaagtcaccttcagaagtattggacattctcccagctccacctcagcttccagggagggccccagagctactcttttaagctcataagaagctaaactgtaggtccgaccctagtgacgttggacaaggtacttcctattgcttgacctattcctcactcctccctgctttgaagtagctattgtggtcgaatcagataacttccaggtcccctagagttgacttataggtgctctgacttgaaggccaatccttctaatttccagttcagtctggtcgcctctggccaccgaattgtatactcaggtcttagggtaccgaaaaagggaaatagcacatttaattccccttgatacaagaccatggatttaataatggaaaacagggctaacatctttggctcaaagaaatatgatgagtgcaaatggagatggtagaatgggctctggggagagaagctactggcttttgcctgactgccccttattggggccacagggaagcatcacatcccatcatgcagccccttgtgtcatgatggtcagccccaggcagttcctccctctatgctatggcctttagagatggcacttcccctcagtacactgatttaccaagaaatttgcacccacacacagtgataatgagttgaaggagatctgtccaggttgggacgaccaaagatgttcatgaactcctctaatcacagggcgctgtggagatcatcttcaaagggcatgagaatgtggaagctgctcaggcagagtacatcgagaagtttgccaaccctttccctgcagcagtgcgaggtaggggactgtggtgaagagggcagctttgtttgtttggtcaacttgctcattctttctctacagaaattgtcacataactgcctttttgcctttgcagtctaatctgttgactagtgagggttgggactgtccctgggcagtcatcacttggactaaggactgtgggacaggctgctttggtaaccacaattaaaacaacattgccaaagtgtattaaatttctaggtgttgttccagttgtctagtgctgtgcagaaattcaccctataactcaacagcttaaactaaccaccgtttcccccactgcttatggttctgtggggtccacaatttggtctgggcccagctgagtggttcttgtgctggtcttgcctgggatcacccacacaggtatagtcattctgtggcttgaccggggcttgacagtccaaaatggcgtcacttacttggtagttgctgttagctagactcactccccacgtggcctctcacccttgaggaggctagtccaggcttccttacatggtgtcccgagagtagcaagggggcaaagggaaactgaggcctagatttggaagttgcacagtgtcatttttgccacattttataggccaagaaaactcaacaaggttaagcgaaggaatacaaatccacctcttgaagagagaagtggtaaagtcacattgcaggacttgtgtacaaggatgaattgttatagccatttttgaaaacctagatgtattttctttatttcctattgaattcattgtggcaggatggaggcattggagcaagcagggtatagggagggtgtccgattttccttttcttgccaagtgctcctaggccagaagttggggagctgtcagaacaggccagctcctgggatacaagggggaattcacagggcctaccatctctgtatcaggttgggcactgcttatactgctggccccagggatggtgcccaggctgagcagaaggttgaggggtggcatcatctcgggatgcagatgatccactcccttttctgtgcttcaccagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 37770 - DNA, 35768 bp, Homo sapiens
agtctggacagtcatggcggcgactgtggcgacggcggcagctgtggccccggcgccagcgcccggcacggacagcgcctcttcggtgcactggttccgcaaagggctgcgactccacgacaacccggcgttgctggcggccgtgcgcggggcgcgctgcgtgcgctgcgtttacattctcgacccgtggttcgcggcctcctcctcagtcgggatcaaccgatggaggtgaggggacccggggctgggtggcggggacgcagccaggaccctgaccctggggtgaccggcgaacagcacgatccccccaaccccgccacggctggaaggccagaggggagaagccgagaccggggaagtaattcgtcatggtcctaacgcgccggtgggccagggttcagcctctgacaaagcgcgttcgcactgttacccctttgagcctcacaactgcctgtggaacggagatcatgatccccgttgtacagatgagacccttgagccctggagacccaaagtcgacctgcccaaggacttgtagccagtgagtggcagaacaggggctcctggtctagggctcttacggtctactcagggaggggcggaagggagataacgtagtgtgagggcgggacgggtttttgctcgcattcttcaagagcccgttgctgggctcggggagatcactccgaagcctctggctcgtttgaatccgccctaccacccatcctggctaccctgcacccagaccgtcctgcctctaggggtgtcaagtgaccctggcttagcattaaataaggtcttctcccctatattataaataaagaagccaaaggcgtcttcaggtggagtcgctttatgttcaaagctccagagaatccaggggattctccaaaatgttttaagccctgctctggagctttgacctcgatagaaaaatttaaaagaatccaaagtgtcaccccgtcatcctcttgtcatgattttagaggacagtagagccattagagatgagacttttatgaactgttgtggtaaggttagggagcaggaaagccatgatatcaagggcccctctgatgaccccccaggagatggagtcgacatgatcatggaaaaagatgaacaggtcgttagtgtattttcactgtaaacagtattcaaactaaagagttttgagacataatgtacccatcgctcttcagaacacctagtggcagtcgctcggtttgtttgcattgttctggggaatgtttgcttgtggccttgttgcatcgatggacagggttatttccaggataccgtggctctcggcacaccattcttttctctccaaggtgtgtgccctgctaagagagtgagtgctgctagcagtgggcctgttcagtgtcccctcctgcccagaaggaacaactaaggagtcctgtggagagcctgcccacagttttcaggctgccttattgctctgtctctgctccagttttctacagataggaggttgggtttgacaagcatcatcaaatgaccatccctagtgtgcacattaagccaagcctcagactttgccctgcaccagtcggagccaggcaaatggaatccgactaccttcttgttacattgtcacagagtttcttcttttattgggttttgggggacattgcatagtactgcctactcttttttgatagggaagattaaaaatcaacaataaaattcctgttgattaaactccagtttgctaggaaccaggtgtttatggatttttgtgggtcatcattttgtgatcgtgctatcaatctagtgaagaagaaaaggaatgtggctcagatgcctgagtcaaatcctgaagtcagaggctgtgtaagaatgcagatattaattgatcacttaataagtgcctaatatctgccaggtactgctctagatgttgctagggatacagcagtgaataagcagatgtgtctgtgctccagaactcctggagcctacattttaccaacaaacaaccataatttagtgaaacgaagtgccatgagaaacataagataaggggacagactagagcagtggttctcaatcttggctgctgtgcattggaatcccataagggtctttaaaagatacctgggcccctttcccccaattctatttttttttttttttgagacggagttttgttcttgttgcccaggctagagtacaatggcgcagtctggactcactgcaacctccacctcccgggttcaagcaattctcctgcctcagtctcccaagtagccaggattacaggtggccatcgccacacctggctaattattttgtatttttagtagagacagggtttcaccatgttggctaggctggtctcaaactcctgacctcaggtgatctgcccaccttggtctcccaaactgctgggattacagggcatgagccactgtgcccagcccctttctcccagttctgttagaattgttctgggttatggcctgggcattaaggtttggggattttttgttttgttttgttttttgtttttttttttttttgagacggggtcctgctcaagtgacaacccaagctgaaatgcagtggcatgatcatagctcactgcagccttgacctcctgggctcagcgatcctcctgccttagcctcccaagtagctgggactgcaggcatgcaccaccatgcctggctaatttttgtattttttgtagagatggggtttcaccatgttctccaggctggtcttgaactcatgggcttaagcaatcacctgcgtcaacctcccgaagtgctgtgattgcaagtatgagccactgtgcccggccttgggcattaaggtttttaaagctcttattgcagcaaagcttaagaagcactggactagagaacctcagtcctgagacgggcaacctaggaagtatgttgcagtgcattggcaggaagtctaattaatgttggcattcagaagaaagagatgaagtaacacaaacagattgaatataataactgctcctgggcctggaaacagacacactcctaccacctccaccattctgcttgcttcctggatcagttgaaggcagagctgcattctcttttgtgcacaaagttggggatagaggggagggctggagccagccatatcttgacatgactgtagtatgtgtaatcgtcccgtggttgtttctggattccaagagtggtctaagagaattgtgctgcagcataatgtcctagctctgcaactgcttaagttgtctctgagaagcctccctgggaagggcaagggaccatctgcaaggaggggaggacccaaaatctgtgactctgtttccctcctgctccttctacactgactcccacacaatgtttttctgcagaggaaatcagattaaaataactatgaatggcactaagagtaaaaacggacagagaaatgcaaccaagaaatacacatattgattagcaagaagaagcctagcatacttcttgccctggtgatggtgggaagtttacgggctaattgtagctatatgagcctcaggactttttttttttttttccaagtgctacttggctaagccctttcacattttccccagcctcaccttccccagatttgctacatctagaaggaggtactgcagcaagaagataaactaaaggaagatgtgagcagttcctagattttaaaatgacctctgtggtttttcattacctttctctccccactgcaacttggataggtgttagcaacagttcctcttccactttatttaaatcattttgtccctggctctgtgctgcgcctctttcaggagcttctgggacagagggaatttgtagaaataaaatatgttccctctcagcccatttctcttagaattggtaaatgaggtaaactgggaacttcccaggatgccccatgagaacaagtgtgtctctcttcccagatgctgagagctgaacactgttggactgttgggaagtggattgagaacgctagtctactggcagggaaacaggagcttctctgagctattcacattggtacctgagagaggcactttactgttctgctgccaaggaaatgtttctgtttgcccaaaggggataaaaaccttcatctttctctttgaaattaggaaagaataaatatatttttaaaataataagaatttaatatttaagtatttctaaatatcactcagatacttagaaataaatccctgccagagattgtgagtttaggttatccttttccatggggcttaagctctcttaattacttaggaaaaattaatttctattaatatcctatgtagccaatctgtgccagccagtggtatcatcatcgttgttagataaccttgccttgaagcagaggaacttggtcaaggacagcctggacccaaaagaattcactgttatcctccctccccccattaacaacaaataaataaaatattcctcaacacaggatcagccattcctagagaaggccttccctaaatatgagtacttaatcaaaggatctgcttgttttattctaaaaggctagccttgtagagtccctgagttatagtgtcctctctatatttttggaaatcccagtctggttttctccagttctgcctgcctctggctccagagcacttacataataatgtaattcagttgcacatgttgtctaatccaaagggtaagctttgctctcccaggaccatgtgctctgaattttggccatgtgagctcagctaagagctgccaagggtgaagtgccagcccccaacaccaccatctccaatgcccaggccagtttccttcagagtcccctcattggagtaaagagaaattggagtaaagaggagggttctaagggaccacagaaggcccaaggttctctctggtgaaagaatgcatatacctgcccactgagcctttgcccagtcgcagcactgctccaaatgtgagggacagctgtcacctggcaggcctcaaaggtagtaccctagtggtggcttctcattctctgcattctctggctgcctggagtctggagatactggggaccctcctcacatccctgtctattgcctccgtgtggtggctgtcctgagccctcccttcccgggttgactcgggagggaagttggaagaagcagagcatttctagcaggccaaaggggaggcagaaatatggatgctcaagagagaaagtttagtacaaacaaactagaagcaaagaaaggcaacttgtaacagagactagaagtaaagttcagttttctagagtagtgcttgtgaaactttaatatgcaaatgaatcaccaggggatcttgctaaaatacagattctaattttggaggtctgggttagagcctgagattctgcatttcaacagactcctgggtgtttcacagccaatgctgctgattgtcagaccacactcagaggaggaaagatctggcagcagaggtgttgctggcctttgagttggcctgtggtgctccctaatggctgagcccagggcagcacagcctcagtgctctgtttgttgagaggcagtggctggctaaaaacgaacatgtcaagcctgacagattgcctaggtttgaattctggccacttactaggtatatgatgttgggcaagtttcataatctctctatgcctcagttccctcatctataaaatgggaataataatattacctacttgattgggctgtttgagaattaaatgaggtaatgtatgtgaaacaagtagaatagtgcctgtcattgtaaatgcttattaaatgttaatcattgccattattatcattatttttatttagttgctgggttcagagttgggccttctaccagcctcacatctctgcttcctgctataaacatcttttgtgaaagaagaaaagggctctcataggattagctgtactttagagatgctacgaggaatctctccttttagtaaatgaggtctaaaaataaagttctatagaaggcagattgctacatgttctggaacctagatttcatgtgcattccaaccttatttatagcttcaaatcaaagtcctatgcagcctggtggactgtgaaggaaaagacccccaaagcgcatggcaaggacactcctgggagctgcagatggaggaccctgtgtcctggggttatgaaatttaaatcactgctcctagccctaggcattctacctggcagggtccaggtttcagatggcatgagaccatttgcatggatttctcttcttttccttccagaagagtggtgaggcttgggggaggccaacacaagtgacgcacttgcagctccctgttccttttctggaggtgacaatttttcaaaaacagaaattcacagaggtggagcttttggtttgcataaagcagcattcaacctgtttgtcttccatcccaacctctcagagagtcttcctcatgctcttttgcaaacatgatgctttgagccgaggccagggctcagcccatgctagaatgtgggtcggtggcattggccgtaggagtgtgtcaagttgtgtacgtcagaggcagcagtgggggctggttctagttggcagcctgggaatagtcactgcttctgtaagcctccagtagtcagggaatgtgactgtgatgtgccatttctattgttgacagagaaaaatgctggggatgggtggagacccaaggggtagatagcaggtgcctcagaggtatctgtgacatatgcagattgacctgtgggttcttgaagaagaagataagaatgccagtggattacctgtagtcacattgctattagagaacaggattccaaactcctgagggcctgcagaatctcagcccctggaacagagttggtgtgcaactagaaatctttagaaatggggcacagaaccctcacggtggctcacgcctgtaatcccagcactttggatggctgaggagggcggatcacttgaggtcaggagttcaagaccaacctggccaacatggtgaaaccccatctctactaaaaatattgtttaaaaaattaattgggtgtggtgcacatacctataaccccagctactcggaaagctgaggcaggagaatcgcttgaacctgggttggggaggttgcagtgagccgagattacgccactgcactccagcctgggcgacagagcgagactctgtctcaaaaagtaaataaataaataaaaaagggcacagagaggaaaatgtgggtttcagagtgaccaccctaggttcctgaatccccagctttgtcacttaacagctatggtcttagacaaattaattcacctctgagtgtctcagtttcctcatctataaaataaggatggtactatttccttcaaaatagttgagagaattaaatgcagaaatgcacttaaaaagcatgacagaaccaaaatcccattgataaccttggttgcctctggggagtgagggaggggaaaaccctttctactatgtaccactttgtcactggaattttgagccacatgaatagtttatctggttataatgttaatttaatttaaaaataaaacgctgaaggcactcagcaaatgttaatgtcctttccctttcccctggtgatccaggtctcctgctgaagttcttgcctagctgcggtcttccccacccccacccccacaaaaatgtgaagatagctattgagaagtaccttttaaggccttctccctcttgggatgagaacctgatcaccagagccctggagaggcctggagagtgagccacctgccaaacaaagctctgggaactagggacccattgcaggctgtgaggctgtggcagcagaaatacgcatggcccagagcatgcatgcagaaagtcaaggagtcttttccaccagagtaaggaggattttcccggctgtggcagtctggtcctctgctaagaggaccttaatgcttcataccacagtattgcactggcttttcagatggctcccacgtgagtctcacaacaacctcatgctgggcagatacttatatctagccccagagactgcgagggagtaagtgactagcctctgatcacacagaaacaccacactaggaacagctcacatttatctcatgatgtctgtgtgccaggcacagtgctaaatgtttttcacacattattcgattttcttttcttagcaattttatgagatgggtactaacatcagcttcacattaccggcgagaaaacaggcaaagaggttaggttattgcctaaagtcacacagctagtaagtggcaagaccagggtttgaagcagagcagcgctgatccactaccacatccctcctgggctggaacccaggcctctccagccctagtgatcatgaggctgcctgttgggcataaacagcgaaccagtttctccctgctttgttaggaaagagagccactcttcatgatgttatcactaacaaggcctgtgtggactccacaggttcctacttcagtctctggaagatttggacacaagtttaaggaaactgaactcccgcctgtttgtagtccggggacagccagccgacgtgttcccaaggctgttcaaggtaagcgtgcagagccccagagaagacagtgagattctgtccctgacggtttccccacagcctgagtgatatgatattccgactgagggaatggaaacatcagggctggtctggctgttgctgctagagaagttgggagcaaaggcagccagttagcttgctcttggaatggaaactgtgttaaggaaaaaaattctgggaaaccagtgtcttgttggaaagctctcagctcagtccagacataggatgtggtaagtcattccactctggatgccactggcttccttcaatgttttcttggctcaagccagccagatttattagggttccttctaggccaagactttgaggtggggtttcatgtctagcaaggtacatttcccatcttgctttgctctgcttattgggaaaagtcagccttttctgccgggcgaggtggctcacgcctgtaatcccagcactttgggaggccgaggcaggcggatcacgaggtcaggagatccaggccatcctggctaacatggtgaaaccccgtctctactaaaaatacaaaaaattagctgggcatgttggctggcacctgtagtcccagctactcgagaggctgaggcaggagaatggtgtgaacccgggaggcggagctttcagtgagccgagattgtgccactgcactccagcctgggcaacagagcgagactccgtctcaaaaaaaaaaaaaaaaaggtcagcctttctgaggaagctttcttgtttcccatggggtaaatgattgatagaaatcttcattttggtgccacataggtttctgtttgcagtaacggggccagtccacttttccctcaatccctttaaaaagtatattctaaggcccacatagaagcacaggaactcatggacagagggctgtgggacagactgccatcaccctcagcagcacacaatgattgtcatgcccctccccaccctaactccgagacaaaaggaaaagtcatgtcaaggcaaacagcttagtgaatacatcatccttcaattcccctccccgtaaccccacacataattgtgcatacatgtacaaatcacacagtgctagtaattgcccacattcattgagggctgcctatgagtcaagcgctgttcccagtgcttgtttacatcaactgagttcttcctcacagcaggcctaagaggtggctactgctatcccgatttacaggagaggaaacagtcattggttgtgaagttaataagtgacgatcttggattctgactctagagctgtatccttacccaccataccatataaatacatttgcctcccttctcccctcgacattgccctttttctcccccagcaactcagaggccaacccacttatatcccagagatatagctaggtcatccattcagtcatgtaatgtatttttattgagcttctgctaggtactaggccccatactaggtataagggtaatgatgatgagtgagacaacatggtttctgctctgagagttcacactaataggggaaacaggcaagtgtatcattgtcatataatacatgctgcagtggaaaaaagacaaggtgcagaagaattatattgaaggaggaggtcaagaaggcttcttggagaaaatgtaatttaataatattgttattcacaggttacaatgagtattcagtgatgtaacctatatgaactataagcatggtacctggcatatagcaagggctcaatcaatgtttaatgctgatatcctcgaatgagggataactggccctgctaaggacccagtccccgggcagggctgagtcaggaccagaccagcctgtgcatggctaggacatttgcccctgtggttcagagctttcagagactatgaccagagactttggagaatgtgtttttcttcttgcaagttgcatgctctagggctttctgtgggttgactgtacaaccattcactgggccagcttgctatgagatctagaaattcctaccagaaatgactaaaggcttaggaaagaacttcctccttttcaacatgtagcccctctggtcagtttcctctgacctccagactaaggatcgcttcccctttcctgactctctcagggctggaacctattagctctgtttgctattggcctcaggagtgttgctgtggaaacaattaagacacttcacatagcacaactctgccaagaaaactaggccacaagtctgcagggctgtgaggagctctgggaaaagcttgctgagcaggcagaaggctgtggtcctgtcccacctgtgagtcagtgccactctctgggactgggggtttcccaggagcgttgtatttatggcctcctgctgcattctcctacctcaaggacacagcaagtgcacaaggctgcctacctctctcccaactccactgttgctgtgctgttggcttcgccacactgcctgccctcctcaaactttctgaacctcagcttgtttgctttccagatcaaatccctgttcctagttttttctgctgcccatcagataggtctctagactagctctgttctctcccaggaaggaactgagagtccagcttccccctcctccccaaacacagtgttgagcataacagatcctctccccacaggaatggggagtgacccgcttgacctttgaatatgactctgaaccctttgggaaagaacgggatgcagccatcatgaagatggccaaggaggctggtgtggaagtagtgacggagaattctcataccctctatgacctggacaggtaagagatggggcccagggatcaggttaccaattgtgagagttagtaatttgggcccctgctgagcggaactcagagaggttcagcattagggctacctgacccaggaggcatggcatcttctagaagctggaggagaataggccagagtcaggacctgtagaacaggtcacaaagagctttaccccattgaggtggcagagaggcttgttaggcccaaagcatggaagcagtgaggacccacactcagggtatttacaaatctgctcctagtatgcccgagtcccacctgtgcctcatattcccacttccatcctgctcaacagctgccctctgacctcagtggaccctgtctgttacccctccaacagacctctgttcacacaggtccagtttttgtacctaagatgagttcctaggctgggcatgctggctcatgcctgtaatcccagcactttgagaggatcacatgagtccatgagttcaagatcagcctgggcaacatagtgagacccccgtctctactaaaaataaatatattagccatgcatggtgggacatgcctgtagtcccaattactgaagaggctgaggttggaggatcacttgagcccaggggcttgaggctgccatgagctgtgatcatgccacgtcactccagcctgggtgacagagcaagatcctgtgtcaaaaaaaaaaaaaaaagagttcccaggttctatgactatctgggtttccaggccatgttgcttggtggcggggagggctctagagatccctgcagggagctgctaactacagaggagcctcctcccctggtgacagcctctgtgctttcagagattctaggaggaaatcctctcctccccttccctgccatgccagagctgtcaccctcctgctgctgctgctgctgttgctgctgctgccaagccagcagccgccgccgctccccacccccacttcccaacccagtgctggctgccaagaagccaggtcacacagctgtgcacgtgagccgggccctcaggaggagaggctgggtgtggagatcctcctcctgctgcgtgccagaggagagggaggcatagcagaggcagcagccgaccatatatctccactaacgtggggagagcaaactgagaaatgaactcacccagccagatgggccttgcgtaagctacttcttggccaagaagagccccgggaatgtggctccataccatcccaattcatccttatataaacagcctccgttctcttcttcgccctctgatactccttccttcttgcatgagtgcagttatgttttccctggtcatgaaaaatactttgtaaactacaagactctctttaagtatcagttgtggctatgaactctagctccagtctctgaatttgggaggataagctgtcttccacctctctgttcaatgttctaataaatggaggctaagaaggggatgattttccaagaaaggaacatgtctgctattccttatgatgttagagttaaaaaaaaaaaaaaaaaaaacatgtcttcagctcttatcaaagaactttctccagggcttacatgggtggtagaggcctatggggattcccttagcttggacagataggccaagtgccaagcaggctagtagggatttttctgtgattagagattttgtcagtctctgtctttaggcggctctgcgtcaacaccagggagcccggaattgagtcccagctctggccctgccttgctccattactgaggcacctgcttcagctctctgggctttattttccctctcggtaaaatggagatgcggcctcccttgccccctcctttccactcaggcatgggacctgtgagtggatgaggaaagccaccctcaaagccttcagagtctgggttcttttttgggtgggcagggacccacatcacagggccatgtgggtaacactagctatgctttgggctccccaggatcattgagctgaatgggcagaagccaccccttacatacaagcgctttcaggccatcatcagccgcatggagctgcccaagaagccagtgggcttggtgaccagccagcagatggagagctgcagggccgagatccaggagaaccacgacgagacctacggcgtgccctccctggaggagctgggtgcgtacttcctgcccagagccacttgtgctggtgcctgcttttgtgtaaagaaattctttgtgaaagtaatgcatgtcattatagaaaggttagaaagcacaggaaaacaaaaatggaaatggcagtcactattactccaccacccagaggtaaccacaattaattttaaactgtgtccttctagtatttgttctgttcatactcatacatgtaatcttctgtttctggttctagatcatgcctctatttttgtactaacctctcgcagacaatacaggcactgcctggtgctggtgtccatgggcttctcagtaacaagatagctagtattgcttctgttgaaagcagggaatctgtcagcctctcagattactaactacactctttcacccctccctctttcttaccttttttttttcttttttagacggagtctggctctgttgcccagtctggagtgcagtggcacagtcttggctcactgcaacctccacctcccgggttcaagcaattctgctgccccagcctcctgagtagctgggactacaggcgcctgccatcacgcccagctaatatttgtatttttagtagagacggggtttcaccatgttggccaggctggtcttgaactggtgacctcgagtgatccacccacatcggcctcccaaagtgctgggattacagacgtgagccacacctccagtcttttgatctgaacaaagctattagcctttttcacctgaaaaccacagttgttgccagctaatctgaaaaggcaggaggtccgggattgttgtcatctacctggagcgatgagggtgcaggggaaagcagagaaaatagtgactgtgggaagagaaccaagttgacctagaaaacgctaaaactttaaggattatctaacccccagtagcaccgagacactgtggttcaattctcataaagttcaaataacagaacagccgtgccgggctatcactgaaatggtcaaacctcctgtcttgtgacctttccttctcttcagggttccccactgaaggacttggtccagctgtctggcagggaggagagacagaagctctggcccgcctggataagcacttggaacggaaggtatgggccgtttctgagacacagagctgcagatactgatatccacacagcaggagatacaggtcatgtccatgtcctttagtccctcttagctcacattgtttggaaaatgaaaaatcctcctatcctcctgatggccataacaacagcaacactaacagcaactaccatttagagagtacttaccatgtgctggtcactaggctcagcatttttgggttaagcacctgctggcatttcttttaatctttccaatagcctgcaaggtaggtactaagctgttcattctacagattacaaaattgaggcttagagaggttaagtaacttgcctgaggtcacaaagttagtaattacaggttgagtatcccttatccaaagtgcttgggaccaaaagtgtttcagattttagattcttgaattaggaatgctcaccttataacacagtaagaccttgttctatgttattctaaagctatgtcggattgcttttctttcatctgtgggcaggttccccctactaagaggatatctggttagtaaaatctataagattattttgtgttgatgtgtctccgcacctttttgctggaactctttcagcgtgttgatttccatatgcttggacacagagcaaatggcccacctcccagtgcagtgagaactggggaggaaagaagcccaggcctcagaggcacagtgtcacaaagtcctcactcccctgcagctagaggagcagagaaagttctcatgtccgagaacagtcagctcctagtttcctgccccctgcagctggtttataaaatgtcagctttttctatgcctgctaagatggctaggtattttgcctagcagccagatgatgacgataatagaacaaggaggccaaggcaaatctacttgggaagaatgttctccagccctggaggtgtccagtcaacagtgaaggcccacagcctcgatgtttctacctggttgtttccttcagcctgggacgaaagcaagccccacagacttaaaggatgagactagctatctctgtccacatcaaaaggttcacctagagattcttgggcccagtttgaagacaaaggttgggccaaggggcagaagggtggagatgacaaatgggattgcaggagtagagtaaggcttaaacctgtaaagagctatcatctatggttagtttttatcagctggagaacattttgtagaaggatgtcccttaggtcaccgacaggagctccttttccacatacccccagagagcgggccccttctctcaagggcccttacgccatggacatattcagactcagtggtgcccagaggaaatactgtgtcctgcacatctgggagaacaaatggtgctagagatacaggagttgaacctgatttcaggatgtttattttagcttccttcagttctccaaatctgaagggagcacctactcatgccagtttagcaatactagatagaagaaggtatgtgcctcttttccgaaagcaccaggaaaagtcccaaggcatgttttcattgtcctggtttgggtcatgtgactgtccctgactcaatgactgtggccaggtataggaggtggtgctttccctggccagacttgcatcatgagtccgctcccagaactggaaggtaggtttagctctgctttatccactcggactaggatcagggaaggctgattctccacaggaatatgagatgctgttactgaaaagcagaggaagctacatgatctttaccactgggttactcaatagtagatgagggcaagcatctctctataaaagtattctgattattaaattaaaaaggaatggtggaatttgaataccaccattttgtaaccctcaataatgatgcattatgtattggtgactgctgacaccatagaaggaggcaagcattatgtgccccctgtagtcttgtcaaagggatcaaacctgagtccagtccagtttctggtactagccaccaatgtgcaggtgatacacaggacacagcacttgttgaactgcaccatgagtatacagtcagcaaaatccagactgtgggaatcttggcaagtcagatggcctggattctttcccagaacaatggaaaggaaaagaaaaaaatggcataaaatgtgcagattaaaagaaaattaaataacatattaaagttttttttaaggccaggcacagtgactcacacctgtaatcttagcactttgggaggccaaggcaggaggatctcttgaacctaggagttcaaaaccagcctgggcaacatgacaagccctcatctctaaataaaaacaaattagccgggtgtggcagcatgtgcctgtagtgccaactacttgggaggctgaggtgggagaatcacttaagcccaggaagtcatgccactgcactcctgcctgggtgacagagagtggggtctcagaaataaaagaaaaagaatcccagcactttgggaggccgaggcaggtggagcacttgaagtcaggagttcgagaccagcctggccaacatagtgaaacctcatctctactaaaaatacaaaaactagttaggcatggtggcgagtgcctgtaatcccagctacttgggaggttgaggcacgagaatcgcttgaacctgggaggcggaggttgcagtgagacgagatcatgccactgcactccagcctggttgacagaatgagactctgtctcaaaaaaaaaagaaaactgagtagctgggattacaggctcccacaatcatgcctggctaattgttgtccttttagtagagacagggtttcaccctgttggcctgactggtctcaaactcctgaccgcaagtgatcctcctgcctcagcctcccaaagtgctggaattacaggcatgagccaccacacccgggcagaaataaagttttttaaatggccaagactaaattgtaatacctaggaatgcacatttgggtaaaaaaaaaaaagctacttaaacacaaagaataactgtgaaaagataaagtccttcctttcaaacgttttgccaaaatagaaaaatgtaaacatttcagaaatgcagaacgtgtttattataaaagctgaggtaggggttgcatatactggggggcaggagggaactattcctgggatgagcacatagactcttggggtggctgtcaaagctctgtttcccaaaccttggtggctattgcgtggatgtttgccttagaataattcattaagtcacacatgtgtgtgattttctgtatccaagtttcatttaaaataaaaatattttaaaagctgggggctagcaagggtgtgtacacgcaaaaatacctagtatctgttagaagtgcttaacctgataccacaggggttacctgcagaggaggaagccttgaggttgcgacttgaaggaagagtctcagttaaccaggtgaaggtgagggaaaggaagacagtggtccagaggcagctgcttgtgcagaggcaaaggccagtgagagcagatgcgtaaagaagaggggcagcaggaggcggagggtacagtgagccgagatcacaccactgcactccaccctgaccctgtctcaaaaaaaaggggcaagagacagagctggaaaggcctgggtgctggggagccacagaagctttcatgaagatttgggctctgtcctcagagcaacaggaagcccactgtgtacattatcccgagcaacaggcattacattactctggtcccagcgtggagaatgagttagcgggggatgggagtggacgcagggaggccagtcaggaggctgccacagttgtccagtctagatatgaccttagcctgaaccaggttggtggcagcagggaatggaaagaaaaggacagatttgggaaatatttaggcagtagaattgacaggacttggtgaggggacaaaggtgatggctaggattgtgccttgggcagctaggtagctagcagtgtattatctgaggtagggaggccaatggaagggtgggttaaaagaaaagggcacatctcccttgagctgcctgagaggcagccaagtagaggtttctagcaggcagctgggtggagcaatctgggctagagctatggatgtggtggttgtctgcaaaggggtggaactgggagccatgggcctggatgagcttgctgaggcacacagttgagtagagaacctagagctgagccctgggtacccacatttaagggagaggcagaggaggtggagctgatgaaagaccaagagcgccaggcagctgggagataccaggagatgtggagtcacagaggccaaggaatcaagaggataagacagcacagttggcaggtatagcgctgctgagagatcccaaaatacaaggtcagaaagtgcctgcaggactcagtggcacagaagtcacaggagactcttgtgggaaccagccttgtggtcacctgaggtttggagttagagaccagcctggccaacatggcgaaaccccatgtctactaaaaatacaaaaattagccaggtgtggtggcaggtgcctataatcccagctactcaggaggctgaagagagtcaaggttgtgaaacagtatcatggagaggaggagaggatgttgggagttaagaaagtggaaataggccgggcacagtggctcacacctataatcccagcactttgggaggccaaggtgggcgatcaggagaatcccttgaacccgggaggtggaggttgcggtgagccgagatcacgccactgcactccagcctgggtgacaagagcaaaactctgtctcaaaaaagaaaaaaaaataaataaaaaaagtcgtgagagactgcatggaacagcaagtcaggaaagtaaagtcctatgccagcaaccagtgatgataaaaacatgaccagtaatgttatatgacacatggccccagaaatgaatgattccattggtccccaggaatggattggaagtttcctccttccccagctgctgttgaacaataatgcgaagtccctggtgtctgtgatacaacctcagggccgctagtgactagagaagggactgagatattcttttctgtaacatagaagccttgtttcctgctgtataattagagagttcattcagtgctttcagaattctttcatatctcattttaatccacagaagattggaaattttgttcttatttaatagatacgtagctgagggaagtaacaacgtgttcacagtcaccccacaaattaaagagcaagtcagagaatgacatagactcgttgtttggtctgatggtggttccgtctcaaaatcggctggacaagcacagtgttccatggctccatggctggctgttctgtgaccgtaggcagattccttaaccacccaatgcctccattttttcctctgttacatccaagcctttccttttgccaccttctctttctgctgtaggcctgggttgccaactatgagagaccccgaatgaacgccaactccctcctggccagccccacaggcctcagcccctacctgcgctttggttgtctctcctgccgcctcttctactaccgcctgtgggacctgtataaaaaggtaagggggacatacctgcccacattgcacctaaggcctgcagccaggccttttgggcttgtcagtcaccctaaaaaaggcactggtgggtgggggttgggctatggcccctggaagggcctaagtgtgtgcagatagtccggaggaggagagaagactcaatatccaagagggcagagccaagcacagagtgaactgcccaccagaatgaagcccagaccatcatgtagagcagaaggacaggcagaaaagcaggcctcaggtgtgaccctagaggtggcatatcctctggcagctggtggacaggggcgaggtccccagggtgagaggcatggagagggtgaggctggagccagtctgaagtggaagagcatagctgcccgctctggagctgtgtccacagcattcaaaaggggagtccaggaacagcagttgcccatcagtgatggagggagtggtgtggaggggctgcacacagggctgtgctatacagacaagaagcaaataagcctgtgttaactgtccccagaaggagagagggcaacacagtcagcattcagagggatcacctcatcttgtgcctatgttttttgtttctgttgtttatttaagagacaaagtctagctgtgttacccaggctagagtgtagtgtggcctgatcacagctcactgaaacctcagactcctgggctcaagcaatccctctgcctcagcctctcaagtagagctaattttttacattctttgtagagatagggtcttgctatgttgcccaggctggtctcgaactcctgggcacaagcaattgtcctgccttggcctcccacagtgctgggattacagccgtgagccaccatgcctagccgttgtgtctacatttgtttttttgtttgtttttgagacaggatctcattctgtcacccaggctggagtacagtggtatgatcacagctcactgcagccacaacctttcaggctcaggtgatcctcctatctcagcctccccagcagttgggactataggtgcatgccaccacacctggctaattttttgtatttttttgtagaaactgggtttttccatgttgcccaggctgatctcaaactcctgggctcaggccatccacccacctcagcctctcaaagtgacagatgctagccaccacacctggctgtatctaggtttttaaatgttatctcctcatccttgccattattgagattttgtggcatgggatagctttgccagtttggtgagtaatcttgtgactttagggaagtcattatttgcttggaggtctgatttcttaattaccttatggccccagatccaggctgtgtgtataatttattcaaccaaaatctagactgagcatttttcatgtgtgctgataggaaaattccttttgactttctagaaggtggagccaaacagggaactcttgaggacaaggaacatgaccagtcttgggaagtttgaatcctagtgcagagtcctgtggtgaggccccttcccactgcctggccctctgtagctttcttcttgctcagagcagtggcacagtgcaggcagggcctgggtgtttcacatgcaggcatgctgtgccacttctaggggatagtccctccacatctggcagctgagccactaggtctttggagggcccagattcctttgtagaagagacctgagaggcaccatgctaagagctgggcgagtgtttgtatccatgtgccacccctacctctcaggtgaagcggaacagcacacctcccctctccctatttgggcaactcctatggcgagagttcttctacacggcagctaccaacaaccccaggtttgaccgcatggaggggaaccccatctgcatccagatcccctgggaccgcaatcctgaggccctggccaagtgggctgagggcaagacaggcttcccttggattgatgccatcatgacccaactgaggcaggagggctggatccaccacctggcccggcatgccgtggcctgcttcctgacccgcggggacctctgggtcagctgggagagcggggtccgggtgagtgctctctcaacgaaaagctggcctgtaccctctggtcaggcccgtcaaagggcagcccccttctgggctgagggatgaggtgggatttctgggtccaggagatcccctccagatcctctgtggcttgccttcaatggaagggttttggctcctgggggcactgtggtgacttgggaaaaaacatggctgcatgtccccaaggaggctgatcatcccctcccctatctaggtatttgatgagctgctcctggatgcagatttcagcgtgaacgcaggcagctggatgtggctgtcctgcagtgctttcttccagcagttcttccactgctactgccctgtgggctttggccgtcgcacggaccccagtggggactacatcaggtgaggatacagaccaggctctctggcctctgaccactgtggcctcctactaggatgggataccctgggccttttgaaggagggtctgggtatgctgatgggtcatctggtgtatcttatttcaggcgatacctgcccaaattgaaagcgttcccctctcgatacatctatgagccctggaatgccccagagtcaattcagaaggcagccaagtgcatcattggtgtggactacccacggcccatcgtcaaccatgccgagaccagccggcttaacattgaacgaatgaagcagatttaccagcagctttcgcgctaccggggactctgtaaggagacaaacacctagctcactgaagggaaggacagcacctacaggctcagggggccagatggggatgtccagatacttgcaaagggagactgagtgctgtctttcaggttgacaccttcgctgggtatgggacactgcaggctgggatgaactgggccttcctgagtagttgtggggctgtgggaggaaatggaacctcagtgtcttgctcctaccctccccacccccacttgcttcatcctgccctgtagccctctgcaatcctgcgagacggcactctgattactcctcgcctctctcccaggtctactggcatctgtcccttcctgtgtggaagacctcagtcaccctgtggcagagcccagctcgagccaggctggcagcatgagcagtgcaggtgagcagcagcaaccaacctcctgtggcctcctgtggcctgtgccaccacttcagtcattcaggactgaggccagaaggaggccttgcccagtggagcttatattccacctggggcagtcagatagtaaagaaaccaagttggatcatttcagataacaagtgctttggaggaaaagaaagttgagtatcttgacagagggactgggaaagaaggatttcttctgtgtcacttgagattggagcagtcagggaacacctctgttaagcagagacccacgtcatgagcaggagccagccctgccacacactgagaaaataacattccagacaaagggagtagcaagaaaaagctcacaaacagtaccgagcttagtccattcaaggaaccgaagggaggtcagtgtagcggcatgtcccagtgaggagctggaatgagatgaggacaagatacagcatgagcagcatgtggcaggcctgatgtccgagacgaggactaggattcagccttcagtgcactgaaggatggtcagtagggcagggcatgattggacttaggtctgaaaaagctccctggcctgctgggtggagattggacagtgtaggccggagcgggcacagggaggccagagaggaggcagcacagacagggtggtggccgcaaggagaaagactggacagattcgctgcattcggagcctcttcccttcttggggatgaagatgagtaacatgagatgggaagaacacgggtttttctagttggcccagctaggctgcctccatgggcagcatgactcctccacaggggccctgctctttgctgcttggggaggctgattcagggttgcagagggaatgcctcaccttcaaagcaggacagcaggcaggccaaatcagtctctggccacagcccatgccatttggggcccaaaagctggtcctgctaccagcaggcctgcttggtcatgtcctccttggacatttccaggcaaagtcactgctgaaagcaaggccgaggggcaggtctgaggagcagcatgctggcattccattgataagtgtgctccctgtcccctaaagagctgctgctgcatagtgtgggatcattttggctgcatgcacagtctgtgtgaccctttgacacgcttccctacaggcccaagaccactacccagtggcccagcatcccccaaacgcaagctggaagcagccgaggaaccacctggtgaagaactcagcaaacgggcccgggtggcagagttgccaaccccagagctgccgagcaaggatgcctgagagtgagtgacagcagcctagattcaacctcaggaaggaagttgggagtgggggggcctactgccctgccagctgcaggttgaaacatagcaaactagatgaaaatctggtgggaccacccaatgctcagccactaaagctttaccattttacagtggcagccgggttccatcctggcttagggaatgagtactttctggttgatatctgtgtgacctttaccattgggccggctatggtggctcatgtatgtaatcccagcactttgggaggccaaggtgggaggatcgcttgaggccaggagtacaagaccaacctggccaaaccaacatagtgagactccatctctaaaaacataataataataataataataatctggtgggactgcatgacttttaggatttcagctcaaaaatcccaccattctgacttttatcagagatttaaaagtcaagcccttttgtatttttttgccagctaagggaaaaagggaggcatgggggctgaggggtggcgctttctacctattaaaatgagtcacactcaagagaaagaaagctgagacctgcgtgtgaagcagcggggaaaaggcgcattgcagggtctgaggctgctccaggccccctgctttccgacaggctgtgttctataggccagccagtggagggcagcactgaccttgagaagcctggacagagggctgtgctgtgtcttacttggcccagccctgcctgaggaccagtagacccagtctgtcatcatctttgccttttgcggcctctcctcccttctcacccatcctgtggcctcagctctgcacctccctggcagcgctcatcttggaagcctcctgaatgtcatcaaaacactggcttctcctttcccaagggaggaagggccttttatgccactcttggggaaatgtaaattcctgtcccctctgagtcatcatctcaagctgttccttatgcaccatgtcttcgtcattagattggagggtgatttttctccatggagctgataggttctttttatcagatccctcttacttcagggccaggccgcagccatctggtttgagtgtctggatttgtgtgctcactgagatgggcatttgatgcctgcacccttcacctttcctgggctctttgacatagacattgctgatggacagatgtgtgctatcttgttcctgggagtaccagcaacctactactctctcagttatctcttagctctgtgatactaagcaaagttcatcctgtattacaaatttggaacttgccaggctgacactctgattttcggatgagaagaccaaagaacagagaggttaaatgtctgggtcaaggttgctcagtaagctaatggtgtccaattcaacatgaaattgttgccagcaggtgggtgaagaagggggagcattaaacatataaaatgtgatgtgctgtccatccataaggattgaacagtctgcttagataaaaaggaacaataacctagaattcctggacaaatgatacagactatacaagcttagcagaaggctgctggtgtggtctggaacaatcagggaacatatcacagaagtttgcgctagggggcctgaaaagtgaattggattcaggcagtgagcagggcgcttaggacaagaaaaacagctgaaggtttatgtgatcttgtacaaatgacttaactgctatgggactcagtttcctcacctataaattaggttgctgttgcaagaattaaatgattaaatctgggccgggcgcagtggctcatgcctataatcccagcactttgggaggccgaggtgggtggatcacctgaggttgggggttcgagatcagcctcatcagcttggagaaaccccgtctctactaaaaatacaaaattagctggcatggtgacgtatgcctgtaattccagctactcgggaggctggggcaagagaatcacttgaacccgggaggcagaggttgcagtgagccgagatcgtgccattgcactccagcctgggtgacaagagcaaaactctgtctaaaaaaaaaaaaagattaaatgtgtatgtgtcagctagaaatgtgggggtctattaataatagctcaattactgtggctaaaacaaataggggcttatttttcttacctaacaaggggcccagagatagtgttgctggtctgggcttgggtggcagccccagcttcagccatcaattcttgatcaaagaggaaagagaagggacagcaagggcagctgcactccttccgtacacatgtcaagagctcatgttttgccagacaccattccaggcattgagggtatggttgtatacaagactggcaatatcacttcccccttgggtgcatattagtggaaggagacagacagtaaacaaataaatatttaaaatttaaagaggccagccgggcgtggtggctcacacttgtaatcccagcactttgggaggctgaggcaggtggatcacgaggtcaggagttcgagaccagcctggccaacatggtgaaatgctgtctttactaaaaatacaaaaattagccaggcgtggtggcaggtgcctgtagtcccagctacttcggaggctgaggcaggagaatcacttgaacccgggaggcagaggttgcagtgagccaagatcgtaccactgcactccagcctgggtgacagagctagactcagtctcacaaaaaaaaatttcaggaggccatcagtgctatgaaaacaataaaataaagttgagtaagaaagtaaggtcggggcacagaagaggctgcagttctgtattataagggttgctggtccagggaccatacttggagaatcactgacttagaccaatcataatccattttctgggtgaagcccattgcctcctgaacacattttaggttctgttaaccaggaagtgtggatactggtagacagctaatggtgactgctttataggcaagacacttactcaagtgtgtgggtcatgagtgcttggtaagcagtagttattattgtaggtattgttattattgtagaggacacaaggttacagttgggtctgattatggagggttgtaaatggcaggcacatgagtctgctatgtactctttgggagtgaagaaacattttggaacaggaatgatcaaattggcattttgggaggatgaattaggcattgggctgggacctgcagaggaacaggttggggagagaaagtcagctgagaggcttgacagtgattccaagggaagacatgacaaggatgcagaggtaaatgcccgtctcttgccctggagtccagaagattgtcagcctactgggattttaaggactgattcttgaggtttactctgccctccactggtggctcagtggggagttaggccaggctagactgtgaaggttgggggtgcagaggtcagaggatctggggtggtgcagacttccctccaagacagactagggaggaacagctgtgttctttggaaatcctgagagaagaagagtacaccatgtctcaccatgtgctggcagaggcacctgggcctaaagatgcttagcatcctcagctgtaaaatggtgataatagcatcttgtcacctgccctacccatcgaaaaagtctttgaatatgtaaaatgcactatgcaaatggaatcacattatcatcttgcactttcttctctgggtgtctttgattatgttggtgttacttcagtcagagccagcaccctaagctgaatggaccacagagctgtggctatgtagcccaaattggtatcatattatattgggttgggggaggggagtggcagggagacttgcccctctttcctccatttcctctgtaatttttaattgtgtgactttgggctggatccatagcctttctgccatgctttaggtgtaagatgtgaatagtcattcttcatcagcctgaaggctacatcctgggccttttgaggtctcctttagctctgagctctatagttctggattctgtttttctaatgcctcaggcctgtggcagtgtacagggtgtacagtcacttaaaatttaaactgatctggtaggaaagcatggcctccaatcagtaggttctacacttacctcagatccacaccagctatctgttctgcattaagttttattttacagcattcactaaactgaaaaacaagccagcccccaaatagctattgtttcaaatggttccccataatccccaaagctgctgactgctccggattccattagccttgaattgtgtacagatttctctcattggtccaattattttgccatggggagaacagctcacgtgttccatttgcccttctgctggtacagactgatctgtggagagaagccccactgaatacaaaaggttcccggccaaggatcacctcttcccctcccccgcgggcttttgttagctctgcagtaagcctgactgggtagatcatcgagtaaaacctgacttctggattctccttgatgtctttttgacactagtttagttgtatactctgtccttgtaaggtgaaaggcactagcaattggtaaaatgctaaatagtggaagtgaaggcagtgtggcattggccagagagccctgcattatactcagactagtgtctgcatcccagacctgccagcattacactcaaactagtgtctgtgtcccagacctgccacttgcctcttgtgagactccacccaaatagtctcacctctctgttcctgcctttaaaatcagaggcaggattctctgttcctgcctttaaaatcagaagtttagactcatatcccctagcgctttccctggcacttcataagtaggcgttgactgatggctgtcccttccactttcttgcatgatctgcatgctgtgggaagggtaaaggtgtggttgacctgaggaatgagattgagctcagagcttcagctctctcccccatccaggcccagctgtacttccctgaccctcacttggaagcaggtagcgaaccctctgcctttctcaagctcttgggcactgtgccttgcccaatatgatggggagagggaaacattgagactcggtgacagtctgcaaacaaagtttcctccaaaccatcagctgttgtggaccctctgccagcataaactcatgcctgcacacgtgcatccacccctccagggcgaggagcatagggacgggcagacttatacacttgggttcttgatagcatctaatggatgggaagggatgtgagggcaaaggtacccaggaggccatgctaactaacattgggttgcagagggagacagtcgttaacgctttttgttctagccgccactgtgtttcttgtatcaatgacaggttgaaagagttggacaactaagagattgatttttcagtgaatgttttatgagttgattttcccttggtgcctccccttggctgttcttcccttccctttagtcctgctatcatcatttttttgcaagacctcatttgatttccccagacccctttttctacagacgcatgccctagcttgaggacaagagcatggcaccaactagttatctgctgatcaagcagctcgagtaactagttgaacaggcctttggctagctttgtaggcgaggccaagttggttcttctaaaccttggttttctgcattggtagctttgaaaccatcatagagggacttgggtgactagggcttatctgagtccaggacactgccccctcccttcatgagcctgcccaaaactaactggtgccgaagtcaacatatgtctgaattgttatcattatatccacctgactgtacctcaccctcttatcttctaagcttaggcattggttcttaaaccctgtttgggttactccccactttggaaagtcgatggaggatggaacccatacccagaaaactgcatatgttcacacacagagaggaatgtgcacatcactccagaggctccatggactgcaccaaagcctatccttgggctccttaaggcccaggaaccccagattaacagcagttattctaaggaatcttcatgcactctttatcttcccccatccctgaaaatggataaaacacacacaaaaaaaatggaggtgttgggcaaggaggaccttttgtggtatatcctgcaatcctgaaagttttctatttcagaagaatagccatctctttagtttaacaacaggggccagagagagccctgtgtgtggagtatatactcagaatcagcacatttcaataaatacatgtacaccttaataatacatacatttgtagcaaaaaaatggctaggttattatagtacaagcttaaagggaaaaattattgaaaataacacacattttaaagaataaaacacacagccaggtgcggtggcttacgcctgtaatcccagcactttgggaggctgaggggggcggatcacctgagatcaggagttcaagaccagcctgggcaacatggtgaaaccccatctctactaaaagtacaaaaattagttgtggtggcaggtgtctgtaatcccagccacttgggaggccaaggcaggagaattgcttgaacccaggaggcagaagttgcagtgagccaagatcgcgccactgcactctagcctgggcaacagaacaagactccatctattaaaaaaaaaaaaaaaaaaaaaaaaaaaagtcgggctcggtggctcactcctgtaatcccagcactttgggaggctgaagtgggtggatcacctgaggtcaggagttagagaccagcctgaccaacatggagaaaccccatctctactaaaaatacaaaattagccaggtgtggtggcacatgcctgtaatcccagctactcaggaggctgaggcaggagaatcgcttgaacctgggaggcagaagttgcagtgagccaagatcactccattgcactccagcctgggcactaagagtgaaactctgtctcaaaaaaaaaaaaagaataagacacacagtactgacctatacaggcacccactcttatgtctgctctttattttgcccagcttccagataaattatcatcagataaaatctgcttcagatttaccatgcggccttaaaagcatcgcatgatactgaatccttgtctccaatgtctttgactttaagagcattttcccttttctaataacagcttaattcacatgtatgtctgttggatattagtcttcatgctgccatgttgaatttcttctaaaagtcttcttctctaaaagtcttaatgagcaatactatcgtatagagattacttgctagtaaaaagacagatttgagaatcagacagatgtggatttccttttttggctctgccacttatgaatgctgttgtcctgggcaagttccttctcctctctggtttctgttttctcatctacaaaaatggagggcaagcttcaaggttactgggatctcaagttgtgttagtctgctcaggctgccatgacaaagtaccacagactgggtggcttaatcaagagaaatgtgtcctctcactgttctggaggctggaagtctaagatcaaaatgttgccagggttggcttcttttcttctgaggctcctctctgtggcttataaacagccatcttctccctatgtcttcacatggtcttccctctgtactgtctgggtctaaatttcctcttcctttaaggacaccagtcatattggattagggcccacactaatgacctcatttaacttaattacctctttaaagaccctgtctccaaatacagtcaccttctggggtactgggggttaggacttcaacataagaattttgtgggggacagaattcagccacagcacaagtgtatagtacctgacccacggcaggcttagtaagcctacttattgtctacctcacccacatttaaactgcacaaacttttaatgggacgctgtgtgtctctgtagactcccagacacactaaacctatttaaacagacaactcagcattgtgacaggcgcactctgtccttcctttattatcagggatgaagctgtttcttctctttgccccagattccggatgtcataaatctttaaaatgagtcatccttgtgtctcctctctccctcctgcccccacaatcttccagcactgtgccagggtgctttcatctatatgtggaaatgtgctcacctgctgattgtaaactcagtcattgccttactcttcaaaattactggtcccagcgggcttctcttccagccattttttcctgattctccatctctggcagcagctgctgtgccttgattcagaagctgcccttgtcatatctgagcaagtatcccccagggcttcacgtgactctcacatagccttgtcctcctcctcctctgctgtccgcagccctgggtggagggcctgcagtggggagcttgtcctgcatcagcacctcagaggggcagtattccctcatcccagtggcatcccagcaacaacctgtccccaggtaccgtggccctttcagctcactctttcagctcttctcaggtcccgctctgaatgtccccagagaagcagccagaggagcttgtgtccctgggcaactgagcagcctcctgaatgctccttttgcacttgtttttctcttccagctgcagagcccttgctccgtgagcaaagcctgggtgcccaagcagccaccgcagcagcagagtacaacctgcagagaagctgatcaccgggcagagatagagcgagcatgtgtgtgtgtgtgcgcgtgtgcagaggagggagtggtgtgcctgtttgtgtgtgcatgcatctgttgacactcatgattctgaatgttgcctgggctgggggagtacctgtagcacgccagtgctgtttcccggcctccagacacaaggctcgaggttatggcagtgactttcagctgagacctgttcctgcaagccagctgccttgtctgaacagaacgtagtggtaggaccctagctgggattctggcatctgcctccctagacctccttccctccctcctcacgtcaggctgtggagcaggagcacagcagttctggctgttgtccaaagcatgggattctggaggcagccagagccctgctgagttcctgctttctgacctggaggctgagcaggccggagtggatggatgctgtccagacgtagccacctggcctctgtttcttattttaaaattctctgctactgggctcagtcccaggcccttccttgggcttctgggactgagcatgaggccatagacagatctaaaaagtttccaccaccctacagaagtacacacagatacctgactggtgtggggtatgcctggtactgtaataggagcctaagacagcacacctaccttttcaggatttagaacctaaaattagaaagagaatcccagctgtcattgttccttccccagaagctaagagccagcctcagagcctacccaggagctgtgaaggggcaagggtcaaactgactcactctaccaggaggagaccaggttgcagtggcgtaaggccccctggtttctctggccacactccaaggcaccacagtgctgccagtgaggacagctgacacccagccagggaaaccattctagtctttattctgttggcttccagggcctgtcctggacttgtcagcatccagactgccatgtcagctatcccagtagctgagctccaaggactcaggcagagggactcagggatggggactgccaggggcagttggcaaaagtccaagtagagattacacccagaacaccattccttccaggagcagtaggtgggaggtttgacccagagaagccaatccttgcattccaggagtggcctgtgcctcccacctcttccttcccactgccaaaggcctgtgttgagaaagatgtcatgcaaaaggacgacggtggccaactaaagcaagtcttccttccaccctgtggcctgcacttgagccacaaagtgtgtgtgtgtgtgtgcgtgtgtggtacgtgtgtgtgtgtgtggctatgaggctgattcctgtttggatttttgtcctcacgtgtatcattaagctggcctttgggccttttcctttctacctcccctgtgacctttcctagcctcagatctgttaattcttttggccccagccctgtccctcactgtcctctgtccttggaccagaaccctggggtcagacccatctcctgtagctgtccatcacactgacaggcttcttcctgagatatcctcaggttttctcagccagagagctgcctttagagtccaactgttgtacgtatgtcaccttcactagaaatgtcccatcatcgtgggaggggagcagggcacaggggatggtgtgcattcagagcattgggttgggggcttccctgttccctcagccccagtcgagaggaaagagaatcgggccactgccagaaagagagtcaagcaaacctggaagggcaaatctgagagtgggaaggccaaaggccgaggcccagatttagtattcactagcagcgccttcgggtagcaggatgattccttttcctgcctgtctgctgctggctctcttccctaaggtacaggttggcaggaccacctccgcctacttctccaccatccctagcatgtcagcccgttcccagatcaacctgccagtggagtcaggcagtgcactcctggagccaagagggaagggcagggtagagagggtatgtccagtagcctggagctccatggtggcttcatgcctcccttctcccagctcaggtggccctgagggctccctcggaacagtgcctcaaatcctgacccaagggccagcatggggaagagatggttgcaggcaaaatgcactttatagagattttctattgctgggaaggtgtgtttctcccacaatttgtttgtgaatattcacttgttttataaatgtctgacctgtcttgag

SEQ ID NO: 37771 - DNA, 29868 bp, Homo sapiens
agttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcctctgctgagtcgggtgcaggcagccctggtgtgggagcggccagctaggagcgctctgtggtgcctggggctgaacgcggctttctggtgagagaactggaccctcggaaaccctccgagtcccgaattcgttggttcctctagggctctacttctcgcctgccctgttttcttcgctgcactggctccttcctgtacttgcctaattttgcctcacctccttccactccatcccgcctgcaggcttcggcaccctagttcttcccagggccgtccacccatcttctctgccttacctgtgcccgcacccccgccccgcacatctggcgggagcttctggtaacatcttgagccgctcaagagtgagcgagggctcctcttttgagcccgacaaagctgcgtccctttaaagccatcacttcctttctcttgtctgctcaagtgcaagttctagattgtttccagaggttttagtagtttattgttggagtagaggcgtgaagtcttgcaaaggtatccataggtgtgattataaaacaagcttgagcgattcgcatgaattagcatgttatatatctaggaaggaagtttatgaagtctaagcgtcagtgtgagcccccaaagctgaaaattgaaagaaaattacaagcttttaaagaacagttaggaaatgatgacggagattacacgcgtgtcaaagccacctgtgattgtaactcctccctgttccaaggaattagagaggcatccttagccatggtttataggcaaggaaattgatgtctaatactgtgtgtgagttttcctgagctggaaaagtagcactgtaaatatgctttatttgtgtgtgtcatgctctgtgaaaatggaactgctgcttctctcagttgtcatcacctgaagtggacctaggacttcataggatctaccaaccataattttggatttatttgtaatggaggaggttccaagggaactgacttatagggggctttctgctgctgaatggattaagactattctggataagcctgaaacaacaaaatatgtgtgttttttaattgtgtttttgctaaaaatagctttccccttaaaatttgttttaaaatcaaaacatttattatcctttatctgaaagattttcagtgagctgaagcagaacaaataattccaagttcattgacccgaaaacagtgttcagctattaagctaatcctctcccagtttgaaagagacccagttaaaggtgtcacagtagtctctggcatttgtggcttccagagcctttagcaaactcgatggtaaacttttcctaccacgttcttcatttatttttggtagtgctttttcccttttttttttttttaagacagagtttcactcttattgcccaggctggagtgcaatggcgtgatctcggctcactgcaacctccgcctcccagattcaagcatttctcctgcctcagccccccaagtagctgggattacaggcatgaaccaccacaaccggctaattttgtatttttttagtagagatggggtttctccatgttggtcaggctggtctcgaactcccgaggtcaggtgatctgcctgcctcggcctcccaaagtgctgggattacaggcgtgagccactgcgcctggcctttttttttttttttttttttttgagacaaggtcttgctctatcacccaggctggagtgcagtggtatgatctcggctcattgcaacttccacttcctgggctcaagcaatcttcccacctcagcctccacaatagctgggaccagaggtgcacatcatcatgcttggctaattttttaaattttttgtggagacagggtctcactatattgcccaggctggtctcgaactcctaggctctggtgatcctcctgccttgggctcccagagtgctgggattataggcatgagccaccgtgcccagccaagtgcttcttccttgacccctaggtactgattcccattgctctctgtagaaatcttcactatagcacctcactgaagagtgttttatccagtcaaaacatttcccacagtggttttggtatctctagcaagaaggctgggcctcattaaaccaatttgtatcaaagtatgactgcctgatggaaaaaaacactttatcagggtttacttatttttgttttgagacagtttggctcttgttgcccaggctggagtgcaatggcacgatctcagctcactacaacctcctcctcccaggttcaagcgattctcctgcctcagcctcccgagcagctgggattacaggcatgcgccaccaatgcctggctaatttttgtatttttttgtagagacagttttgccaggttgcccaggctcgtctcaaactcctgacctcaaagcaatccacctgtctcagcctcccgatgtgctgggattacaggtgtgagccactgcactgtaccgggccttaaatggatttttaaaccaaagatttatgaatgcaaatgaattagtagcatgtatgctgttctttttgaggaggggaccttttttttttaattaatttttgttttttgagatggagtctcgctctgtcgcccaggctggagtgcagtggcgccatctcggcccactgcaagctctgcctcccgggttcacgccattctcctgactcagtctcccgagtagctaggattgcaggcacgcgccaccacgcccggctaattttttgtatttttttttagtagagacgggatttcaccgtgttagccaggatggtctcaatctcctgacctcgtgatctgcgaggaggggacctttcttctgccgcttgtctgagagaggtttctgaagcagaatgtgaggttgaggtctgcacataaagagctgctgtgactgggacatatctttagatgttacagctagctttaatttgctggcctctaccagtgtttacttaagcttattaacatgctatgtttagaggctcacttagaaccccttttgtactctgggtctcttaaagcattgctgtgattggtctttatctttggcatttcctagtagcttgtctgttgtgtatccagaacacagttactcttgttacagtcccatcacattttaagaaggtgcaggagagagacaacaaaatgaggatgtgactttttttttttttttttttttttgagatggagtctcgctctgtcacccaggctggggtgcaatggcgtgatcttggctcactgcaacttccacctcctaagttcaagcgattctcccaccccagcctcccgagtagctgggattacaggcacccaccatcacgtctggctaatttttgtatttttgtagggcagagtttcaccatgttggccaggctggtcttgaactcctgacctcaggtgatccacccacctcggtctcccaaagtgctgggattacaggtgtgagccactgtccctggccgacaatgtgactcttgagactaaaagaacagttgggtatgccatttctggagaggactcctacatgtgaaaggcacagatactgttaagtccccagaaacttggatagtctggcattggagttcacagaattgtttggggaaatgagcttccttggtaggtaattagagatttaaaatgaaatttgggcttcacattctagtagtgtcatattgagtatgagtgttgacatttcgcttagaaatgtggaagagtgactgactgttcagttaacaaacattttaaatgtttaagaaagggaggaggatcattagctcaagtcagaaaaatcaaatctgaaatatttagtttctcttttattgtattgaataatgggacaaaaatgacatatcattaactgagatttttatgcattttgaggtattaggagataggagtacaaaaaaaaacccatcagaattcaggtaggtagctcttaattttcagtgttttgtatcctcagtcatattttgccgtaactgtgaatatgccctcttacatcttaaaaaaaaaaaaaaaagatggagatagatgtagataccttgtcaccatagtattccaaggttttcatacttttttttttttcaggtaccagagaatttatggtggccatatcagaggtcttccagcctagattacttctggtcactgatctgttattgtctctagcataataatagaaatgtcaggccgttccttccaatagcttgtgttttcattagtctcaacctcatctgtgaatgagtgatttgggggaagaatgtgagagtcaacaagcatgtatcctgacaggatcagaaaagaacaggtttgggtaactttttggtttgacttgtactctgagatcagaggagggtaaatgaacactggaaatgtgtgaactccaagctccctctcccacctaacatgaagagatagttcaaggaggcctacataactgctgagctctttcagttttttttttttttttttttttttgctggggaatcgggggttgttgggctggacagggtctccctctgttgcccaggctggagtgcagtggcacaatcatagctcactgcagcctctacctcctgggctccagcagtcctcttgcctcagtcttccaagtagctgggactagaggcacatgccactgggcccagcctatttgcaaaacttttgtagagacagaatctcaatatgttgcccaggctggtctcaaactcctcatctctaacagccctcccggcttggtctcctaaagtgctaggattacaggcatgacccactgcaccttgactgctttgtggtttttaacaatctgtgaatctacatagtctatgaattaggaatattgttttggagcagtccacaagctgagtcccaagtagagatctctgttgggatctgctttttgcagtcactagtctcagtgaaccatactgtatttctaggaggttattatagaatttgttatttcacaaatgaaatgtaaaaattttatttttgtccgcccccccaaaaaaataaataaataaaaatgacccaaaaaagtgattaaggatatacagcaattctgagttagaaggttaggatttgagtaaaaaataatagaaacaagaaatggaagatggggagcccatttaagtagagatatttgttctgttaaaaaaaatctacacatctgatttcttttcttttttttttttttgagacggagtctcgctctgtcgcccaggctggagtacagtggcgcgatctcggctcactgcaagctccacctcccgggttcacgccagtctcctgcctcagcctcccgagtagctgggactacaggcgcccgccaccatgcccacctaattttttgtatttttagtagagaccgggtttcaccgttttagccaggatggtctcaatctcctgacctcgtgatccgcccgcctcggtctcccaaagtgctgggattacaggcgtgagccaccgcgcccggctacacatcagatttctaatgaaatctgttgagtgaatgttcctgatgatagtctttgcagggttcttgtctttgtgagccgagaagactcccaaggatgccttggtttatttacttcccctctctttacctttagtttttatctgccctaattgtatggttgagtgctttctctccactgttagcagctagctgatttcatttctggtttttttgcaagcaacaactgtcactgcatgatataggttgggttaatttttcctttgaatttaccggtgacttgggctcattaaccaggcggtcacaagtgctgtacagtaacaggctttctgtccctgtagaatgggatgctttgttttgaagtgcccttgagacaatcttaatctgtaataacaaaggaacctagaaatcatgtctttgaaaatagacatgtggtcattatttatgattatagcaaactttaatttactggtactaatagtgaggctccatggtatagttaatcacaaaagtttatgtttggttctggaatttctcacgatgtttctggacaccaattgctattccagggatattttatttagactgatcatttaattggattttagtccctgacagagtggagggacagttcacaaaaggggaaaaaaaaatcaatggatatataaaatttcactctcacaaataagaaaagaattcaaatatatgtaaatggaaattatttactaatttctatcttaagttttttttttggcgggggacaggatctcactgtcgcccaggctcgagagcagtggtgtgatcatggcttattgcaacctcaacctctgggctcaagccatcctcccacctcagcctctcaggtagtggggactacaggtgtgtgtcaccacacctggttaattgttttgtatttttcgtagaaacaaggtttcaccatgttgcccaggctggtcttgaactcctgggctccagcagtccacccaccttggcctcccaaagtgctgggattacaggtgtgagcctccacacctggccttaagtatttttaatgatcataattaattctggggaaaatatggaaaaatgggcatatggctgataggaacataaattggacagcctttctagcaagtagtttggtaacatattttaagccacttaagaagcttttccagggctgggggaaatggagaaagaatactaatgggtatgggtttcttttggagtgatgaaaatgttctgaaattacataaggctattagtcgtacagcattgtgatttttttttcatctctgctgctggcagatgaattgaaagagaattttatcgtatacaaaccattatctcaataaagctattttcttacttttttttttttgaaacggagtcttactctgtggcccagactggagtgcagtggcatgatctcagctcactgcaacctctgcctcccagattcaagcagttctcctgcctcagcctcccaagtagctgggactaccggcgtgcaccaccatgtcttggctgatttttgtatttttagtagagatggagtttcaccatgttggccaaagtggtcttgaactcttgacctcaagtgacccacctgcctcggcctcccaaaggctgggattacaggtgtgagctacggtgcccgaccaataaagctatttgtttaaaatagttaatgcctttgacccagtaacatgctcagtgatgtatagttcagcttttattacatcaaaaaattggaaacttttggctgggcgcagtggctcatgcctataattctcagcactttgggaggccgaggcaggcaggtcacctaaggtcgggaattcaagaccagcctgaccaacaatggagaaaccccatctctactaaaaatgccaaatcagccgggcatggtggcgcatgcctgtaatcccagctaccttgggaggctgaggcaggagaatccgttgaacctgggaggcagaggttgtggtgacccgagatcgcgccactgcactccagcctgggcaacaagagcaagactccgtctcaaaaaaaaaaaaaaaaaaaaagttggaaccttcttagtttatttttcgtttatttttcttttcttttttttttttgagagagtctcgctctgtctgttgcccaggctggagtgcagtggcgcgatctcggctcactgcaagctccgcctctcaggttcacgccattctcctgcctcagcctcccgagtagctgggactccaggcgcccaccaccactcccggctaattttttgtattttttagtagagccagggtttcaccgtgttagccaggatggtctcgatctcctgatctcgtgatctgcctgcctcagcctcccaaagtgttgggattacaggcttgagccaccgtcttagtttattttattttatttgagatggagtcttcctgtgttgcccaggctggagtgcagtggcacaatctcagctcactgcaacctccgcctcccggattcaagcagttctcctgcctcagcctcctgagtagctgggattacgggcacccgccaccatgcctagctaatttttgtatttttaggtagagatggggtttcaccatgttggccaggctggtcttgaactcctgatgtcaagtgatctacctgcttcagcctcccaaagtgctggaattacaggtttgagccactgcgcctggcccattcattgttttttttgagagaaggtttcactctgtcacccaggctagattgcagtggtgtgatcatggctcactgtaccctggaactcctgagctcaagtgatcattccacctcatggctgatgagaccacaggagttcatcaccacatcaggctaattgtctatgtattatgtgaaaaagttttaaaaccatagtgtttttatatgtgaattttttaatgaagagaatagcctgtcttcacactttttagagtacatatgtggataatggatcattttaaaaatattttattatggaaagcttaaaacatgtgtaagtaggcagaataatattgtgtgccaccatgtacataatattatttttttcaattcctggccaattttgtgtcttccataccccagttcttttctacgtcttccttattgtttgacacaaattattgatgtgtcatatcatttaatctaggtatttcagtatatttttctgaaaaagagactttaagaaacatctgccatcattatcacatgcaaaaaattaatgattctagtcagtgttcacatttccaattttcttataaatgtcataaatgatacttttttttttcttttcgagacagggtcttgctctgtctcccaagctggagtgcagtggcacaatcagagctcactgcaacctcaaccttctggctctagcaatcctcccacctcagcttcccaagtaaatgggagtacaagcgtgcaccaccacacctagctaatgtttttcttttcagtagagatgaggtcttgctgtgttgcctaagctggtctcaaactctttgactcaagtgatcctcctgcctcggcctcccaaagtattgggattacaggctttaggtaccacatgtggcctgttgtgtgtggttttatttgttgttttttttttaaactctttttttccccacaaaccaatttgttagtgtttaggtggttttttctgttttgcttttttgttttttgagatagggtctcgctctgtcacccaggctggggtacagtggcacgataacggctcgctgcaacctcagtttcccggactcaagctgtcatcccacctcagcctgttgagtagctgggattacaggtgcccgccactatgcccagctaattttttgtatttttagtagagacggggtttcgccatgttggccaggcttgtctcgaactcctgacctcaggtgatccacctgccttggcttcccaaagtgctgggattacagacgtgagccaccatgcctgtacttttttttcgataaacatgaattcatgttagttgtataattttttttttttttttttgagacggagccttactctgtcacccaggctggaatgcaatggcacaatctcagctcactgcaacctctgcctcctgggttcaagcgattgtcctgcctcagcctcctgagtagctgagattacaggcatacaccaccacgcccggctaattttgtatttttaatagacatggagtttctccatgttagctaggctggtctcaaactcccgatctcaggttatccacccacctaaggctcccaaagtgctgggattataggcatgagccactgtgcccagccaacaaccctatttcaatttttccagcctaccacctaaaggatactgtgactatatgtaagattaaagaataaaagcagtttaacagaaataagcctctagagctgcctcaggccattgatcttctctctaaagccagtgcatcatcccaacaaacaagcacatttaacaaggccaaggagaagagctctagggtttcttgctccccagtgctgctgcttcccttccccagcagcagcacatggcatcgctgttttctccagagtacttgaaagggctctctagggaggcttgccagactgttggcaatttccccttcccagagcacgattactaacacaaatagaaactagggtagggaaaggatattaagctctcctaagaaggttggttttccagagatgatggcaataaaaacatatcccttataataaactggtaaacattaaaaaaaaaagactgttttctaagacctggactatttaaattgcttgttacagcccttaccttccattcttataagctatgcttcaattcaattcaacatacctttgagtacctgttacatgccaaggccttgtggtaagaagcccagttacagaaaaaaataagacacaaactttactctcaagtaaattcatgtgtgtttgtgttcacgatataacgtgacaggtaataataacaaacaggaagatatctaagctgtgatttgcaagataaatgttaaggaaatggggccgaaaggtgtggtaagagagagaagacattcagatagggaaaacaccaatctagtaagatacttaaggaattgcaagtagtttgataaaactgaaatataaaaaacaaagggagggaatcagtgtggggagagaggcaggatccagatcatgaaggcccttttatgacggggtaatgggatttcatcctgcagatgaagataagccaatagtttcataaagggtatattttctgggtcttgaaggctaaaattgtgagcatcttccataacaagattaatccttgtccataaatcaattttagtcccagatttatctttttttggaacaagccacaataataacttcagaggaagaggccgggtgcggtggctcacgtctgtaatcccagcactttgggaggctgaggcgggtggatcatgaggtcaggagatcgagacaatcctagctaacatggtaaaaccccgtctctactaaaaatacaaaaaattagccgggcgtggtggcgggcgcctgtagtcccagctactcgggaggctgaggcaggagaatggcatgaacccgagagatggagcttgcagtgagccgagatcgcaccactgtactccagcctgggcaacagagcgagactccgtctcaaaaaaaaaaaaaaaaaaaaaaacttcagaggaagaagagttttctttgtggtataaaataacgtttcttggccaggcgcggtggcttatgcctgtaatcccaacattttgggaggctgaggcgagctgatcacttgagatcagggattcgagaccagcctggccaacaagacgaaactccgtctctactaaaaatacaaaaattagctgggcgcagtggcgcacaccttaaccccagctactcaggaggctgaggcaggagtattacttgaaccctggaggcggaggttgaagtgagtggagatctgtgccactgcactctagcctgggtgacagagtgagactctgtctcaaaaaaaaaaaaaaaaaaaaaaaaaaaatatatatatatatatatatatatatatatatatatatacacacaaaatatatatatacacaaaaatatatatacgaaatatatatatatatatatacacacacacacacacacacacacacaaaatagattctggctgggcgcggtggctcattcctgtaatcccagcactttgggatgccgaggtgggtggatcacaaggtcaggagatcgagatcatcctggctaacatggtgcaaccccgtctctactaaaaatacaaaaattagctgggcgtagcggtgcatgcctgtaatcccagctactcaggaggctgaggcaggagaattgcttgaacctgggaggcagaggttgcagtgagccaagatcacgccactgcactctagcctggcgacagagctaagactccgtctcaaaaaaaaaaaaaaagaaaaaatagattcttctggccaggtacagcggctcatgcctctaatcccagtactttgggaggtcgaagcgggcggatcacttgagatcaggagtttgagaccagcctagccaacatggtgaaaccttgtctctatttaaaaaatttaaaaattagctgggcatggtgagggcacctgtaatctcagttacttgggagactaggacaggagaattgcttgaacccaggaggcagaggttgcagtgagccaagatggcgccattgcacttcagcctgggtgacaaagccagactcttatctcaaaaaaaaaaaaaaaattcttccaaacagcaaaacttaatagacagatcacctcaaagaactagagttgacccctccaaggtaaccaggtaattaatattaatgttctcttacaggtttatcaaatataaaatggtatagataagtgtgtgcttctcctttccttccagccctcaacacaaaattcctaaataaaagggagtatcaacatcagattgatgtattttgtatataataaggtcacattatacttgtcattttagagatgtaacctagaagtcaagcggtaaaacaagctttgcaactatgtggatggacaagatgtaattgaagatgaagtactttagagatggtatgggtaaggaatggaggaaaaaaagggaggattcctctgcattcgtttagtcctgcaatgtctattcatgcgggccaaaaaactcacaagcagataaaacagtgtaataagaaaaaaactaaaacatttttatttcttttttttttttttttttttttttttttttttttttttttgagaaagggtctcagatttgtcagccaggctggagtgcagtggcacaaccacggctcactggggcctcaacctttcaggctcaagcaagcctcctgagtagctgagactacaggtttgcatcaccatacctggctaatttttttttttttttaaatagagacagggtctcactatattgtccaggctggtctcgaactcctgggctcaagccatcctcccacctcagcctcccaaagtgttgggattataggtgtaagccattgcacccggctgaaaacatttttcggcaacgataatgagcgtgagaactttccaacttggcaaaaacaactgcaaatatagtcaactctggaaattcacacatgaattattcagtttggggactgtgatagcctgttactccttctacctactgtaggctcacaatctattttttcttaatgattttttttttttcttagacagggccttgccctgtttcccagcctggggtgcagtggcgtgaacacgttcactgctgcctcaacctcctggacttaaccaaccaatcctcctgcctcagcgcgctgaggcagggagaatcaatctcttgaatctgggaggtggaggtttcagtgagcggagatcatgccattgcactccagcctgggcgaccaagagagagactccgtctcaaaaaaaaaaaaaaaaaagaaagaaagaaatagggttgtcattggtgactggatttctgagttcttgttcccgtccatccctcattctttgtatgattttaaaatgttatttttaaaaattatggccaggtgtcatgcctcacacctgtaatcccagctacttgggaggctgaggcaggagaattgcttgaacctgggaggcagaggttgcagtgaactgagatcgtgccactgcactccagcctgggtcacaagagcaagactctgaagaaaaaaaaaagggccagagtgcggtggctcatgtctgtaatcccagcactttgggaggccaaggtaggatcacgaggtcagggagttcaagaccagcctagccaatatggtgtctcaaaaaattccgtctcaaaaaaaaagtacaaaaggccaggcgcagtggctcatgcctgtaatcccagcactttgggaggctgaggcaggcagatcacgaggtcaagagatcgagaccatcctggccaacatggtgaaaccccgtctctactaaaaatacaaaaaaaattagctggacgtggtggtgcatgcatgtagtcccagctactcgggaggctgaggcaggagaatcgcttcaaccagaaggtggaggttgcagtgagccaagatcgcgccattgcactccagcctgggcaacaagagtgaaactccgtctcaaaaaaaaaaaaaaaaaaaagtaaaaaaaaaaatctacaaacaaaacgtaaagttccttaggccagtcccccatttatgtatgtatattcaaatgtacagccggataaacgtatgtatgtatgtatttattttgagacggagttccactctgtcgcccagcctggagtgcagtagcgcaatctcagctcactgcaagctccgcctcgcaggttcacgccattctcctgcctcagcctcccgagtagctgggactacaggcacctgccaccatgcccggctaatttttttattttttgtatttttagtagagatagggtttcaacgagttagccaggatggtctcgatctcctgacctcgtgatctgcccgcctcagcctctcaaagtgctgggattacaggcgtgagccaccgcgcccagcctttattttgaaatggagtcttgctttgtctcccagtctggagtacagtggcgcgatctcagctcactgcaacctccacctcccaggttcaggcgattctcctgcctcaccctcccgagtagctgggactacaggcacgccactgcacctggctaatttttgtacttttagtagagacagggtttcgccatgttgtccaggctggttttgaactcctaacctcaggtgatctgcccaccttggcctcccaaagtgttggaattacaggcgtcagccaccatgcctagtcttttcggaatactgtgaaatgctatttatattctgttctaatctatacatgattttcatattggctccaatatttgtttttttgagaccagaatctcactccgttacccaggctggaggtgcagtggtgcgatctccgctcactgcaacctctacctccgaggctagcaattcttgtgacgcagtcccccaggtaactgggaccgcaagcgcgccaccatgctcagctcattttttgtatttgtttttagagatggtgtttccccatgttgccgaggcttgtctcgagctcctgagctcaagcagtctgcctgcctcagcctcccaaagtgctgggattacaggcatgagccaccacacctggccagggctctatagttcatgttcacatcacatgttacttagggggaaaaaagggaaaaaatgacccagagtgtagcatttatgctatctgtactaatctgtgtttctgaatttcctcatttaatattaaaccaaaatagatctgaaaaaaataactaccttaacacttagcatctaaaagaaaaaaattccttagtatcattagatgtgttctcaatgtcagatttctcagattgttcaatttttttttttttttttttttttgagacggagtcttgctctgtcgcccaggctggagtgcagtggcgcgatcttggctcactgcaagctccgcctcccaggttcacgccattctcgtctcagcctcccgagcagctgggactacaggcgcccgccaccatgcccagctaatttttttgtatttttagtagagacagggtttcaccatattaaccaggatggtctcgatctcctgacctcaagatctgcccgcctctgcctcccaaagtgctgggattacaggcttgaaccaccacgcctggcctcaaaatttttttatggttgattccttcaaataagaactagcttttcctttaccttattgatgtgatgccttacacttactgatttttttgtatgttaaaccgcccttgcagtcttgggataaatctcatttgttcatggtgtataatacttttaatatgctgctgaatttaacttgctagtattttattgaagatttttacatctatattcataaggaatattggtctacagttttattgtgtctttggctttggtatcaggataatgctggcctcacaaaataaatcaagaagtgtttcctttttttggttttttggaagagtttgagaagcatttgtgttaattctggagaacttgcttttatttatttatttattttgagacagagtctcactctgttgcccaggctggagtgcagtggcatgatcttggctcactgtaacctccgcctcttgggttctagcaattctcgtgcttcagcctcccaggtagttgggattacaggcatgcctcagcctcccaggtagctgggattacaggtgcacaccaccacacccggctaatttttgtatttttggtagatacggagtttcaccatgttggccaggctggcctcaaactcccgacctcaggtgatccacctgtctcagcctcccaaagtgctgggattacaggcttgagccactgtgcctggccagaacttgcttttcaatatagcttttatgccaactttctgtgtgaccttaatcaaatatttttcaggcctcagttcctagatctgtaaaaagatatgtaattgaattaaatgctcttgagtgcatctctgtcagtttgttgccctacactagggtctaatttggtagaaagatgtttgctttcattataacaacttgttatcaaggatgaatttctccgtgaaattaatagagatatagactggaaagcagaaggagctttaagaggttatttgatttagtcctctgcctttacagcagcaaattattttctctgccccataggtagagtagttaaggtccagaaggtttaaatgatttaccctaggtgtataactagttaagtgtcagaacaaaaaaagctagacctcaagtctgtttaccacagagcccatcgtacacacgtggccttttctgaaattaggataactaggtaaatgatctttcttctgtttttcttcctctgtaggttttttgccctgacatctcttcgtcttgtgtttttacttgcatttggcttgatgatcattgtgtgtattgatcaatggaagaacaaaatctggcctgaaataaaaggtgagtttggtagcatttagaacaatctgaactgaagatggcctttcctataatttgtacctttagtattaggggtttatgaggaggtgtatggagctggggactgtcttttgaagtctgaatcatttgctttaggaggcacttgaagggcttgtgccccaattatggttccttagagctgggttctgcccttcccattgttactaagcacaggaaatctgtactcaccacctgagttatttttgccaacataatggcctgaggaataagtagtcctcaaatgaaaaataataaattatcgttattggacactgcatctttattgaggcagtacctctcaggaattccttttacattgctcatttgcaaaacactaggctaggcaattgtgacttatagaaagtaccatgatggccgggcgcagtggctaacgcctattagtaacccctgcactttgggagtccgaggcgggtggatcacctgaggtcaggagttcgagcccagcctggccaacatgatgaaaccccgtctaataaaaatacaaaaaattagctgggcatggtgatgcatacctgtaatctcagccactaaggaggctgaggcaggagaatcacttgaacctgggaggcggaggttgcagtgagccgagatcgtgccactgcactccagcctcggtgacaagagcaaaactcagtctcaaaaaaaaaaaaaaagaaagtaccatgacatgtggtgtctttttaaaaagctaatacatacataaacaaatgaaaaattaagtgacaattatagaccagcaccacagatgtcacagtgcagtatgtgattagtatacttagcatgtattttttccctagcctgagagtggaacaaagcaaaagatttgaacagattgagaaaaaagtctgtttctagagagtccagtggcttgattagtctgaggaaccagaagttgcaaagcatttcctgacatcagagaattgatcatatggccaggatgaaggttcattaaagggagtgctaggaaataaaactgaaagtatgttgggattaggttttttgttggtttcttttcttttcttttcttttgagacggagtctcactctgttggccaggctggactgcagtggcatgatcttggctcactgcaacctccgcctcccaggttcaagtgatcctcctgcttcagccctgctagtagctgggattacaggcacgcaccaccatgcctggctaatttttgtatttttgttagagacggggttttaccatgttggccaggctggtctcgaacttctgacctcaggtgatccacccgcctaggcctcccaaagtgctgggattacaggcgtgaggcaccgcacctggcgcattcttttttttcagacagagtcttggtctgtcacccaggctggagtgcagtggcgcaatcatggctcactgtggcctcaaccttccgggctccagcaattctcccaccttagccacctgagcagctgggactataggcacttgccaccatgtccagctaatttttgtattttttctatagatggggtttctccatgttggtcaggctggtcttgaactcccaacctcagatgatctgcccgcctcagccttccaaagtactgggattacagacgtgagtcaccgcgcccagccctattcttattttttaacaaactaggtctcactgtgttgtccaggttttggagtacagtggcatgatcatagctcactgcaacctcaaatccctgggcttaagtgatcctcccacctcagtctcccaattagctgggactacaggtgcataccaccacacccagctaagtaaaaaaaattttttttgagacagaatctcactttgttgctcaggctggagtgcagtggcgcgatcttggctcgctgcaacctccacctcccaggttcagatgattctcctgcctcagtctcctgagtagctgggacgacaggcgtgcaccactacgcccagctaatttttttggtatttttagtagaaatggggtttcgccatgttggccaggctggtcttgaactcctgacctcaagtgatccgcgtgccttggccttccaaagtgctgggattacctgcgtgggccaccacgcccagccgataataaagattaatttagtagcatttttaggaccacatggaaggaggaaaagtggaacaggatgacctgttaggagactgtggcagtgtctttgtgagaagtagtcagagaggcctcagtgaatacaaatgatggatggcctggagagctgtgaataaggaagatcaagacataaatagttggggccaggtgcagtggatcatgcctgtgatctcagcactttgggaggccaaggcaggagaattgcttgagccaaggaatttgagaccggcctggacaacgtggcgaaaccttgtctctacaaaaaataaaaaaattacccaggcatggtggtgtgcacctgtggtccccagctacttgggaggctgaagtgggaagatcccttgagccctggaggttgaggctgcagtgagccgtgatcgcaccactgtactccagccaagacaacagggcgacacctgtctcagaaaataataattgttatatatgtataataaaagacataagtggatgggggttaaagctaagagagtggcagaatggcattacacttagcaggcaaaggcagacaggaaagttggtttgaaggggtgagagaggaaaactgatgtagattttaggcaggttaattttgaagtgttggcaagatattcaaaccagagtatacaggttttaaatacatgcccatcatattttatagagacttcaaggaatcgtgtagttcatctgcctatctaatggctggtgaatctcaaaagacttatacatcattcaggtagataatgggtctccccatttttttttttttttggttagagacagggtctcactgtgtttcccaggatggacttgaactcctgggctcaagtgatcctcctgcctcagccccccaaggaggcagaactataagtgagcatcactacacctagctctgggtctctttttaaagagaacaggcaggctgggtgtggtggctcacacctgtaattccagcactttagggaggctatggtgggtggatcacctgaagtcaggagttcaagaccagcctggccaacatagcaaaaacctgtctctactaaaaacacaaaaatagccaggcgtggtggcaggtgcctataatcccagctacttgggaggctgaggcaggagaattgcttgaacaccagaggtggaggttgtagtgagccaagatcgtgccactgcattccagcctgggtgacagagtgagattctgtctcaaaaaaataaagagaacaggcagatttcggctgggtacggtagctcacgcctgtgatgccagcactttgggaggtggaggagttcgagagcagcctggccaacatggtgaaaccccatctctactaaaaacacaaaaattagccaggtatggtggcgtgtgcctgtaatcccagttactcgggaggctgagtgagctgagatcacgccactgcactccagcctgggctacagagcaagaccctgtctccaaaaaaaaaaaaaattagccgggcattgtggtgggtgcctgtagtcccagctactcaggaggctgaggcagaagaatgggaggcggagcttgcagtgagccaagatcgtgccactgcactccaggctgggcaacagagcgagaagactctgtctcaaaaaaaataaacacaacaggtggatttctagggttggagttgttacaacgtaccttgtgtagcctggcacagattgatgtgtatgggtatcccagacacactcaaggggtgagatggaccatttttcttgtacaccttggctttcagctgaggtcattagaagggggctcaaatagtccatttggacctcccttccttcccctcgaaaaatgagtaggcataagtgattattcccttgtctgcagctccctaactggcagtataacacagtgtctccttttttatcggctattactgttttcttttccccaacctattaaaacttgagctgtcagaccaacagcctaacattttcatgtttagttttccctaccaactaatgctggtgtttgttttaatattgtagtgccaagacccgacgcattagacaatgagaggtatggaacactaattaaatccctttttgttgctctgattcattctcttgtaatattctggttacatgttgttaaccccatgttctggacacacagtgtaaactgagaacctaggctgttccaaatgatcattttaacacatcctaaagttcaggcagcaatatgttgagatggcctgtgtcctctgatctttacaagagaagtttctgaaaaagaagcattacagtgccccataacctgacatgccagggaatcagctgcattattcagtcccagtgagaaaacttaaaggcagctaacttcatttgtctcctggcttttataccaggtcatttagtgttttctgtgacctctggctatttaaagttcccggtcagaaaacacattggttcctggcatcagcaagtcaaagccaaagattcctcttgtgtcttacagctcctgctttcatttctcagttcatccactccatttgtttgatccaaagaattttctctgctgtggtttattttggttttgctttatttattttctttctaaggggcacatccaccatttcctcccccttagcagcagtggtgtcagtcagactatgctcacttttatccctggattgcaatcacagggaattggaatggtctgagtgcaaggaagaaaacgtttctaagcacaaagggccttggagctggggacaggtttacacacgtggattgggctgcttgctcatagggtggagttgtcagaacaagtttgtcctccttgtacctaaattcagatttcaacctggtgagccaagaagaaagtcatgcttcacctccaaagcacctgggcctagtcactccccaaaccccatttaaaaccggaagcactggctgcctgcacagcaagatggggggaccctcaacaccctcctttcacagctcccccttctctctcccatagctggggctttgtgcaccctcggttgctcagcgtgcccgagctctgccaccatgtagctgaagtctgggttagtgggaccattttcataaggaatgttttgcttttcaaaaagcaaaacccaggcaaggtaagactcttccctttttcactttcatctctggcctctcagttcagttcatgctaaactgaaacagctcctttactatgtgtcttcattcaagaaagtaaagactatgatgttcatagagacaaaaggaagctataggaaaggccttctgaccagccattaggactaacacaggagcttggtgactgctcatttggtgtggttgccacttagatgaggccgttttcttgcttcaagataggaaagaaagctttcttgtgtacattctgtgtcatattaaatatgtgataggttgttgtgtttttttgggttttgtgtgtgtttctgttgacttaaaaaaccaccaccaacattgctttcagagagaatttttggctaagtcctattcaaaccaatttcttggcaggaaaggtgcagccctatggggttagccatgtaaaaggagtttgaatagaaggggacatgctccttttcttcccaaacagaatcacctttggatgcaacagtggctgcacgtccatgcttgacttacagagtctttctgtcatatctctaccctaacccttcacacccaccccagtcccctgccatgtgacagaaacttaatactctttcttgattccccagttctgcttgctgagctgtgggatactgacctttttggctgtcttgggccgctacgtccctgggcttctgctgtcctacttgatgcgtaagtatgacatatacctcccctacaaagtataccctgctcatagctttccaactatggctaactctaggtgtggggagaggactgttatatttcaattctctaggatatgacctttgcatattttcatgacctgtttagtgtcatgaaaatatccttctttagcaggctctccacatacaaagttcatttcttaccaagtcagaaattgatgagggtccactaacatatattgttggtattaccaactataaaggactgcctgtccctgtttaaggagagaatttttagagccagggtattgtcagcagaacataactcttaggggtttctctgctaggttctatttatgccagagtacttttttcccacttggagcatagttttgtaaatttagttacttcctgttggcatgtactcagcttgcttggggctggaagaactaagtacttatgcctgtggcttttgtatatcaaaacctcgcatgatttgttgtgtaatttccatttatggctcagtgacacccattgccaggttctgcccttggcctgtcagcagcatactgtgctgtgcacaaccctgcagtaggctttgtgggtggctgtagaagtccctgccctcaaagactccttcatgtgtaggggagactggtgaagatgactggcagacttgggcagatctgttccacactttgtgtccaagccctaaggaccaatagcagcgctacagttgggaatgttttttgcagccccttctccattttgtcactgtttcccatgcctcctcacagttgtcactgtcatgatgtggccccttgctgtgtaccaccgactgtgggatcgagcatatgtgcggctgaagccagctctgcagcggctagacttcagtgtccgtggctacatgatgtccaagcagagagagagacaatgtaagtgtcatggtgtcattctttccacttacgcaatttggggcgaaaaggagaagcccataggtctgacatactgggtgggtcctcaaaagtggaagtcgggggtagttggtgggggtgaggattgataggtaaaaatgatattctgttctagggaaacctgtgcaggcttgccagtttttatcatttgtaatcctaggctcccgttttaaacctatctgataaaagctctttcaagttgaataaaagctagacagtgaagataaattcctagtatttgtggtttgttttttttttttttttttttttgagacagggtctcattctgtttcccaggctggagtgcagtggcatgatcatggctcactgcacccttgacctcccaggctcaagtgatccttctactcagccccgccaaacccttcagtagctgggactacaggcatgtgtcaccacatctatctgatttttaaatttttttgtagagatggggtctcatgttgcccaggctgatcctgaactcctgggctcaagcgatcctcctgccttggcgttccaaagtgttgggattacaggtgtgagccaccgtgctgagcccagagcagatcctttcaactcctaagcctggtctcttcactagtaaaagctgcctcccaaaggtgattaaaaactgctgcctcagaggttgtaagtgtactagcctgagatccatgcaacacaatgatggtagtacaaacttttccctcccttgtgtggtcttgtcaggttttgtgttttatggaggcctggccttcaaagagccctgcacttggtcaccaaggcccaagtccccttggggcagccagttgaataataccagtcctcaaaagtctgatttaacaaggtgtgcatctccttttgccctctctttgatcatgtccacttaacaccttgacattaggtctgcctttagccatccagagagttgttgacaaagcctggtatttgatcatctgaccagaatagaaatgtgtgccaggccgggcgcagtggctcacacttgtaatcccagcacttttggaggctgaggtgggcggatcaccttaggtcaggagttcgagaccagcttgaccaatatgatgaaaccccgtctctactaaaaatacaaatattagccaggtgtgatggtgagcacctgtaatctcagctactcaggaggctgagacaggagtattgcttgaatccaagaggcagaggttgcagtgagccgagatcgcgccattgcactccagcctgggcaacaagaacaaaactccatctcaaaagaaaaaagaaatatgtagggtctggtggagaggatgttggaagctgagatattttctccagtgttttcaactcaccttgcatttaggctcagcagctcagccttctgttattattatgtaggcttagagccagattcagagaggctctttgttttgtgttctgattttatgtctttaaagtccaaaggggattttacgctgggagaaggtatcaagcaagactttgtgctcttcccacagtacgccgcagagctctccacccagaacgagccatggacaaccacagtgacagcgaagaggagcttgctgccttctgtcctcaggtatcttgagtgtgggagctgcttcactgtccagttttctttagctaccttttaaccatccgacagctcacatttaggccataaccaggtttgaggccttagactccccttgttcccaagacaaggagagaagtgagactttgttcctagatctcaatttttttctttatcatatcattcctgtaatcaacctaggtctcaattagagcctgatgcccagcaccgctcttccgtatctctttttaccctaccattatggaagaacttctggagctagtatgatcatcttttaaacagcccagttcacccttgggtctgtgcagtatgtgtatcctcctaccactttgaaaaattatctctggatcaattatttgccttaaagtaagtgggtaattgactcccccaagactgcttttcttcctgtgcttaagaggttatgaatgagtgttttctttgggagagcagcctaaaaggggtcaagattttttttgttgttgttactttcacatgtattgattaaaaaaaaaataaaggggagagggagttttcaacgggaagttaccatctatccctggttacattgatttgatggccttcggataactaatgctagctgattagtaaagctgtacctggtgactacacctggttcctgatggcattatctcacatttgttggtcttttcctaagctggacgattctactgttgccagggaattggccatcacagactctgagcactcagacgctgaagtctcctgtacagacaatggcacattcaatctttcaaggggccaaacacctctaacggaaggctctgaaggtgaggggagcctttgacctcagttgataatggctctgactgttgcctcttagcttccctgaacagaggggatactggtgcttgcccctctcctgttttctgagctatggatcaggcggcagagcagcctgagtgctgtggctacagccaggatggcactgctgcccttcttgaagactttagtcccttagtagcctcaggcactagcctcacaggggacatagaagagagggggaattgtgtagagatcacagccacctataagtggaggggaaaggtataccagtcccatgggtttatttcgccctgagaaagccagggtgggaaaaatctggtcatgtggggctggggcacaggagggccaggtaggtgccatgactcagacacttctgtattccaccagacctagatggtcacagtgatccagaggaatcctttgccagagaccttccagacttcccttccattaatatggatcctgctggcctggatgatgaggacgacactagcattggcatgcccagcttgatgtaccgttctccgccaggggctgaggagccccaggccccacctgccagccgggacgaggctgcgctgccggagctcctgcttggtgctcttcctgtaggatccaacctcaccagcaaccttgccagcctggtctcccagggtatgattcagctggccttgtcaggggcctcccaaccaggcccttctggagcacctgcccagagagcaacgagaggcttcctccggtcccccagttcagacctggacactgatgctgagggggatgactttgaacttctggaccagtcggagctgagtcagctggaccctgccagttctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcagtcactgaagtgagagtgtgctcccccaagggaggcttctctccatcaggatggtactttgggggaacaaaatagtcagggatattggttcccctttgaggaggtgctgctgtttgcttttaggtatgagtgctcaggggccctcactgaaagagcccatgcctgccttcctcctttcatcgcctctctagagcccccaaagtcaggcagcagctggagtagttacattgtcatcatctttttttttgagacagtttcgctctgttgcccaggctggagtgcagtggtgtgatcttggctttctgcaacgtctgccttccaggttgaagaggttctcctgcctcagcctccttagtagtgggattacaggtgcccgctactatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtgatgtgagacagaaacctaaacatggtacttgattctaaacctgtgccagtctatagcctctgcctccccaagcagagctcaagccaaacgcttctgtcctctttccttctgcattaaccctttgctgatcctcaggggccactcccccaacacccctgtacttgggtgagggatgttggacagagcctgttttcatgtactgcaggtgggggtgtgctgacatgtttgctcttggttgatggagaaggtacagaggccagggagtgaaaatggttgacagaagagggaagagttaggtgtctcatagtcactcatagtggggtggtcaggggtaatggcatctccccactttaggcttctcaaacagacttttgacacctctcaagttcagagctctgatgtggaaagacaggaggtgtggggaaggagggggatttcgtgtgtttgcatgagtgtgcgcttcaggccttgggagttggcaagagggagggaaggaaggagagcaaaatcttcggaaggtgtttcttgtacctgagggatcctgccctgaatctccatagtctccactgtgaactgaggaggggaggggtgtgctggggaataaatcttgtatgagaac

SEQ ID NO: 37772 - DNA, 71406 bp, Homo sapiens
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcaggcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctggtgagtcccgccgacgccggggccccagccccgcgctccccggcccccgcgggacttcccgccctcgacccaccggccccctggtccggcccgggattgtgacccgcgccccctccggccccgcccgcccagtgctccccggcttccgcggcggccgggcgcctggggcgggagaggagcctctgcggagcctgggcgcggccggaccccggttcgcggggcgcggcgccagcgtcgggacggtgggagagttcttgaacgacttcccggtctttgccaaaagttacatccacagcggtgtttgtgggtctcttacggctataacggagttgaaggcgcagtgcggactgattgaatagcggtcatcttttgcagccgtgagcacttccgagcctccctgccgccgggagaaagcccggctcccctggcttttcaaaagctctcccgttttatccgatggtgtggtcgtccaagttttcctccattgggattttaaaccgtttttttcccgccttgactcttttgtactctaaaagaacgcgtttgttcactgttttgaacctttccagttacttttgtagatttatctcgcttgttagtaagccagcggttttccaagtgtggttacaactattttcgttaatagtaccaaggtcgtgtacatcgagttttccaaaggctacatggtatggagtgatctcaccgccgtttggaggcccgatgcctgtgtattcttaaaaacaaattctcccttttaatttttgatagtaaacattggtggttttcatctgtgtaaacaaaagctctttggaggctggagaccaaaaagtttgagaaccactctactaagcaacctcctacatgagaagtttaaattgtagaaacagttcagattgcaggctgagagattagaggatccgtccaaagtgacaccgttggtttgttttatagaacctggacaaagatttttctccctgattcagcccaggtctcttttcattctatcgcgtattttttaaaaatctcaaattttctgtctggacccccttgtctcagttgctgtgtttgtgtgcatgtgtgagtgagggaaaattgaggggtcctggtgaggaaaatgtgttttataaattctttgattcatagattacgtatccaaacaagcttgagcagaagagaacacttcatttagctgatgttagatttatttttaattgtacttaatttgctttgaggctaactttacttattttcgaattaaactgtattttgcgttaattgtagattaatatgcagttgtaagaaataatacagtatagtgagaaccctgtaccctttatccacctttccacaataagatctggcaaacccatagtacgatatcacaaccagcatattgtcattgattgatacagtgaagataaaggatgttcccaggaccaggaggatcccttaatgcctttttataaccacacacacttctttcctgccctgcctccttcttaaccccagacaatcagtgattcgtttttattcttataattttgtcattccaagacttatataatggaatcacccagttagtaaccttttgagattggattttttttttttcaactcagcaaagttctggagattcatccaggttgttgcatatatctgcagtttgctggggtagtattccatggtatgattgtgccacagtttgaaggatatctaggttgttttcagttgttggctattggcaataaagctgctataaacattcatgtacagtaactcataatgtaagcataagtcttcagttctttgggatagatgcccaggaatacaattgttgggtcatatggtagttgcatgcttagttttgtaagaaactgccagactttctcagaatggctgtattattttgcatccctaccaggaaagtatgagaggtccagtttctgcacatccttaccagcatttggtggtgtccttatttttaatttagccattcttataggtatatagtgacacctcatggtgattttaacttggatttctcgtattgtcacccaggctagagtgcagtggtgccaagatggctcacttcaacctcagcctcaatctcctgggctcaagcgatcctcctgcctcagccaccccaagtagctaggactataggtgtgcaccaccacagccggctaaatttttgtattttttgtagaggcaggggtgtgaccatgttgcccaggctggtctcaaactcctgggctcaagcgatcctcccgtctcagcctcccaacatgttgcctattttctagttagattttttttttctgttgggtttaaagttttttaggtatactagattccagtcctttctcagatatgtgatttgaaaatgttctctttcagtctgtagtttatcttttcatcttctaacagggtcttttgcaaagcaaaagttttcagttttgttgaaatttatcattatttccttttatggattgtgcttttggtgtcaagtttaagaactctttgcctaaccttagatcccaaagattttctcttatttttttcctaaaagttttatagtttatgttttacatttatgttatgacccattttgagttaatttttctgttaggtgtcagacttaagttgagggccattttttggcctatggatgtccagttgctccagcaccatttgttgaataggctccctttccattattgagttgttgatgcacttttgtcaaaagtcagttgagcatatttgtgtgggtctgtttcagtctgtttctgggttctccgttagcacgcagtcttgattcctgtagctgtgtaagtctgaaataaggtagactgatttctcccactttattcttctctcccccagatttttagctattctagttctgtgcctctctgtgtaagttttagaatcgtcttatctatatttacaaataattttgctgggattcgagaggaattacattaaatgtttatatcgatttagggagaattgatagctttactatgttgagtcttctaactcatgtacatagtatttctcttcatttctctctttttttttgaagacggaatgtcgctttgtcacccaggctggagttcaatagcatgatctcagctcaccgcagcctccacctccctggttcaagcgattctcctaccccagcctcctgagtagttgggattacaggcatgtgccaccacgcccggctaattttttgtatttttagtagacacagggtttctccatgttggtcaagctggtcttgaactcccaacctcaggtgatccacccgtctcagtctcccgaagtgttgggattacaggcgtgagccaccatgcccggcccagaccttttttttaatagaagaggatattaaaattcagggaagtggctgggcgcagtggctcacacctgtaatcccagcactttgggaggcccagatggatggatcatgaggtcaagagattgagaccatcctggccaacaccgtaaaaccccatctctgctaaaaatacaggaaattagctgggcttggtggcatgcgcctgtagtcccaactacttgggaggctgaggcaggaggatcacttgaacctgagaggtggaggttgcagtaagctgagatcgcgccactgcactccagcctggcgacagagtgagactctgtctaaaaaaaaaaaaacacctcagggaagtttagtgtctcgcttaaggaatcacagctagtgattgtgagatctgctctgtgtcatattgtccctgccattatctccaccatgctccttattaggaattgcatcattttatgattcaggagatcctggctgtataattagttattgttgactgagatagtggatcttgaaatagtgttgagtacagtccactgactgccttttcatctcccgagaaacacagccataattttccacttcttcagttatccttaccttttaagtggtgaccaaatctttgcaattcctgtccgcatttgtcatttcctgttttagctacaatgcttctgaactttttttctcattccttctcagtttttcttcagtgaggataattttcgtatctaagaggcttctcatttgttttactttctgtcttgaagttgtgattcttaattctttcttgatctttttttttttttttttttgaggcggagtcttgctctgtcacccaggctagagtgcagtggcgcgatctcggcagtgaaaagactcagttcccatgctgcttcctctgaagctttcccagagaaccccagcccctggcagccaggctgcttctcatttggtatttggtcatatgctaccttgcagtacctcctaatttatgtttttgtattgttaaccttttgcatcaagtaaactctgcatttttttcgtccttaattaaatgatctgttttctggaagagcaacctgtattattctttgtatcctccatagccatactcatatatctttgaggacaggcattatttttttatatggaaagtatgttatcttggacaattttattcttgctgaatgttaaatgaataaattataaatgcttgcaggcagccaggagctgtttgttcatctacacttatgttctaatgaagccccactttccctaggctgaaacactgatagtgtcatacttttcagatagtcccagaccgattttcattataacatagtgccaggttatgtttggattaattgattgattgattgatatattttggtctgtgggaaagaaggagaaggatgctcttaaatttttataatctactgcaggatagagtccctctcttcaagaatacatacaggacccttgctttcaaccatattaatgtgatttatctctgctttagattttgagcattcctagtataaaatgcctgatgcgcaaagcttttgtaatgagaactttaattcttacactttcttctgataatatctggaaggttgatttagataatgctttatttagaaaatttaatttttttttaggatttgtatctactactgatttaaggattttggaggaggaatcatgtatctcatagtcataatgacgaaagtaaaatattttaaattctaatgttaaataccttaaaacaaatatgatttaatagcttgggatatagcacttatactttgttggtattacttttagtaaataggctacctggtcaggctccctggtctgtgccaggtaggatgggctccccagcccctcctcactagtttcagcctaagatcatatgaccaaggaacttaccaaagataaggtagaaatgtggctattctctgatttcctttaccttcctcccttaagaatcagatcaagtttatcctgccctctgtgtggtctgtatttatggggatagcaagaaagtcctattgtcttagagtgcgtgttacatagaaagagttcacaaattgtgaaatattaggtagggagtatattgatggataccttgaatgttctgtgagtgtccatgagaaaactgtatcccagtctctcatggacaaatagaagctgtgcatggtgacatttttccttagctgcatatatactatttggcaggaacattgccttgagctctaaattagtccagaattactcaaatgatttttgaaaattaaaataaaaagctgcttttgttataaaagacctttaagaggatagttgactaagtttaattctatgtgtatagatgagaaatgttctcactgacaaattagtagctagttctgctcaatctgaatgagtcacggcttcagaaacagacattgaacttttccccatctccagcataatcttcagttttttttcccatttgcactgcatgaaatctactttatagaaagtccttttgtcgtcttataaaagtatagatacctccagacaagttagtcagtgggtgactttcctaatgcctagggagatcctgggaatcaaggaagtcagagtttccctaggggtgaacacaggtaggtagttttgatttagggcaggttgggtgagaagtcaggggaggaaagactaaactttgcctttttcaaggtttatctagaacagtgtttctcaacattttttcattattaccccctcaggagaaaaattacatttaaataaaatgtaattaataacagatttaatttttattaaattagcccaggtaattaagttctccctaatgggaggaatccagtactaaagaatatacatttttcagataaggttgagctttggtgagggccacagaccatttgtttatttatttatttttgtcctcccaagaaccgatttctgctctctttagggggagagataatacaggtactgcccccattgagaatgcatgatccatggttagccatcctagcaatagggcaacatatgttttttcttctgagtctgctactagatttgaaaacagtctaagactaaatactctgtacattataagttaaatgaggcattcaagaacttactcaggaccttagctgtttgtaatattgtttctatggagactgtagtcttactccaagcagcttactaatatgaatttttggaaaatacaaattatttgtgtgattatgatttatactacctttaaataagtagaatgaaagctttttacaaaaagctcaatattgagctaaatagtaaacgaagcgatggccatggattagcggagaagagcaggctagacattttagacaggaagaatattcactgtctgacactgtttatatgctgaaacttaaaataacatgagaagcctttcaattcttcactattcatgaaagaaatagctttgctgggcgtggtggctcatgcctgtaatcccagcactttgggaggctgaggtgggtgggtcacctccggtcaggagtttgagaccagcctggtcaacatggtaaaaccctgtgcctagtggtgcgtgcctgtagtcccagctactcgggaggctaaggcaggagaatcgcttgaacctgcgagacggaggttgcagtgagccgacattgcaccactgcactccagcctgagtgacagagtgagactccatctcaaaaaaaaaaaaaaaaaaaaaaaaagcttaaaatttttagtgcaattttttttttaataaaagggaactttttagctattattttcaacttttagtggcctagtaatctctgaagatctttgcaggtaataaagtagtcaagatatatttttctgtggacttgtcctttatggctataactatgtccactatggtaattgaatgctaccagatgctgaagtgcattcaccatggcaagtacttcccttgtgttatcacattttattttttattttttgttttttgagacagagtcttgctttgtcgccagactggaatgcagtggtgcagtgttggctcactgcaacctctgcctcccgggttcaaacgattctcctgcctcagcctccggagtagctgggattacaggcatgtgccaccacacccagctaatttttgtagttctagtagaagcggggtttcaccatgttggccagggtggtctcaatctcttgactttgtaatcctccctccttggtctcccaaagtgctgggattacaggcatgagccacggcacccggcctgtgttaccacattttattctcccagcccatgagctgagtactgttatctctagttttttggatgagatgcaactttcacacatccttgcacaaaatgtcttttgtttcctccatgttgtctttgtacctccttgccccagacctcattccaggctttggcagttcttaatgatgcagcattttgcatctgttgctactatacagttaattctaacagccttcttaacatacatttatactgatgtcatgctaactcttcttctttgtgacatggatcattgagagaatttctgggggctctctgttttggtagaagataggctgcttgtcacatagtaacagaaattctgttgtatagaaaagaattataatttacagtttccatgtaactctgaggactaaagaacctaatacagcattataatttgaacagttggagaaaataattttgttttgtatttgcatattttgctatatattttcttttttgttgattacaaaaattatacagatattatttagcttatcctcaggtattctgattagcttttttagctacactttcccatttacctaccttttagtcagaaaattatgttatacttttatgaattaactttgttattcaagtacaatttatttatttatttattattattttttgaaatggagtttcactcttgtcgctcagagtagagtgcagtggtacgatctcagctcactgcaacctccatttcccgggttcaaacgattctcctgcctcagcctcctgagtagctgggattacgggcacctgccaccatgcctggctaatttttgtatttttagtagagacagagtttcaccatgttgggcaggctggtctcaaactcctgacctcaggtgatctgcctgatcatactagtaatatggtataattatattcagcccaaaaactaagcctgactggcttgatgaattaagctgaatctttaatgctcttatcagtgtagaacaattcaagtctcaaggaatcaatggaaacttcaagagaagtgagaattaccactgggccacgtatatttgtttttgataatgtaaaattttacataaaagttctttgagggatccaaggtgctcataggaaccttaaactcagtagttccaaagttgcatcaaacctgtgctgattcctctcctattctctttcctgcttcacagtgacgtctctccagtgaccttagtttgagtcacttggactcagaatcatgaagtcagcttcttgcagcctcaccttttctgctgtccttgcatttacatgtaagcctccttgggcttcagtgatgagctcactgtgattttccaaccataccagttatatttgtacccttggcacacgcagattccactactgtgttgtccctcccctcccctccccagagtctcgttctgtcacccaggctggagtggctcaatcttggctcactgtaagctccgcctccccggttcatgccattctcctgcctcagcctcttgagtacctgggactacaggcacccgccaccatgcctggctaattttttgtatttttactggagacagggtttcaccatgttagccaggatggtctcgatctcctgacctcgtgatcccacccgcctcggcctcccaaagtgctaggattacaggcctcagccaccacgcccggcctcttttcttttctttctttcttttttctttctttcttttctccccgccccgcccctccccttcccttcccttctttcctttctttctttttctttctttctttctatggggtcccgctctgtcacccaggctggagtgcagtggcgcagtctcaaccactgcaacctctgcctcctaggttcaagcaattctcctgtctcagcctcccaagttgctgggattacaggcacacaccaccacacctggctaattttttttttaattcttttttttttttttttttgaggcagagtctcgctctgtcgcccaggctggagtgcagtggcatgatctcggctcactgcaatctccacctcccaggttcacaccattctcctgcctcagcctcccgagtagctgggactacaggcatctgccactatgcccggctaatttttttgtatttttagtagagatggggtttcaccgtgttagccaggatggtctcgatctcctgacctcgtgatccgcccgcctcggcctcccaaagtgctgggattacaggtgtgagccaccgtgcccggcttaaaattttaattagagacggtttcaccatattggccaggctggtatcgaactgctgacctcaggacccaccacgcccaacctgtcttgtctttatttgctaggaaatttcctgtttcttcatcaagtctctgctcaagccttttcttgccagtgctttctctgactatgtagatttcattataccctgagtgtcttttccagatttttagttgtatgtatgtctcccaattgtactaagatttaaattgcaaggatattgatttatacagcttcgatccacaatacctggggtctgttattctgtccttaaaatgtaaggctttaaaaataatattatgaggccgggcgcggtggtgcacgcctgtaatcccagctctttgggaggctgaggcaggcggatcacgaggtcaggagattgagaccatcttggctaacagggtgaaaccccatctctactaaaaatacacagaaaaaaattagccaggcgtggcggtgtgtgcctgtagtcccagctgctggggaggctgaggcaggagaatggcgtgaacccaggaggtggggcttgcagtgagccgagattgcgccactgcactccagcctgggtgacacagtgagactgtctcaaaaaaaaaaataataatattaataatgataataataacattatgtacatttgtggagtaagtgaaaaacaataagcattgatagacttcacactgattcctaagtattcttttttcccagatgttcctgtcaactttaggtccttttaatgcttttttgttttgttttttttgttttgtttttgagacagggccttgctctgttgcccaggctggagtacagtggtgcagtcacagcttactgcagccttgacctcccaggctcagatgatcctcctgcctcagtcttccaagtatcagtttccacaggtacacaccactgtgcctggctaattttttttttttttttttttgagacagggtctgcctatgttgttcaggctttaagtccttttaatgggtatctatttctcttccttccccttttcttcagctcctctctcatttgcttttcctgggctaaataaatgacttctcaaatttcattggcttttctgtcacctagcctgcatggaacatgctctcttttgaaggaattcgagccatctagtaatccttttttttttttttttttaatttgagatggagttttgcttttgttgcccaggctggagtgcaatggtgcgatctcggctcactgcaacctctgcctcccaggttcaagcgattctcctgcctcaccctcccgagtagctgggattataggcatgcgccaccacactcagctaattttgtacttttagtagagatggggtttcaccattttggtcagggtggtgtcaaactcctgacctcaggtgatccacccgccttggcctcccaaggtgctggcattacaggcgtgagccaccgtgcccggcttactttttatttaaataagccttgagatttagttccacagggtcttttcacatcaataagatgcaattttattgtcttaatcttaattttattgtccttaatctccctttctgttcatgcagtttctgtaagttgttttcattcttcacatcacaaactttctctcattgcttgttccaagttatagtcataaaatctgagttgaaagggatcttagaaaattgttacctttgttacccacttagtacggaaatcagctctgtagtattgataggggttactgtgccgctgttggaacccttccagggtctgagctcagtgcttcctaggcagctcatttctctgttagacaacttgaatccttcagtcatttcccttccttgtgtcaaaatctgcctcactagtctattcatgggtcctggtttttccctcgggaagcgcatttccatatgacggactgaatatactttgctgtcccttaatcctcttatgctgcggtaggctaacaacattgggaaaaagtcatatttccttgactcatacagtgctagaaagtaacttgtagagtattagaaaacttaatctgtaagacatcataaaggaagatttagttgctttttttttttttaacttcagggtgtagaaagatattttgagctttatatttaaggaagaagccgtaaagaaaaagatttatagtttagtctttatgaaaactggaagggtcagtaataaatcaggaaaagatatttatgatacacatgacaagcaaagagttatactcagcagctcttactaataagagaaacaaagaaggagtaccctgataggcaagtgggaaaacatgaattggtgatttatggaaatataggagaaatggccagtaagctgaaaaatgtttaaaatactagaagttaaattaagatgttagttttgcctgtcaaattgacagaaatttaaaaattgttaataccctgtactgatgaatatataatgaaatggacccttttatacacttgtgtttattgtgaaatatgtatttggtctttgacccctgacatacaactgctgaaatccttaaaacttccaaagtgatgtcttttgtatgctaatgagatgactggtggctggcagcccctaggtagcttaaggatggggctggtcaccagaaagaacaaggcaagattagagggttgggactttcagtttcatcccccagtctctaggaaagggagaggggctgaaagttaattgataccagtgaccagtggttaatcaaccatgcctgtataatggaggctccttaagaaccaagaaggactgggttcagagagcttgcagatggccaaacacatggaggcttacacacatccatgtgttgggagggtggcataccctcctccatggggacagaagcccctgggcttgggactcttccacatgttgagctttgtatctctttatctggctgtttatttgtatcttttaaaatattctttgtaataaactggtaaatggagcaaatgaacaaattaattgaacccgagatgggggttgtggggaccctgatttctagccatttgttagaagcattggaaaataacctggggctggcgatgagcagaggtggagtgggaatggggcagagtcttggggactagccctcagtctgtgggatctcactctattgccaagtagagaagtcagaattaaattagagggcacccagctagtgtctactacaaaactgattgcttggtgggtgggtgggaaaaaacttcccacatttggtcacaaaattatcctgtgttgtgtgagagcagaggaaaaacagtttgtggttttttttttttttcaactcattgctaatattagaaatataagcaggtaggtccagtctttttgaggggcagtttggcagtatgcttggaacaggaattatattctaggaatttatcatgaagatattgtcagatgcacagaataattgatggttatacaggtgagttgggtggaattctgcaagcagacatgtaggaggagctagcagtgtaggagatttcttggagatgaggggcaggggtagtattgcctgtgaaagttgaagagggaagaaagcaggacatgtgggtgctggggagaaagccttcaggccctgatccagatcttaatagccgtgcaaggaaagaagggaggaagcccaattgagcagtgagagctgcagaaccgtgtggatctgacaaagtctgggccaggcagccctgacatccctactgtgcccagtcttcaactaccagctgcctagggagaaagtggtcttgggtctatactgcagcagattccaaaggctctacaggtggagacggtcagcaagctgcaatctttgtaggccacaggactaggtattgcttgaagggagaatcagaatggcgcacctgtttggctgccatgagaggaagttcgttgtagtgttagtaaaatagcacaaattggaacattcattgcagtgttactgaaacagcacaaattagaaatgatattttttctataataaatttctaattaggaggagtaattttaaaataagattgcatttgtattttaaactgtcattgttatggtgcaagcttttgttaagcttgagactcttaactcttttatatgaactgctatcaagaatttccccatcttgatgatcttttgagactaaaaagtagaatttgcagttatcctttaacttttgatgtatttgttggagtttgatggtataatggaggtgctattttgctgggattggacaaccctaagccttgctgtactgacaccctccggaggatatgcaaacaggccatgcacactggaggccaacttgctgctgccttatcttgctcactcttggtaatttcacttgagttctttttttttttttttttttggagactgagtcttgctcttttgcccaggctggagtgcagtggcacaatctcggctcactgcaacctccgcctcctgagttcaagcagttcttctgcctcagcctcccaagtaactgggattacaggcacacaccaccacgcctggctaatttttgtatttttagtagagagagggtttcaccatgttggccaggctggtctcaaactcctgacctcaagtgatccaccggtcttggcctcccagagtgctggggttacaggtgtgagccaccgcgcccggcctccacttgagttcttttttttctgggttgtaataagcatccacttctagcagtgtggtctgcattagcttgaataactgaatgttactacttgttttaagaaaattttagatcactgttaacctgtaactttattttaacttgaattttcccttaacctgaagatgttataaaatgattttaaataatgagtctgtggaatctttcaaagtattgtttcaagccaaataccccaccctcctgaaactcataaaataggcccagataataattttttttttatttttatttttttttgagacctagtctcactctgtcacccaggctggagtgcagtggtgtgatctgggctcactgcaacctccgcctccctggttcaagcagttctcctgcctcctggtaaatggaacaaatgagcaaattaattgaacctagcctcctgagtagctgggattacaggcatgcactgccatgcctggctaatttttgtatttttagtagagatggggtttcaccatgttggccaggctggtgttgacctcctgacctcaagtgatctacctgcctcagcctcccaaagtgctgagattacaggcatgagccaccacgcccggcctcccgatgataattatttaggccactttttgctttttgttctctctcgctctcgctcacattatcctaaagaatgccaaaaaagacctcatagaatcccaagggacagtttaaaaactttggttctatattttggactaactttataataataaaaattttggaaaagtgaagttaaagtcaagtgattatagggccgggcgcagtggctcacgcctataatcccagcactttgggaggctgaggtgggcggatcacctgaggttgggagttcgagactagcctaaccaacgtggagaaaccctgtctctaataaaaatacaaaagttagccaggtgtggtggtgcatgcctgtaatcctagctactctacttgggaggctgaggcagacaaatcgcttgaacccagaaggcagaggttccagtgagctgagatcacgccattgcactccagcctgggcaacgagagcaagactccatctcaaaaaaaacaaaacaaaacaaaaaaacataaagctaagtcaggattctgtttcctgaggctcattggtctgcttaaggggtggctgtaaggcattttcagaaatgtttcccagcagggtaaggaaaattgttacctaggggcctgttggaaaagaagcatcagaagtttatctgtaattggtggacaggaaaaggccatatttcccaagggccctaggatgaattgtgtgtctgtcacattgcctgtatcccacaaactgagattttaaaaaaggtgcagcaccagactttcctccagctatcccacgtctggcacttctttctaggattcatagataatacaactttttaaaaagtatatggtagaccttgctaggagttaagttactgtatgggatttttccttttggaaagtaggtgtgtagatttatatatggttttgtgtgtgtgtgatatatatgtatctttaaaatagaagctacaggaaaagcaaattgactgtgtagtcaaaggtggtttgagatggttagtctccttacccccttgtgcgttgaaacgagattgtggtcacctattgtgcattcatgtttctctgagacagagtcacaaggtccaggaccatgtcttactactgttgagactgcggagcctagctgagtggtttacacatactaagtgggtggtcaacaatagagcaggccagaattcttgcagatttttaatttttttctaatttagtgtttcttagccctacacagagctctgtttgccattagagggattcagccaactcttgtcctattattacttttcctgctaatttattaaaaaccttttccagccaggcacggtggctcatgcctataatcctatcactttgggaggctgaggcagacaagttgcttcagctcaggagttcgagaccagcctgggcaacagagtgagatctcgtctctacaaaaaaattagccaagtgtgctgggatgtgccagtggtcccatctacttaggaggctgaggcaggaggatagcttgagcttgggaggtggaggatctcggctgtcagtcgagatcatgccactgcactccagcttgggtgacagagccagaacctgttttaaaaataactaaattaataaattttaaaaaaattaagaaaatcttttccagtattaaacttgttttggaaatttaactgaccaagtagtactagtggaaaatatttgaaataattattcatattactttaatgtgactcatttaaacttactaatcaaaacatttatccactgagattttaagtaggctttttggccaatgttcagaaacacagtaaatgaataaacaaaagcagatatttgatatgaacttacataaatgacagaaatttaacctatattttatttaagtttaatggcaaatgagtataaagcctctaatttttttctttttttttttctttttttgagatggagtctcgctgtctgccaggctggagtgcagcggcgcgatctctgctcactgcaagctctgcctcctgggttcacgccattctcctgcctcagcctcccgagtagctgggactacaggtgcctgccagcacgctcggctaattttttgtatttttagtagagacggggtttcactgtgttagccaggatggtcttgatctcctgacctcatgatccacccacctcggcctcccaaactgctggaattacaggcgtgagccacaccatgcctggcctaaagcctctaatttttttctaagcaaattttacttatcaacactaagcaacatttcaccaaaactcatgatatgctatcattatattaaaaactaaaaaccacttttttaccagtaatttttaaagtttgattttcagccgggtgtggtggtgcatgcctgtaggcccagctgtttcggaaactgaggtgggaggatcgcctgagcccaggaggttgaggctgcagcgagctgtgatcgcaccactgcactctagcttaagcaatagtgggagatcttttctctaaaataaaataaatattaaacttaaagttctatacttgacaagtcaaaataatatagcctcagtgaattatatgtgttgtgcatcacttatagtagacacagatgctgagaggcaagcaggtagtatgttaggtccggaattaacgacaagcatggaatgttctaccctcctcctcattgtgtctaatgcagagctctgaccagggcccctagccagatattatctgtggcacttagcctttagcagaaagtcagactctaaatggacatttctggtttactcagtctgccactcaggtattgtctctaatctgttcgttttttccttcaaattcttacacttactgtactttctccaagtacgaaattctgccttctggtgtttagggattttttttctaccttaaatttctcatctagatttatacctctttcctgactcacttcaaagtcattttcttctttgactcctgccttcagtgatctctaatttctccaaatttctgtaaccaccactgtttgtttccaggggctctcactttgtttctgtcctacagactagagggacgtgatactgcttaggtaccacatgatgactgggactggggggcctttcagaatggcagggtgtaagtgaagtatatgtgtagttaaaagctaaagcctgaagccaggtattaaaatcaggctagtctctgatgtgctttgtatcatttacatactttttgccttttagattgtaaaaacacaatcagaaccgttgtgtccctcactgagcttttgcgtgcttttaaataggagcatcttccaactgacaagtgtcattttgtgttggaaaaacttaggatttgaaaacactgttggctgggcgtgggggctcaggcctgtaatcccagcactttgggaggccaaggcggtaggatcgcttgagttcaggagtttgagaccaccccggccaacgtggcaaaaccccatctctactaaaaatacaaacataagccaggcgtggtggtgcttgccggtaatcccagctgctcgggaggctgaggcaggaggatcgcttgaatccaggaggcagaggttgcaatagctgagattgcacccctgcactccagcctgggtgacggagtgagactctgtctcaaaaaaaaaaaacacattgttattcggagtgttcagtcacaaggtcagcctattttatcaaaatgtaccagcaaaagattgttgttagcatatatgaaatttagtcacgatgtacactattttgtctctgtaagatttattcactgtgtatgtgtgtgtgtgtgcatgtgcgtgtgtgcatgcgcatgcgtgcacgcgcccgcacagaggatcacggtgaggtggtgggagcacccaggttctctctttcattgcaatgccgtttgttgcagcatggttcattgtaattgcagaggagaggacagtctcaatgaagagcgtcgatatgtatacaccacactgtagtatacagaggagaacactgtgctgtagaaagaatgaggtagatctaaatactactgcgaaacagtctccaggagagattcagcaaaaaaaaaccacagtgcagagcagtagacagctaccatttatataaacaaaggaggcctgcttagacatgcacagcctctctctggaaggatgcgtaagggtctggtgcctctcgggaagagcgctgagctattagagaatcaagagtgggaagggagtaattgtgcactgtattctcattgacaccatttgcaattttttttttaccacattcatattaatattgttttttaaataatgtgacatttcctcattatcttgtgctgtattcagaagtaggatagcagtaccttggaattagtacagtttttcttgtacctctcttccctcattctctactgttgcgaacagtgaatatccatttggtttacaacttgaggcagtagaaggaacaccagtttggcagtcaaatcagacctgtgtctatacactactggcttgtatgattttgggtaaattactcaacctttcagaatctgaattttttcatctaggctgtgggaatgttaatatgtatagctcagatgtattgtaaggattaaataagaaaataaacttaatgagctagcatagtgatatggacgtgtaatatgagttctataaatgattattttagtgactaaggtacttgttcaaattataaaatccctgctttccccaccacaccacaattgtagcattcttgacatttgtatttcctctgacacgctgcagtggaacatacctgattttgagggacttcttggctcttagagtatctttaaaaatgaaaaggccaggcgtggtggctcatgcctgtaatcctagcactctgggaggccgaggcaggccaatcacgaggtcagaagttcgagaccagcctgaccaacatggtgaaaccccgtctctgctaaaaatacaaaaattagccaggcatggtggcgtgcacatgtaatcccagctactcaggaggctgaggcaggagaatcacttaaacctgggagacggaggttgcagtgagccgagatcatgccattgcactccagtctgggtgacagagcaagatgccgtctcaaaaaaaaaaaaaagttctttctctctctacttgtaaatggaagtttactaatttcataaaatttttttgtgtgcaagtatattactgtatatgttgaatattatatgtaatttacttatgtagatacctatccagcaagaaagccacaatttcaaacacgattcaataatgtagactacacatcaaaacttggtgataacaacattattataacaccttattcatgtaaatatattattcagataatggggtttggggagtaatgtttctgtttccttttaagcctttgtattccttttttagctctttcagtctcacatggcaacgaaaacaacttgtatgtcttcacaaggatcagatgatgaacagatagtgagtatgtcttttaaatagataccatattgtactctaaatgcttctatgattttaaaataactacttggagtgcttatagactcttgtgatagagacttctgtttgtacttacctccaacgtgaattaatttttctgttgattcaagtgaaaagtcgatgatggattgaataattgagtatccacaatattcttaattgagtatccacaatattctgacattaaggaaatttttttttctgtttcttttttcgtttccttttttttttttagacagagtcttgctctgtcgcccaggctggagtggagtggcatgatctcggctcactgcaacctctgcctcccgggttcaagcgattctcttgtctcagcctcccgagtagctgggatcacaggtgaccaccaccacgtccggctaacttttttgtattttagtagagatggggtttcaccatgttggtaggctagttttgaactcctgacctcaagtgatctgcccacctcagcctcccaaagtgctaggattacaggccactgcgcccagccctatttctttttatcattcgttgtttgtttttgttttttgagacagagctttgctctgtcgcccaggctggaatgcgatggtgcaatctcagcttactgcaacctctgcctcccgggttcaagcaattctcatgcctcagccttccaagtagctgggattacaggtgtgtgccaccacacctggctaatttttgtatttttagtagagacggggttttgccaggttgcccaggctggtctcgaactcctggcctcaagtgatttgcctccctcagcctcccaaagtgctaggattacaggcgtgagccaccacgcccggccgttatttgttttttgagcacactgcagaatgtggtgggtgcatagaactcctgtgaatggcagagtttagggagcccttgggtggtcctgccagctgcctccctgatgcaagattacaccttatgcttctaagggtctgtggggaggggtttggtaattcatattgaaatttgtatttaaaaataggaagtaaatctggtgaaagaggtgagtaactagaaagaaaattacaaatacaaacataggtaattcagtaagttgttttttattttgtttgtttttgagacagggtcttgctcactctgttgcccaggctggagtgcagtggtgcaatctcggctcactcaacctacacctcccaggttcaagcaattctcatgcctcagccccccaaatagctatgattataggcatgtgccaccacactcggccaatttttgtattgttactagagacggggttttgctcgtgttggccaggctggtcttgaactcctggcctcaagtgatccatctgcctccgcctcccaaagcacttggattacagacgtgagccaccacacctggccagtaattcagtaagattaaataatttcctttagttctgtgctccaataactgtagtctcttgtttttccctctttctccatatatcaatggtactaacagtctattccatcttcctcacagactttttgaatgatgtttaatcctccagagattactgtcagagtcactagtaatctttagtgactagtccatccagtggctgttgcttggtttctttttccctggcccctcttttgtgttacatcatggggaccacaccctcatttttgaaatgcttttttccagtgacattaaaatcctgtcattgtagaactaaactagaagggatcctagaggccatttagttcaacttttatgtaataagcatatgcctatcagataacaactttaacaagttatgaagttcttaccatcttgaacactttcacgaggaagaagcctagtgcttcttcagtgctctttaaaaaaatatgaagataacatgcttacatgactaaaaatgattcaaatggcacaaaagagaatatagtgtactagttttctgttgctgcataacaaatcgtcacaaatttagcggcttaaaacggcatctgtttgttagctctcagttctataggtcaaaggccagacgtggcccatcttccttctctgctctgggtttcatactcaaggggtcagctgctgggttcttatctggaggctttccttccatactctttctggttgttggcagaattcagttccctgctggctgggggttgttgtcagctcctagagaccactccattctgaaagccagcaagggagaactggcaggtggagttctcttcatgcttcatgtctttggccaggaagtgcccaggccctgttaaggatttacctcatggctgggcataatggctcacacctgtaatcctagcactttgggaggcccagacgagtggatcacctgaggtcaagagttcgagaccagcctgaccgacgtgaaaccttgtctctactaaaaatacaaaaattagtcagctgtggtggcaagcacctataatcctagctgctcgagaggctgaggcaggagaatcatttgaacccaggaggcagaggttgcagtgagctgagaccacatcattgcactctagcctgggcaacagagcaaaaactctgtctcaaaagaaaaaaggaaaaaaaaaaaggatttacctcattaggtcaggcccaaccaggatagtctcccttccgaagactgactggtttgggaccttaatcactctgtaaaatctcttctcagagacacctaggttagcgtttgatttaataactgggagaaagtttgtgtgcaccaggggcatcggtgttagcgaccatctgagaattctgccaaccatatacaataaaaagcgatttcttctcaccccaacctgtaagtctactgctgactggtaaccactctcaatagtctgtcattacccttcgagatatttacatctgtatgtgtgtatatatatacatacatatatatgtgtgtatatatatacatatatatgtgtgtgtatatatatacacacacatatatatgtgtgtatatatgtgtgtgtatatatatatatgattatgtgaaaaatgcacataatgcatatttttaaaaactctgacctcagtaaataaatcactattgggatacctagctagtcatccatgttgtgacacgtatcagtagtttagtatactacagtttgtttatctattcaccacttgtttgatatttggaatctttccagtttttgaccattgggaataaaactgctgtgaacattgatgcataagttcttgggtggacatatgttttcattattttggatacctccaagcgggttttttttggctatataataatatgtgtttaacttcataggaaactgccaagctagtttccaaagcaactgtaccattttgcagactagcaaatttatcagcattccatttcttcattatctccaacacttgacatgttcagccttttaattttagctgttttattggatattcaatgttactttttatttatttttatttttattaatttttttgagacagagtcttgctctgtcttccaggctggagcacagtggcaggatcttggctcactgcaacttccgcctcaggttcaagcggttctcatgctgtagcctccggagtagctgggactacaggcatgcaccaccatgcccagctatttttgtatttctggtagagatggggttttgtcatgctggccaggttggtttcaaactcctggcctcaagtaacctgcctgccttggcctcctaaagtgctgagattataggcatgagccaccgcacctgacctgaccacttgaacctgggaggtggaggttgcggtgtgccaaggtcgcacgactgcactccagcctgggtgacagagtgagactccatctcaaaaaagaaaaacaaaaaacaaaacaaaccaacaacaacaaacaaacaaacaaaaaaaccacaaaaattacccaggcgtggtggcgcctataatcccaactactccagaggctgaggtggaagaatcacttaaactcgggaggtggacattttacattttcttgataactaattttctatatgtgccattgtcctttcattttcttctttcctaccttcttttggattaatagagaatttttatgactcaatttcatttctgcttttggcttattagctatacctctttcgcttttttttttttttttttaatagtaattgacctaggctttaacttaccacacccaaccttcaaataatataatattttagcctggcatggtggctcacgcctgtaatcctagcactttgagaagctgaggcaagtggatcacctgaggtcaggagtttgagaccagcctggccaacacggtgaaaccccatctctattaaaaatacaaaaattagccaggcgtggtgggcgcctattatcccagctactcgtgaggctgaggcaggataatcccttgaacctggggggcggaggttgcagtgagccaagatcataccacttcactccagcctgggcgaaagagcaaaactccatcttaaaaaaaaatttgtatatataacactttatgtatactgtagaaaccttataacaatattccttcagtcctcctgtattttgtgtttcttatacattttacttgtgcatgtaacctgtaacacattgtttttgttactgctttaaacatttgtattttcaagaagttaaaaaaaacctctcttacatttacccacatatttacctttctgatgatcttcattcctttttgtagatctgttgtcattttcctttctcttgaagaactttgatcattttttatactgtgggccaactggcagtggattttctcagattttgtttatctgaagttgtcttcattttgccttcatttttgaaggatgttttcattggctgtagaattctacgatgtcttttttttttggcggggggcattttataggggtcattgttttgtcttctggtttgcattgtttcttaagcaacatctgtagctcactgcaatgtccgccttctgagtttaagtgatcctcccacctcagcctcctgagcagctgggattataggtgccaccacgcccgggtaatttttgtgtgtgtttgtttttgtttttttttttggagatggagtcttgctctgtcacccaggctggagtgcagtggtgcgatctcagctcactgcaacctccacctcccaggttcaagcgattctcctgcctcagcctcctgagtagctgggactacaggtgcgtgccaccacacctggctaattttttgtatttttagtagacacagggtttcaccgtgttagccaggatggtctcaatctcctgaccttgttatccacccgcctcggcctcccaaagtgctgggattacaggcgtgagccaccacaccaggcctaaagttttcattatccttgttttttagcagtttgctgtgatgtccctagatgtgagttcctttggatatttcctgtttgtagtttgctgaaattcttgtatctctgagttcaagtttagaaaattagaaagttttcagtcactattatttagatatttttttccctccctcctaccccccactttcaccttctctctttctctaacttttctccttgtattccaattactggtatgttagatcatttgatactctcacacaagtttttaagactgtcatagttttatcttttttctttctgtgagatttttagcttggataataactattgaacaaatctgtcttccattatttgatctgctgttagtactaaatatattttttacttcagatgttgcatttttacattctagaaattctgtctgctgctttttgtcgttgcgagctctttcatatctttctgtaattccccgtcatgccacccattatatccatctttttcctgtagattctttagcatatttgttatcattatttaaagttcttacctgctaattaaacatctggttcattgtggctctctttctgttgactttctttcttgactgtgaatcacatttttctgtttttttcctgtcataatttttttattgtatagtagatactgtagagatgctagattctgttttcttcttctgcagagtcttgaactttgttctaacaggcaattaaattgctgactgatcacattgatcatgttgagccttgttacaggctttgttaaggcaggtctgcttcagctgtgctttctgattgctgagttatggaccttactcctaaaatgtggcccatctagggtttcagtagaaggcctagggtgtttacaggagactctttaacttacaggcttaaaatttaagctctgtccatctctccaagatggcacttgaaaactctgcatagctcctcccaattcccattttcccccttctgggatctttgtattccctctgtatgtgtgcagtttggccatcagccatggatttgagtggagtgtgtttgtagattttggactcccttctttctggaattttctccctgaattcccaaccaatctgcctgccccaatctccaatggacatcttaacccattaagactataacttccctcctgagctctatcttccttttgccataatgactagggagtgccttcagggaaaaagctagataaactcatctcacctgataagtttccttccctcaagtcttattctgtccagtgtctatctgcctttggttgcactctagtgacttaaaagggttgcttgtaattgttaccagtaggcaggtaagtttgacctaagttactctgccattaccaggagctgaacctgtatctgtacttttgttttgtgcttttttttcacttgacattttaatgtaagaattttctaagtttttatcataaacaaatggactttaactttttattttgtaagtgaatatgccatagttggatattttcctattttggaaatcgaatgttttaatgttatacatagtgctagactctcgttgtatgaaggggataagaaatgtatgttttgaggatctggacacaggtttcttttcctgaaaatttacttaatcgcttgtatcttaggtgaggtataatgattataaaaattttcatttatttgatatatttgtccttcaagtgtgcctacatcctatttaagtcaaagttgttttttttattgctgttgtttttgtttttattttccttcagaaaagagaaaacattcgttcgttgactatgtctggccatgttggttttgagagtttgcctgatcagctggtgaacagatccattcagcaaggtttctgctttaatattctctgtgtgggtacgtgccacctactcttcctctaagttgttccttcatattccttgtgctcacttcattcttgtcatgggcagaacaatgctcatgttatcaatttgaaatcatgatcccagggattctctttagttgtttagattctgttagttttgtttttcttagctttaagcttttggcttgttatataaacatctcagtgttgttgtcagagtcctgagtagcttagcacacttactctatgctctgctaatgacttgggggaccagccgtagtgtgtatttctttcatgcgcaccctggcctttgaaatatttgggatctttgaaaccactctaggcatttacagttgtatttcttttcagccattcatgcaaccataaagatgtacctttgtgtgtttcaggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagaggtatgtgttttcttcttgtaataaaacaagtttttcttatttcaagacattcgccttatagccccatgaactatgatttgattttctcctatggtaatccatacctttccttccacacattgttttaaaaataaaataattaaacaatattttgttcttattagcacattgacatttttctagccatttgtctaatttctttagaataatttgaatcaccttattaaaatgtgcatttcagcaaaagtagctttaattatttcctgacatgcaaattcagtgtatattaattatactaattttcaggcagggcttatctccttgaagaaaaaaaatacaagacatataagaacaatatatacaatggccaaatacatgatgcttgaattttttgtaaaattataatcaaattagccagttacattattaatcattgcaggaaagttttgatagtgaaattttaatttatattttaccttgtgtctctatttgttttaatatttctcctaaggtcgtataaagattgagtagagattctatgctctatcaaatttaaactatgaaagggggaaaaggattggtaaagcaataactttttgttcgttttcctttttgaaatgtgtttcaatttttttttttttttttttttttgagacagagtctcgctctgtcacccagtctggagtgcagtggcatgatttcgactcactgcaacctccacctccccagttcaagcggttatcctgcctcagcctcccgagtagctaggattacaggcacctgccaccacacctaattttttttgtgtttttagtagagacgggtttcaccttgttggccaggctggtctcgacctcctgacctcaggtgatctacccacctcggcctcccgaagtgctaggattacaggcgtgagcaactgcgcccagtcttatttccatttttgtaagtaatttttttccttttaaaaaataatttcaatttttcgtttagatttggggtacatttgcaggtttattacatgggtatattgtgtgatgctgaggtttggggtacaagtgatccaattacccaggtagtgagcatagtaccaatagttagtttttcagcctttaccgggtatcttccttcccactctagtagtcccagtgtctgttgttgccatctttatatccatgtgtacccaatgtttagatcccacttacttataagtgagaacatatggtatttggttttttgttcctgagttaatttgcttaggataacggcctccagcttcatccatgttggtacaaaagacttgattttgttcttttttatggctgtgtagtagtccatggtaggtatgtaccacacttgttttatccagtccacgttgatgggcagctaggttgattccatgtctttgctattgtgaatagagctatgatgaaacatatgagtacatgtgtctttttggtagaatgaggtattttcttttggatatattccaagttggaatagctgggtcgaatggtagttctggtttaagttctttgagaaatctccaaactgctttccacagtggctgcattaatttacattcccaccagcagggtacaagcatttccttttctctacagccccgccagtatctgttgtgttttgactttttaataatagccattctgactgttgtgagatggtatctcattgtggttttgatttgcatttctctaatgatgagttatgttgagcgttttgtcatgtttgttggctgcttgtatgtccatgtcttttggccactttttaatggggttgttttttccttgtttagttgttagtttcttacagattctggctgctagactattgttggatgcatagtttgtaaaaattttctcccattctgtaggttgtctgtttactctgatgatggtttgttttgctatgtagaagctctttagtttaattggcaatttttgtttttgttgcatttgcttttcaggacttaatcgtaaattcttttccaaggccaatgtgcagcatggtgctttctaggttttcttccaggattcttttatttgaggtcttacatttcagtctttaatccatcttgagttaatttttgtttatggtaaaacataggggtccagtttcattcttctgcatatggctagccagttatcctagcaccatttattgaatagagagtcctttccccattgcttatttttgtcagctttgttgaagatcagatgcctgtaggtgtgcggctttatttctaggttctctgttctattccattggtctatttgtctgtttttataccacaaccatgctgtcttggttactgtagccttatagtatagtttgaagtcaggtaatgtgattcctcaggctttgttcttttgcttagtattgctttggctattcagtctcttttttgtttctttatgaattttagaatagttttttctaattctgtgaaaaatgacattggtagtttgatagaaatagcattgaggccagttgtggtgccttacgcctgtaatcctagcactctgggaggtcaaggagagaggatcgcttgctcaggagtcttgagactagcctgggcaacatggtgggacctcgtctctacaaaaaattttaaaaaattaaccaggcatgttggtgggcacctatactgccagctactcgggaggctgaagtgggactatcacttgagcctgggaagtcgaagctgcagtgagccgtgatcatgccactgcccttccagcctgggtggacagagtgataccttctcaaaaacaaaacaaaaaaacagcaatagcgttgagtctgtagattgctttgggtagtatggccgttttaactatattgattcttccaactatattgattccatgagcattttttcagtttgtcggtgtcatctgtgatttctttcagcagtgttttgtagttctctttgcagatacctttcacctccttggttagatatattcctaggtttttgcgtgagagtgagtgtgtgtgtgtgtgtgtgtgtgtgtgtgtgtgtgtgtctgttgtacatggcattgtgttcttgatacggctctcagcttgaccattattgatatacagaaatgctgctgatttttgtacattggttttgcatcttgaaacttcactgaagttgtatatcagttcaggagccatttggcggagtctttagagttgtctaggtatgaaattatattgtctgcagagagataatttgactttttcttttcctatttggatgccttttatttctgtctcttgcctgacttctctggccaggactttcaagtactgtgtgaaataagaatggtgagctcaggcatatcttgtttcagttctcaaggggaatgctttcatcttttgcctattttataacttgttttttctcattaacttatttgttggattgtttgtattctatcaattaatgaagcagtatataaatacgattctgtgaaaataccaaatggtacagatcagttggaatgcactttagccattcccgtgtgttcagtcccatttcttcccccagaggagccactgctctgaaataggttttttttttttcccagacctttctttagttctttttaaataagctttattaatatatactgtacatagaataaactttactgattttttttgtttttttttttgagacagggtctcactctgtcgcctaggcaggagtgcagtggcgcaatctcggctcactgcaacctccgcctcctgggttcaggtgattctcaagcctcagcctcccaaacagctgggattacaggtgcccgctatgacacccggctaatttttgcaaaagtagagacggggtttcaccatgttggtcaggctggtgttgaactcctgacctcaggtgatctgcccacctcagcctcccaaagtgctgggattacaggcgtgagccacctctcccggcctaactttactgattttaagtgtacattcaaaatgaattttcagaagcatatagcatgttgtaaccactagcatagctctaatataggaaatggccgtagtcatgggtattttgctgtcctgcatatgcatattattctttagccagggacttgggggccctctccagatgtgcagtgcttcctgcctgtgcagctttcttctcttctgttccaacctacagatgttgcttttgcctccttgaactcctgtctgggtttcctcaactcagtgaatggccaggcgctgtgctgtctttgcgctctgcccgggacacttgtccccagtcaggaagctgggacatggtagggctcataaaagagggcatttatttcctttttcagtggtcacagttttatactgcctgtttcccagtgttttaaaacctttttttcatttattttgttcaggtttctagttatttaaggtgagaagataaatccagtcccagttcctctatcatgactgaagacaggctttatttttctttctttcattgttaatgctggactgtactgggtaggacctgcagtattttgtaggatagtcagtgatggtagtgggcaccatcccctcatcatcctaatcccaaagagaaagctttattttttaccatgtaccatgcttgctttgttgtggtttttttgtttatttggttggttttgggttttgttttagataaaataaagaaattcctttatattattagtaaaagttctttttttaaagaatcattaatatatgctttcaccagattttttttttttttttgcattttatggagaaattgtgacttctttcatttaatctttagtaaggtgagttagagtaactgatttttttattggcaaattaaccttataattttagataccattctgagatcataatatagtgttctttttatattatgctatatttttcttttagtttttttttgcatctgtgttcatcagtgaagtttttttagcctgtattcttgtcttatactctttttttaagatggaacttcactcttgtcgcccaggctggagtgcagtggtgcgatctaggctcattgcaacctccatctctcaggttcagacgattctcctgcctcagcctcccgagtagctgggattacaggcgcctgccaccacgcccagctaatttttgtatttttagtagagacagggtttcaccatgtaggccaggctggtctcaaactcctgacctcaggtgatccacacgccttagcttcccaaagtgctgggattacaggcatgagccactgcgcctggccttttatttatttatttattttaaatcaagattgtgttagccttctaaaaggagtttaaggagttttcattctctattttctggaaaaatttgcataagattagagttatttttccctggaatgtttggtagaactaaccaatgaaaatcagggcctggctgggcgtggtggctcatgcctgtaatcccagcactttgggaggccaaggtgggtggatcacctgaggtcaggagtttgagaccagcctgaccagcatggtgaaaccccgtctctaccaaaatacaaaaattagccaggcgtggtggcaggcgcctgtaatcccagctactcaggaggctgaggcaggagaaccacttgaacccaggaggcagagtttgcagtgagccaagattgggccattacactcaagcctggtcaacaagagcgaaactccatctcaaaaaaaaaaaaaaaggagggcctggagttacaagatcagagttatttttccctggaatatttgatggaacttaaccaataaaaaaaatcagtgcctggggttttctaagaagattttgagtttaatttttaaaaaatgattataggacaattcagagttggttttactttgttgagagacagttttgtaagttataattttccaggaatctgtccatttcatctaaagtttcaaattactggtttaaatatattgataatgtactcttaatatctttttattgtcttcatcatctgtaatgatattctgtctttcctgataatagttgtttgtgctgcttttctttttctgattgattagtcttgacaaagtgttgtcaatttatttaatcttttcaaataccaaattttggctgtattgatcctttcagttttatgcttttcttttttcctgtttcattactttctgctcttacgtctgtacttttggagttttgttccaatttctcattgattttcagccttatgcatttagtattataaactaccctgtaagcgtggcttaggctacattccacaagtttgatacatagtattttcaatttcagtaaatttctttttttttttcttttttgaggtggaatctcactttgttggccaggctagagtgcagtggcacaatctcggttcactgtaaccaccgcctcccaggttcaagcgattccctggcctcagcctcccgagtagctgggattacaggtgcccaccagcactccgagctaatttttgtatttttagtagagatggggtttcgccctgttggccagactggcctcgaactcctgacctcaggtgattccaccctcctcggcctcccaaagtgctgggattacaggcatgagcctgccatgcctggccaacaatttcagtagatttctaatctccatttttattttatcctgaagcattgacacttttattattacgtagtgaccttttttctcttgtaatgcttccatgtcagtattgtctgcagctttcctatgtatgtttggtgtagtttttcagtccctttactttcaacctttctgtgcccttgtgctttagacatgtttcttattgagcatattgttgtccttttaaaacacaatctgacaatggttaccctttatttgatcgtgtaattccttcaaaattaatgtaattaccgacatatttaggtttaaatctaccatcttttttgtgtttcctgtttgtcctgccagttctatatttatttttcctttcttgcctgatttctatgcttatagtggttctcttacacattatcacacataatctttcacttaaagttgaagatgagtgtttatacttctcattgataatacaaatagacaatgaaatgaaatttagaacagttaaatttcatttaaccgcttctcctgattgctattatatattaactcttttttttttttttttttttttgagacaaagtctcacttcgtcacccaggcttaagtgcagtggtgcaatctcggctcactgtaacctccccctcctgggttcaagtgattcttaagcctcagcctcctgtgtagctggtactgcagtcacacaccaccccacctggctaatttttgtatttttagtggagatgggattttgccatgttggccaggctgatttcaaactcctggcctcaagcgatcttctcaccttggcctcccaaagtgctgggattgcaggcgtgagccactatccgaccgagttctctctttctttttcttttttttttttttaaattttgaggtggagtctcactctgtcactgaggctagaatgcaatggcgcgatctcggctcactgcaacctccacctcctgcactccagcagttctcctgcctcagcctcctgagtacctgggatacaggcacctgccatcatgcccagctaatttttgtgtttttgcagagacagggtttcaccatgttggccaggctggtctcgaactcctgacctcaggtgatcctccagccttgacctcccaaagtgctggaattacagtgagccaccatgcccggccgagttctctattttttaactacacgaggtattattatatggccagtatatgtttattaccatctattaaccaaaaatttctgtgtcgctcacatacttgaaattttagttggatgtacaattctgggttgccagttattttctttcttccattggaaatatcattccactctctcctggcttctatctttgctattaagaagtctcccttaagggtcctctcctttttttcctctaatgcttttaagatctttgtttttattgttatccagttttgctatgctgtacctgggtttttattatttctaatttaccctgcttgtgatatgtttgagttcttgactctgaatagtgtgtccgtcagttctttttaaaaaatctcagacatttcttctgtaaatattgcttctgccctcttttctgtttttttcctttgaaaactttgatgaaatatatgttagatcttctcattatatcttctgtgtcttttactcttaatcgctctgattcatattttttatctttttgtccagagtatgaaagaatggcatattatttatttagcagaaaatctttacggttttcatgcttgaatagcataagacaaaacattcagatagaggtacatttatggttatttaggtcatataataggtcctcttactgacctatttcaggtcattaataaaagcttctttggaatttttatgtgaaatatatacttaacagattaatttttcccattttatttttttggaaagtaaatcctattgggtcacatttagaccactttccaaaggatcacttaactgttgttataataatcactttgatgatgaattgaattcttgtaatgttcaaggttttatgctatttcttttatttatttacttattaaaaaaaatatcattttttgaggccgggtgtggtggctcacgcctgtcatcccagcgctttgggaggccaaggcaggatgattgcttaaggccaggagttcaagaccagcccgggcaacacaacgagaccctgtctatatatatatatatttaattcatttaaaacaatcttgcgttgtcacctaggctggtgtgcagtggcacaatcacagctcactgcagctttgaatttctgggcttaaaggatctgcctgccttagcctctcaagtagctaggactataggcacctcacaatgcctggctgatttttaaagttttttagtagagatgggggtctcgctgtgttgttgtccaggctgttcttgaactcctggcctcaagtgatcctcctgccttggtctcccaaacaactaggattacagatgtgagccactgagcctggcctatgctagttctggtggaaaatacagatgtataagatactgtctcagtcctcacattgtttaccatttgcatagggagaacaatgtgtattctataattttaaaagaggtgatgatcctcaaggactaaaaggtcgggcaactttatagaagaatttaattttgtacacatttattaagtacctcagctgctcaaggtactggttcattatagggctagaaagataattacaaaggtttccagggaatttgacatgggaactgtttgctgttattttcacttggaaacccagatttgtttaatgagaatagttaagagtagaaaagtgaattgcaaaggcagtggtttatcatatcagaactgaatggaatgctcacacaccattcttggaacagcattagcacactgctctgcacatgcactgtgatttgatttgcatcttgaaggctgaataacctgagatagccagaaggaagactgcatttccagggaggagttacctgagtagaggatgtaattggcctttcctttgtttataattaaataaaaataaaaacgtgccaccattactagttagatactgatgtatgcctttcttctttacttaggctttttgtgccttataaatctaagaggcaaagagtcatggactttgacttaaatgtcttttgagttattgatgcctatgcattttctcagttagttaaataataagccaggtaccagtaattacaaattagactgctgccagccccttcgagcagtctggcaagtgtgggaagctttgtcagaaagggacccagcatgtgaatgactatgagaatgaatcagtgtaaattcaataccatttcaagcacagattgccctgatggtttcggaagtacaaatgatactgaatttaggatagtttgacttaggatttctcaactttatgataggtttattgggatatgaaatgcatttcagctaatattttcaacttatgtgatggatttatcaggatataaccccattgtaagttgagaagcatttgtatagcttttgcgcatgttctgcacatttttttatcactaaagttaatctgttcagcatagatattaactgtttattaattagtgaaaatatagacctcaaacttctaagagttgcacagatatcttaaggtagcacaaataatgttgtattaaacatttaaataatttttcagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtgggttgaggaaaggaatcaacttaccatactttaatatttatttttaactgttaaaatatttttacaatatggatatatattgtaacttttatcctgtgcatcttttttaaatttttttttttttttttttttttagagataaagtcactctgtcacccaggctggaggtagttgtgagatcgtggcttactgcagcctcaaacccgtgggctcaaacgatcctcctgcctcagcttcccaggtagctgggactataggcatgtactaccacacccagctaactttttaatttttttttttttgtggagttggatgtcttggtatgttgcccagttggtctcaaactcctggacttaagtgattttccttccttggtctcttgaagtgctagaactacaggcatgagccaccatgcccagcgcctggaaatctttaaaacattttatatttccatctagcttattttttcagagaaattcaatttggaagatgagatgcaaagaaggaatattgcaataaaattttagtttcctttgtagtgattaaattgcatgccagaacatgggtattctctgcatttttaatgcagaatttagttgatactaattttactttatgccactattaagtgagaagaacttcattaacaaggattaaggtctaatgttgcattagatattgtcgtaaaatacattttaatttggaccatactgagaaaacctatttttgaatttccaagccaaggagctatatataaatttagggagctatagaaaaattcataaactaactcacttcagatttttatatttgtttaaaaaatggctaaagacagtaatcttacattaaagaaacgttagaattttccataatctcaaatggtatgcgaaatgaagctttcatgatcctggttactaactgtataagttgaattaaaaatccaaggttgttctggatgctgcttctttctctgcagaaacctgtatggaaagcctgaaggcctgcctagtgaagctttggcacatcggtcgatttacttttgactagttgcttggtcccctggttttagcaaaaattgatgtagcttatatgacagtctgttcacctgatcacatgtgatcagatgttctaaccatttagccagttgttttcatagttgagtctgattatatggaaattcatatttgttaaaggaacataaaaacaagagtgtgcagttttgtcttagctagagaggagcaacatgaggtaatttgtataaagatttgtagaagctggtgtcagtggaggacggctctaaatattggctctgtcatttattagctgtctgatcttgcaagtttctttagccctctgagcctcagtggacttaagtgattttcagtgtcctccacttttaaataaaaactagggagaagaactacctcaagaggcagatatgaaaattaattaaattgatccatgtaaatagagggtttagcaaataggcatacccagtaagagcctatctgccatagaagtttgctttagtatactgtgtaagtatatattatctaatcttttccaaatttggtgatttaaatatattctttattttttatgataaaagtgtaaactaccctgtaaaaatacctgcctcttattttacataagaaggttgttgggctggacatggttgctcatgcctgtaatcccagcactttgggaggccaaggcaggcggatcacaaggtcaggagtttgagaccagcctggccaacatagtgaaaccttgtctctactaaaaatacaaaaattagccaggcatgatggcacatgcctgtagccccagctactcaggaggctgaggcaggagaattgcttgaacccaggaggcggaggttgtggtaatccgagattgcaccactgcactccagcctgggcgacagagcgagactccgtctcaaaaaaaaaaaaaaaaaaaaaaaaagttgttttaaaagttagctgaagtctacctgtccgggtataaaacaggcagtcaagaggggttaggacatggctgtcatgctgaactgcctggattctgcttcagccccgccacttagcagctatgtggccctggacaaacttggattcaatttttcatatataaaatagggctagaggccaggtacggtggctcgtgcctgtaaccccagcggtttgggaggccgaggcgggcaagtcacaaggtcaggagatcgagaccatcctggctaacacggtgaaaccccgtctctactaaaaatacaaaaaaaattcagccgggcgtcgtggcatgcgccagtagtcccggctactcgggagactgaggcaggagaatggcatgaacccaggaggcagagcttgcagtgagccaagatcacaccactgcactccagcctaggcgacagagcgagactccatctcaaaaaacaaaaaaaaagaggtggggagctagagagagctcactctaagacttttgggaagattagctgagatgaatattacgaagcatttagtacaatgcctggcatatatgaagcacctctgttactgttgtgttatttaaaacttatttaaaaattaacaggcacagtttattgatgatatttacatattggtatttgaggtaactggccaacccaaccacctttgagtcatcaaaagtctttaagaagtgttagccaggagcaatttatattgatgtagtcccttagtggattttcaggaataaatggaagagctaatgagcacttgttcagaggcagtccaccttgaaccagcagttcaacctgcaaactcttataacaactagttctagatgcttcctagtcatccctcagtatccaagggggattggtttcgataccctgaggatgctgaaattccttatataaaatagtgtaggacagtcttgcagtgcaaaactacattttagtcagcaagggaccaaatatagaatggtggtcccataagattataccttatttttactgtactgtattatatgtttctgtgtttagatatgtttagatatacacatacttagcattgtattatagttgcctacatacacacacttaccattgtattatggttgtctacagtatccagtatagttacatgctgtacaggcttatagtctagaaacaatgagccataccatacagcctaggtgtgtcataggctataacatccaggtttgtgtgagtatactctgtgatgttcacgcaacatcaaaatcacctaagatcatatttctatcgcatttctatcaccatgtttattagtccgttctcgcattgctataaagaactatctgagactgggtaatttatgaagaaaagaggtttaattgacttacagttccttaggctgtacaagaagcctggctggggagatttcaggaaatttaaaaccatggcggaaggcgaaggggaagcaggcatgtcttatatgacctgagaaggaggaggagagtgcagggggaggtgctacacacttttaaacaaccagatctcgtgagaactcactaccacaagaacagcaagggacaactctgtccccatgatccagtcacctctcaccagacccctccaacactggggattacaattttacatgagatttgggtgaagacacaaatccaaaccatgtcgccatggttaagccacacatgactgtatataacctacttgtatccttgcatatactttaaataatctctagattacacattataatacctaatacaggccgggtgtggtggcccatgcttgtaatcccagcactttcagaggccaaggcaggtggatcacgaggtcaggagttcaagaccagcctggccaacacagtgaaaccccatctctactaaaaatacaaaaaaattagctgggcatggtggcaggcacctgtaatcccagctactcgggaggctgaggcagaattgcttgaacttgggaggcggaggttgcagtgagccaacatcacgccactgcactccagcctgggcaacagagctagactccgtcttggaaaaaaaaaaaaacctgatacaatgtaaatgctatgtcaatagttgttatattgtattttaaaatttgtattatttttcttgttgtattgtcattaaaaaaatttttcccctaatatttttgatcctcagttggttgaatctgtggatgcagaacccacagatgatgaggggggcaactgtaaagacattaatgagcattacaatattaccttttgaccaataccttatttcattcaaaccaaaatgaaatattttatggtaacggtaaaggtcatgggtatcatgcactcatttaaagatggtcactactcacttctgccttattcagttgatgagagacaaattctaaaattgggactgccttatcaaaatcctgcctttagctttctattgtacaaactagacaggaagttaacccctaagctttgttttaagtttaaaagaaaaactaggatatgctgaaattacttgatttggcccattttaaatagcaatacacaggttttttttttgtaggggcagttggcaggtgtagggaaattttcacttacacaagggcactacataaagatgagaggtggtgtccttgctgacctcatcttgccactccccaggccacctccagatagttgttttctgttactaaaaagcagaacattcgactgcttgacatggaaagttatcttctcttacgccattggtgacaagcgaccctctttgggcaatatctgttactttccctccctctaatagtcatgtaaacattgatgtttagtattcagtctactgcagtttattgtgcaagcaattataagttattaacttggcataatttgttgaatacctaagtatataatattgaaactaaggacttggcaccaaaatgtttatgtactttgactaatttaacaggaaagttgtttacttaggattgctggaaagttttctgccatcaatttcatagacagaaaaaatttctctccttgggagcatatggaaggctgataaattcagatatatacttggcatcaatgtgaaatttgagaagataaaaaaatttagaataggaattataattttttccttttttttttttttttttaacaagagttttgctcttgttgcccaggctgaagtgtggaatgcaatgacgcgatctcggctcactgcaacctctgcctcctgggttcaagcgattcttctgccgcagcctaccgagtagctgggattacaggcatgtgccaccatgcccacctaattattttgtatttttagtggagatggggtttctccattttggtcaggctggtctcgaactcccgacctcaggtgacccacctgcctcagcctttcaaagtgctgggattacaggcgtgagccaccacgcccagtcaattttttacttttaatctgaaaattacattgaggttttactgtcttgatacatatgactgattagcctgaggtttttgatgaaaaacaaactaaaaaacttaagaaccaccagtcacaaatttgtggagctatcagtcttttgtggggatattaatcttatagaactagatttacaagttattcggtcttcacaaccccaaatctcttgccctctgtcagtgataggacttcaaataatactgagaaagttattcctttgcatcatgaacacttttaagatagtagtacatacagtttccttcctctgctgtctaagtaagtctgtgacagtggggcacaggtaggcatggagtcagtcctgaaacgaggcacaaagagaagcttcacctgtcttttagttttgctgagggatcaatcaccctggttacttagtgcttagattattaaaaaataaaaattcttagtgaattgaggcaattcagtttaccttttatcacattttactttttaagtgtatgatgaaattgcaagattttgagagagaagaaaatgtgagatttctaaacctaaattcaaatgaaagattaatcttacaagagttctgctttctgaaagcattgattgaggtgcctgtaatcccagctacttgggaggttgagggaagagaatcgcttgaacccagaaggcagtggttgcagtgagttgagattgcaccattgcactccagcctgggttacagcgagactccatctcaaaaaaaaaaaaaaaaaagattgtgtggctggcatctgtaggaatgagtgtataaggggtgtatatatacaggagaatggccatctgggtcagggttggcatgccttttctgcaaagggccaggctgagaatacactgggcgtcacaggccctgtggtttatggcagcagcaactcatctctgctgttgtagtgtgaacgcaactgtagacagtacacaagcaaatgggcatggcagtgttcctgtaaatctttatgtatcaagatcaacagcgagatggaccgtagtttgccagccccccgatctaggtttagggaaattcattgtcagaatgaacagttttgagtgaaaaaacagctgcaggattaaaaaaaaaaatcctcagtaagattttgtttttctttattcttaataggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatgtgagctcctgattgaatgttaattctgttttccatgtgaaaataaaactgtaatttgtgagtaatattgctgctaatacactttcacttgtgtcttccaaaaagacttcaaacaaggtgaattttcaaaaagtccagtatgagaaaatgtttagttttttaagttggaaaaggtgtaaggagaatttatttttaagcatatttttctttcactctgctttcaccaaaataaagtgatagatttgtgagactgggatataccttttgtgcagccatatgtaattgccttagaaagatgacaccttcctaccctgtctttataaacatgagaagactttacagcctccctttgcatgctgtaaaatcttaaaatctttaaggaggtctcttaaaactagtatttatgctccttctctctcatagtgtcaagttacattcatataacttttagtttagtacaatggaaggtgactaagttcttaattttactttcttgaagctaacacatttttaaaacacctggttgtgttttgtaggatcatgggttttgaaatctgacaggcttggttggccatatgtccattggagttactaacctccctgagacttaacatatctacaaagttaggttaatactgcccaccttaagggttgttgtgagggataaatgatgtcacctttgttaagcgcctaacagtgactttcaataattgttcattccatttcttctattttccttttctgatttttcataccacttttatattagtgtacctaaactaaatctgtaaaaaaaaactgactaatgtaaatgaggtgatcttaattcctatatgttaaattgtctttacatctaattttatttcttgtgctcaactagaatattcagaaagccaccattaagaaactaaatatgtcaattttaaaatattaaacatagtaattaataatttttacattagacttttcccctgtattaatcctcaacttcagacagaccagtctactccctgcccctgaacctagctattgcattttgttcagaatcttttccttttctaagccatttcttcccactttgcttgtccatctaaatcttgttcttcttgatgtgggttagcttgtgtcttcctgctcctagtgatctctcactcctctcaatttctaggacatttactatattgacattaatttgggactttgtgtactactttatattagtaccatatctatacacccacatactgtacacacacacacaaacaataggaatacactattgtatagttacatatacattttgtatactgtgggtgtgtgtatgtgtaatttcctcaacattatctttgtcttttagaggaaaattctttttcggccaggtgtggtggctcacacctataatcccagcactttgggattatagggctcacacctataatcccaagacaggtggatcacctgaggtcaggagttcgagacaagcctggccaacatggtgaaacgccgtctctactaaaaatgcaaaaattagctggatgttgtggtgggcaactgtaatcccagctactcgggaggctgaggtaggagaatcactggaacccaggaggcggaggctgcagtgagatgagatcgtgtcactgcacttcagcttgggcgacagagtaagactctgtctcaaaaaaataaaaataaataaataaattttttttgtttgtgtgtattcccaatagcataatgccttacatgtaaatacttttctttatggggcccaaagatgactcttgtagaacagttagcacatattcactggcaggttttaaaatctgaggcatagctgaccattcgattttaataggtttgttatttaattattctcttctctctcacataaaatttattttatctagtcagttatcacagtggtatgagaagatgtgctcgatattctttttcagggacagttgccgtttgctgttgtgggaagtatggatgaggtaaaagtcggaaacaagatggtcaaagctcgccagtacccttggggtgttgtacaaggtaaatgagacaaaggatgactagaaatatgtatctatctagtaatctcaaagctacctgtcatgccttctttggggtgatgcttagtttggatgtgattggttgtcagaggaattggctgtgtactattttagccaaagtctggaggccgtgtagagcctcccacttctcattatgccacacacacattacccccgcccccacggtaccctgttagtaggtgggaaacaccagtggggcactctgaccaaaatgtgaatgtggaaagtagtgttcagacataaaacatcactaattaccacttaagtataagaacagtcaaccatcttataaatttatatatttttactgatcaaagtattgccggctatttccagaataagccagtcagccaacttaaaaagttaaatctacttgacatttagattatttagctgacattataatgagtaagtaaatagtattatatggttcatttacttatagtgctaattaatggtgaatagattacccttactagtatggatttccaaatgctgattttttttcttaattgataaattttgtaatgaatgaaaaaattgagaaaatataacatttttaattttataaaaaatgtaaaagtaataattatacttaagagtattggtcacaataaaatatatttatttgtagtcctctggtcaccgtaaacatagaagaaggatcatgtaagtgtgttcactaattttgaatagtgtctaacacaggatcataaatgtgttctataaaaagaatttgataattatagcagggaaggatagtattcttgagtttgcagaatttactactttgaagttttagtgaactaatattacatactctttaaacattatgtgaaatgtcttcaggatagtttgtaaactgctaacaaaatattagtgtgaaataactagaacacttggttaacaataagttgtgtcttttttggtatttcctggtgattcattggctactaaatttaaagtaaatctggtctgttaattcacattgcctatgatacagtatttatactgcaagagtttcttccttggttacatgtataaaataatcgtagctgttaatcaaactgatcatttgctatttgttgtttcacatgttttcatttatttgttcattcagcaaacacttagttgtgtgccaggaattaaaatccagtgttgttcttttcttatttttttttggctagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcaggtagggtggggttcttgggaagccaaccaaagaggaagttagagaggattgcatatttttatatatccaggatgatggggcatgtgttctttagaatctcccaaaaccatgatatagaatcatttggtaatgactaattattgtgcttcttgaatcacttgactccttcttgcttttgaagagtcttgctttttaagtccttgtctgactcaaaaagagttaaatatgatgaagaatgtatggcagaggccccctgtttcagttcatgctgacatgagtaactgaaggaaaataccctcattatttgatttctttttgtatttatctgagacgatgatatatttaactgttgtcataaaggtaagttggaacacaaatcattttcttagttttatttatttattttttgtagagacagggtcttactatgttgcccaggctggtctcaaactcctggcctcaagtgatcctcctacctcagcctcgcaaagctttgggattacaaatgtgagcctccataccagtcctcaggaatcatttaaaataaactaaaacattttctgttggtttttcttctgtaaaggttttggaatgagtgaagcttagcaaaacatattataaaggaagaaggagagtgcttgtagggagttggagattagattgtttcttgccatattacagtgtagttataagaattttagaatctgaacccttccttgctcagtaatataaagcattaaaagttgtagaaacttccttggtaattttatatggtgctgtatcccagactttatgcaactcaaatccttagtgtactgaatcagatcaatttgatgtagcattccagaacagtgtttgcatgcaggaaagcgtgagatccttgggacaagtgctattttaaactctcttatgagactgaggattccttttccattgcattgtttgcatttgttatttctctggttcttagcacctgcaccagagtaaacaaaagaaagggggaggagtgcatcaaattagtgccgctgttgcatataagcttttggaagacttaatcttagatgaagttaaatttttaaatttcttcagtctatggagttaattaatgttttcacttctggtagcataatgaattaagaattgtatatacttatggccgggtgtggtggttcatggcctgtaatcccagcactttgggaggccaaggcgggcagaccacttgaggttaggagttcaagaccagcctggccaacatggtgaaaccccgtctttactaaaattacacaaattagctgggtatggtggcacacttctgtaaaaccagctactcaggaggctgaggtaggagaatcacttgaacctgggaggcagagtttacagtgagctgagatcgtgccactgcactccaacctgggcaacagagcgagactccatctcaaagaaaaaaaaaaaaagcattgtgtgtacttaacccaccctcaccaaattcaggcataggatgcttctggttgtgggccagtcattctcgtaaactgacaattttctcatgatattgtcttcactaaagattaatcatctcgagttagcttccctagtgtttctcagaggagactcacttctcatttcttccaagtctcagggtcacttcagaggcctctgtgcactgaggtggaaggggtcctgagtaagagcgggcagggacaactttgaagtcctctctgaggagacaggcctaggtgtctggtggagtcatcatcagtcacctgtggatgattaagaaatgcagggtcagaatttccagggatgaagcctagaaatctgcagtcagaattcttagtcattcagcaaatagtttgtctgctatctgctcagccaaatgctagtcattgggtgtatgtgcactgttggatcaaatagagaccctgcttgtgtagagtctctgttgaggggtgggaggaggacccctatgtgaagaagagagttgggggaggggggcaggtggaagtggggagaccaagttaggaggttgccatggtggtccaggcatgagaagatggaggcgtgaaagagaggggtagtgacagaggggtgagaagcatgcttaagacatgtatttttttaaatttaattttattattattattattatttttgagatagagtctcactgtgttgcccaggctggagttcagtggcatgatctctgctcactgcaacctctgcctcctgggttcaagcgattctcatgcctcagcctcctgagtagctgggactataggcatgcaccaccacccccagctaatttttgtgtttttgtagtagagacagggtttcaccatgttggccaggctggtcttgaattcctggccttggggtcaggaattcctggccttgaattcctggggtcttgaaaccccatctctactaaaaatacaaagtgatctgcctgccttgggctcctgaagtgatgggattacagtgatggatcacacctggctaaggatatgtaatttgaaattaaagtccataggacccactgataaattatttttgcatatgggatttgaaggaaagagagggatcaaggataactcagtcaccactttgacctagaaaatggggtgactggtggtgatcgttattgacctgaggaggatgggaatcagagagtttaggggtgtagttggtaatccagaggttttagaaatgttacatttaagctgcttattaaatattcaggtgaagagtttgagtaggttattagacacatgatgaatctggagctagggagaagttagggctgccatagtaatttgggagtcagcagtgaataatactgggtaaaatcttaagtatttttttaaaaggctctgctaaatgctagagattactattattttgcatggagtttatgttcttgtaggggagttcaaaaattaaacacctaattgcacagtacattgtagctgtgatataagcactaaaggagaggcagacagtgtaaaatgggttgtgtgggtgggggggttccaaatttaagctggaaaattcgggaagactttcttgaggcagtggctattttgagctgtagtaacttggggaaaacagagcaagacatatacaaagggctgaagatggagagagaatggcatctgtaagactccggaagaagatcagttcactgcagtacagcaggacagatgaggcaggcctgggctcacgtgagatgagagaagagaacaggcaggcagcagctgtggaggccctggggaggattttgatctttgtcctaaggggaaggcaacgctattttaggaataatataatatttgcattttaaaaattattatttgctctaatgtgaaggaggtattgaaggggtgttcagagatgcttaggagaggccagttaggagagcatttctttgactaaagtgagatcaatgaaaataaagagctggacatatttgagagatgactagaaggtaaaattggaagaacttagtggttgtttggatataataaagtgagaaagcaggaggctagaaggagacgcctagtctcctgaatttatggtttcatggctaggtggatggttactgcattcatctagataggtatggctgaaggaggactagcttttttgtgtgtgtgtgaggcagcagtggtaggcacaatggaggtcacagtttgggacctgttgactttgagtttcctctgaaacagcaaagtgacaattacaagtaagcactttggggtatctttctggaggtcagaaaagcaatgggccaaagaaatagcttaagagtcatgggtatttaaatgattaattctatgtgtgaccagggataagactgcctgtagagagaaatacatctagaaagaaaggtgactcagaaacagccttgagtccctttagtatttgtcagctggaggagcagataggagagcttgagaagggaggaggaggaaaaccagcagtgtcacgtcttggaacttgacagaggggatcaagagagagggagtctgctgctgtgtcaaagttgaggtccaggtttatgctgcacaagtacagaggtgcttccttgacaattcttggagaataatgaagaccactttgtgttcagttaaaaaaggcagtggttggggccaggcccggtggctcacgcctgtaatcccagcactttgggaggctgaggcgggcggatcacgaggtcaggagatcaagactatcctggctaacacggtgaaaccccatctctactaaaaatacaaaaaattagctgggcgtggtggcgggcacctgtagtcccggctacttgggaggctgaggcaggagaatggcgtgaacctaggaggcagagcttgcggtgagccaagatcatgccactgcactccagcctgggtgacagagcgagaccccatcttaaaagacaaaaaaaaaaaaaaaaaaaaggcattggttggaggctacataggtctggacttgcagatttgaagggaaggcctgcaacaggtagaaaccatttttgttccagctctgggagtggaatgaatgaactgaaaccattgccagccttttttgttcactgctcacaattcatagtccagggaaagaatgtccagtaggcctgatgtaggtcatgttcccatctcttgtttaggagtgagtgtgaacctgattaattgtcccacaagactgtatcccatgggggagaggtagcccccaaaaaggtaatgaggataatggatactggtaccaagaggaaaggactcaatgataggtagtcagaaatcatagattgcccatcacatccatttgctgagcatttcttcaggttgggaagcatctgatcactgatcacacaaagaaggggaaattagaaagggagattcttcagcttaggtcaggctacggactgggtgggagcagtggctggaagaaactcagtaagtttaggtcaggctacagagtgagtgggagcagtggctcactattgtcttcctaagagagtagacctttctactgtatttctggatcacttgggtaaagttgaggcaaaatgtctcttctggttctttgtcatatgtgattaaatgatttgataaggcttttgtagctcattatagtctgatgtattaggaagcttttattttttatagtttcaagaagttatatctggccaggcgtggtggcttatgcctgtaatttcagtactttgggaggccaaggtgggtggatcacctgaggtcaggagttcaagaccagcctggccaacatggtgaaaccctgtctgtactaaaaatacaaaaattagccgggtgtggtggcggacacctataagcccagctatgtgggaggctgaggcaggagaattgcttgaacccaggaggtggaggctgcagtgagctgagatcgcaccactgcactccagcctgggcaacagagcgagactccatctcaaaaaaaaaaagaatttatatctgttttctcgggagtcttttcctatttaatttggtagttgttgtaatttggttggcatgtaaaatctgtccctcagtattatatctatctagcagtaaagacaagttacgcaaacctgttgggtgacctttatgtgactgtacttcctggccctctttgttgccagaacttccgtttgtttttccacttacactttattgaatgggtatgctgagtcatggtgggtatcctaatctaccagcaccaatcgcaggcttgtcacgaggcccacgtaaatagcactatagtcatagtttaattaactgatcttaacattttatattaattatttcaaccattggaaacatgcctttataaaactctttaaatccccaagtttaataattaaagattaacctaactaatctctttcccacagttaatcacctttaactttttagcacaaaatcactgtcattgaagtattgtgggacctgtagctttgaaaggaagatgtatgcttagtagtttagagttgtttaagtatttgacgtaattttagtaaaacttcatgtctttggaattctcaagaactaaatagttcttcaggtagtctatagtagacttggaaaaagttcactaggcttatcggaactgtacttgaaacacaaacatgtcccaattgaaggaaaggacttttcttgatgacatgagcatctgagatttttttctttctttctctttagttttcaactttaaatcagtgagatttgcaacaacagtagtatgttggcattaaatattcatgtcaggccaggtgcagtcgttcacgcctgtaatcccaacactatgggaggccagaaaggtggatcacttaagctttggagtttgagaccagcctaggtaacatggcaaaactctgtctctacaaagaatacagaaattaaccagctgtggtggcatgctcatatagtcccagctacttgggtggtagaggcaggatgatccagcctggatgacagtgagaccccgtctcaaaaaaaaaaaaaaagaaaattatgacagcaagctacttttatgctagaaaagggaatagtatagcaagaaaatgtttttatttttatttaataaatctatgataagaaacaatgattgcattagttttagaatactaactttatagaccattctctttcagatctgactttctttaccaccttttgaaaaatagtacaagtttctttacttgaaattggccttgtaagtttacattgtcagaagttggaaagcagcacgatgagatgcaaaatatgcagaagcagtccattactttctcctgctgagacaccacattggggcaatctgatttgtggtagttgggaatatggactttggaacaagtctaatctggttcaaatcccagctttttacttttcagctatgtttctttgggcagattactctctgtgctttagttttcttatttagaatgtcagggcttgttcttcagggttgctgtgggaattaaatagtcaacataaaggagtccagaagagtaccctgccagtagcagatactcaacaaatgttaggtctcttctcttcaccaggtagatatattttccttgtgaacaactcaagtgcttgtatagattaatgaagcattgttttaaaaaacttatgtttgttatgcattcaagattttttttataattttttttaaatttttttttattatactttaagttctagggtacatgtgcacaacgtgctggtttgttacatatatatacatgtgccatgttggtgtgctgcacccattaactcatcatttacattaggtatatctcctaatgctatccctcccgcctctccccaccccacaacaggctccggtgtgtgatgttccccttcctgtgtccaagtgttctcattgttgaattcccatctatgagtgagaacatgccatgtttggtttttttgtccttgcgatagtttgctgagaatgatgatttccagcttcatccatgtccctacaaaggacatgaactcatcattttttatggctgcatagcattccacagtgtatatgtgccacattttcttaatccagtctgaattcaagatatttttacatcaagcttgtctttaaagactatcagtcatgttggactagtgaaatgtagggaggtttctaaagatgaagaaagtagctgataaatataggggcttctttaaaaaaaaagatcacaacagaaaaaaaaaggcctgatactaagtaaaatgcctccttggggtgtgagacatgtgatgtctagggtattttgcacatttgtaatctctgctcttaaagaacaggtttctgcaagtgtttaggatctgttcctgcttggaacccctcctgtacatgcctcaaactcacctctcagccttggtagctgttgtgtagtatttcttactctgcgtttctttgaacttacagaattctatacttaaaagcttaatgtctccagttataaaatttaagattaataagatttaattcatattttgaaattgatttatttttataagcaatagaaatttctcactaatgtagctggaaagtgaatttgtattctctgtcaaacctttgggatattcttatagcaagcccaaatggaagggctcagtgtttctgacatataagaaggcttattatacctccaaaattctacacataggaaagggcagctactggtagagttccaggatagtcctttctctgctggttatgctggttaaatcttcctcctcttcccagaaatttgtcattctatgaacatttataaagaaactgaaatgtctagagagctctgctggatagtcacagagatgaatgaggcttcattttctgttctcaagatttgtgacctatgagaagggagagatgggcaggatataaatgccatggcagtgcttggaaggaacagttaattctaactggggagtttggcagtcactacgggactgaacgaaggaggatgaacacagaaatgaaaacttacaagaaactgttttaaaggaaggggccaggggaagaagaagagagcgtcctgcttctagtgagcaaaggcagccgccccaagcttcttaagccgtttgtatttattgggtagaaagaacagggaggaagaggtaacgattggtcagctgcgtaattgatcacaggttcatattattgctaacaggcttcagatgtgccctgtagataatcacaagaaacacttgtgcctgggtcgtgactgccctcagcattccttctggatggcagacgcagtttgtcagtttgctaacattctgcatttatgagaatagtttgctctttactaatatagcctccagtggtatactgagttgatcatgaccctcattcttttggcctgcaacaggggagagtgggggagactttacagaagaagttacatgtgaatttgcccttgaggggtagaggatgagcaggacagcatgggggtagaaggtggacagtggccacaaactgaagcctgaaatgccaggttcgttctgggaacaatgaacaggttggtgtggctgaaacctgaggataggatatcagaattgtttggtgagaaatcaatctggaaaggtagaattaggccagagattataaagtttcttgagtgcaatttaaaggaggtgggaccttattctatagatagcataactttaatgtggtgagaaaagataatgagatctgtgtttttggtggaaaatctagagggtgacaagaacaaagtgaaagaaagaggaactagaagctcagagatgaattaggagattgttgcagtagtgaaggcagaaaatcacaaagatcaggttcggctgtaatctggtatctgtagaaatggaaagaaggttatattaggagacttagcttcagaagctgaactaatggaccttgataagatagggagatagggtaagggaagagtgaaagatgactcaggatttccaagtttctacatacagtgattccagtgactctagtactccatatcagcactaacacgggtggcttcatatttcatgctataggaaatttcatgttttgggttaccatgtgtaaaaaaatattggtacctgttacatatatgaggctgaacatgagatgtacagcaggttcttgaataacaatgttttgttcaatgtcattttgttgtaacattgataagaaaaaaaattgattcccggcgatggccactgtctgtgtggagttggcatattctccctgtatctacaggttttctctgggttcttcatcccaaagctgtaagcgttaagttcatggcatgtctaaattgtcccagtctgagttgggtgggggtggtgtgagtgtgccctgcaatggaatggcatgctgtccagggctgattctcacttagcttccaggataggctccagccacccatgaccctgaactggagtaagcaggttggagaatgaatgaatgaatacatattattgtaacataaaaatgtattgtatacattgtgtatacgatacacaaatgtaggacaataagcaatgcggtgtgaaagtgctcagtaaccctgccatatttgttattgtttgtttttgaattacatcgtggtaggaggtgatctttacaattttccctttgcaaacatctattccctgatttcacctccaccataatgactgccatcactcactgatgcaccaaaaattgggtaattaattgtccttcttgtttttgttaatttttcttaaatgtatatatagctaacatttatttcagtgtttaatattagaagggttttgagtctttatttagaagtttggtaatgtttttgtgaccagaaatataccatacgaacttaattcttgtttatatcaattaccctatggtaaaaattggtttaatcatacattgcttcacttaaagttacagttttcaagaacctattgatggcattaggtgagcacttgtatttttgaaagtttattgtatcactttttttttttttttgagacagagtcttgctgtgtcgcccaggctggaatgcagtggcgcgatcttggctcactgcaaccttcacctcctaggctcaagcaattctcctgcctcagcctcccgtgtagctgggactacaggcgcacgccaccatgcctgactaattttttgtatttttagtagagacagggtttcaccatgttggccaggctggtcttgaactcctgacctcaggtgatctgcccacctcagcctcccaaagtgctgggattacaggcgtgagccaccaggccaggccacttatatcactttttttttttttttggagacagagtctcgctctgtcacccaggctggagtgcagtggcatgatctcagctcactgcaatctctgcctcctgggttcaggtgattctcccacctcagcctcccatgtagctgggattacaggcacctgctatcatgcccagctaatttttttatttttgtagagacagggtttcactatgttggccaggctggtcttggactcctgaccttaggtgatccacctgcctcggcctcccaaagtgttgggattacaggcgtgagccgccatacccgacctatatcactttttagcaggagagtaacacaaataactttttagtgttcaagagacctatgaagccaaaagacatgagttccatggtgaacgtcagaggaaggaagaagaaatgaaacagatgtttgtgcagcgagtaaaggagaaagaagccatattgaaagaagctgagagagaggcaagtatgctggtttgatgtgatttgcatttattttttagatgtcctattaatttggaggatttattccaagaatttgcttgagactcttttgtaggctacttgttctttaaagagtagcttttccaacacatagtatttgaatattgacttagaatcatagcctgaaattaaatgaaaactttggccttctttttttttaaagcagtacatttatggagtcactaatcgttgaaattcttacaatgaactggaagctgcagcagctaccctcttgggtgcacacatttttctttcatgaaatccatgccttgaatccacggtatacaatttttaggtgcctcattcaaccagtctcagtggtggtttgtctttgttagtgccaaggctaaaagaagaaacacgactggatgttttcttatgcctagcagggtaagccacatttgccacagcccaactcctgaaggtggtgggcctcacagccacagtggcaacacagtgtatgcgtcttactgtgatgcttcccaaactatgaccttccctttgtcatctcactcctttgactgagaccaaagagaattttggccttttgagcaaatattcttccattagaaatggtttaccaagggcttgtaatggactaggttactaagaagtatcttaaccatgagctataaacatttttactatggcttaataaagccttttttgagtgttgctggggtggttgtttgccctgaaatggatatctgtgaaggctgtgaagtagctttactttccatttgaactcagtctctcaggatgtagttaggtggtctagatcagtggtccccaacctttttggcaccagggacccgtttcctggaagacagtttttccacggaccaggggagatggtttcaggatgaaactgttccagctcagatcatcaggcattagattctcacaaggagcgcacaaccaagatccctcacatgcacagtttgcaatagggtttgtgctcctgtgggaatctaatgccaccactgatctgacagtaggcggagctcaggcagtaatgcttgtttgcccgccactcaccttatactgtgtagcccagttcctaacaggccatggaccagtactggtccgcggcctggggattggggacccctggtctagatgaccttggggtagccctggcaccaaaaaaatcactgaacttctgtagttttgtttgcttctagttctgaagcagcaatttaggttttgagtaaagctattttcttgaaaatacatgatttcttgaagagttaatctgtaatccaattgtgctagtttattatttcaaatacacttacagtacttgctatgtaaatgaactgtgcaggaaatggttttgtaaaagtaatagtttactaatttatttataatgcgaattttgatgttttatttggaaaaagttcaaacaacagaaaagtgaaagtataggatacctatgtccttccccttacctaagaaaacaggaataccataatctcacccaatcttcagtccttattcagatttccccagttgccccaagattggctttcaaaatcgttcctttttatttggtgatttttctgtttttgtttttgaaccaggatgcaatcacagattgcatattgtacatgggtattatgtttgtttagtttcttttattcaagagtttctcatatagcatgaatcttagttttaccaattcactaataaaaagataccactcaaaacattatttaattctatattaaaggactgttatttaaatatgtccttgccaatattgttgtgaaacaaatatcccttaatttatcttttgtataaatccatatttctatatgtagctttgtaaaatgatgtgtgcttagataatagtgtgtgaacattagatgactagaatggggagatgcacagaacaaatgatgtctccaaatatcgttgacgttctgtcttccctattcctttattgacaagattctagaagaactcatgaggcatgttgcatatgacagacggatttcctatataccctccccactttaagaaaaagtacagtttatatttatccctcaggttacatgaccatcattattattactacccaatttgatatgtctgtctatatcttggaataattttttcatttaacatttatgccccttgtatttccaaaaagtatgctcggtaatttacaatttaaaaatgcagctacgttacaaccatgaacatgaggagaacaggagccttataatacagggtacgaagaaggggtttgcacagagggcagccgagagccctggttgagggaatttttaagtgaacacaaagactgggctctaacttctaggcaggcagggcagaagggaccacacagagtttagatggaagtcatctgctagctcagcagagagaaatattttccctggcatttatttctaatttctaaaaatggggccgggcgtggtggctcacgcctgcaatcctagcacttcgggaggccgaggtgggtggatcacttgagatcaggagtttgagaccagcctggtcaatatggtgaaaccccatctctactaaaaatacaaaaattagccaggcatggtggcaacatgcctataattccagctactcaggaggttgaggcaggagaatcgcctgaacacaagaggcagaggttgcagtgagccaagattatgccactgcactccagcctgggcaacagagcgagaatccgtctcaaaaaacaaaaaaaaaaaagatactttttttttgttttttgagactgagtcttgcttttgttgcccaggctggagtacaatggtgcaatctcagcttaccgcaaccttggcctcccaggttcaagcaattgtcctgcctcagcctcccgagtagctgggattataggcatgtgccaccatgcccagctaattttgtatttttagtagagatggggtttctccatgttggtcaggctggtctcgaactcctgacctcacgttatccgcctgcctcggcctcccaaagaaaaaagatacttttaaaaggatctttgagtacgagaatgtgtcgtgtccttaaaagtagtgtttacaaaagatacagcattgtacagtagtccccctttacactcagtatggctttctgaggtttcagttacccatggtcaactacggtctgaaaatactacaataagatattttgagagagaaagagaccacattcacacaacttttattacatacattgttataattgttctattttattattaattattattgttagtctcaacactgtgccttaactttactataggtgtctatatataggaaaaaacatagggtatggtactacctgtggtttcaggcatcctcctggagtcttggaatgtatcccccgtggaaaaggggggactatcgtaccatactgatgacttaatattcttaagagaattggtgactattgatagcacaaaagatcccttgtttttaattttttgagaatttgaaaatgtatttgaattaactgcctgtcgtagtgaataatggaaccatgaatgcatgcttcatgtgtatggaatagttgttgatagccagagctggaaatgccacccagtgtgaataacagtcacattcacacttccctgcccccttgtttaatgtttccctctttgtagttttcctggaattttttagtcaacctcatgaatgatgtataaagtgctgtgtgacctttcaagatattttaatattcatgtgaggtatgcaacctccatttgagtaaccagagagctatctctagtcatgtgatagaaacctgcccttgctgcttcctttccagactttgtcccactcctgctcctctcccacatcaccgatgcacacgtgtgcagagaactgccactctttgtttgtgccaccgatttgaatgacatctggggagtgtgccctttaaacacacacacatacctaacatgtaacttttttaaaagcaggaaccatttaaataagcaaatactaaggaactgatgcttctctgaaaaggcatcctctggaataaaagcatcttatgttaggagggccttaatcgattatctgttttaaccttgtttcccttggaatacttctcctatcaggtggtcactggctcacaggacaacctattccatatttggaacataacagttttattagaccagagtttagctctctggtttcttctctcagtctctgattttcagtgaaatatttcctcaaatattatgtctttttttttttttttttttttttttttgagatggagcctaactctgtggcccaagctggagtgcaatggcgctatctcggctcactgcaacctcggcctcccggcttcaggcaattctcctgtctcagcctcccgagtagctgggactacaggcgcacactgccacacctggttaattttttgtattttagtagagacggggtttccccgtgttgcccaggctggtcttgaactcctgagctcaggcaatccacccacctcggcctcccaaacgtctccccctttctagacaacttggtgtcttagaaaaagataacatagccaggcgctgtggctcatgcgtgtaaacctccgtgagccaatgagcctgtaaacctcaatgagccatcacgcccagctatgtcgtctttttctagacaccaagtcctgctttgtttgcatgaatgccaggtttctacccagaactaaaatgttaatgtcagatttacctaaccagatcagaggaccaaaaataaggttatcttttaaaatgtagattctagacactgtggttgtgttgttagagggcacagcacacagctgattcctatggagctggcttaagaccctagttttttttttttttgaggtaagccacaattaaaccaggtccacctacattctccttggaccttgtctctctgaactgcatgcagaacttcacataactttcatctgtatttcctctcattactagttcttctacatcttttagaattcttttatgagcagtattgtgtgctgtgctgggggtataaaaatgaaaaagacatagctcctaagtaatcctcagggagacgttgctcccacagttaccccagcacatgtgtgctaagggtttctcttttgcacctgtaacagagcacaggacacagaaagaactacccagggtggcagctggagcaagctgagtttcctattttttgttattaacaatggctaatatttatcgagtgcttactcagtgccagccatcatggtaaaaacgttagatagatgttttcttttggtatatcccagttgttttaaagcttcctttttatttgtaagtttccagagttttatgcccttcatagctttgagaaatatgccttctatgatccatatagggcattccttaaattgtggaacaaaataaattaaaaggcctgccccaaaattgacatctaaggtgacattgctccctttatatggtttatcaagatgattttcagccccaaggaggtgaaaaactgctgaattgtattctttaaataattttttcttctgcttttttcacttaagagaaatctcttgaaactcatttaacagttgtatacgggaagaataacccctataggttcttattggaatgaccccttattttcagattaaccaaaaaaaaaaaaaaaaaacaagtttattagcatgtatatttcacatatacaggggtgatacagtcaatgagtagttctcaaagaggcgactgcattctaccttctatagcatcttcaacaaagaacagttaatttttacagaaatgacaagacaaaggaaaaggacttggagtctctagaggcagcaacttggaggaaggcacatagctggcagatgaaggctagtcagtaaagctagttaatgtagagctgtctggtaccagtctccaggcccaaaagggtctgaagttgtctttggtggttaacctttgttctccctggttggggaagggggctggataccttttttctttgtacatctgtatcctgcctttaggcgcctaaagggaggtcagagagctttcctgtatctgctgcttcttagttgccctcagctcaacagtcctgcacattctgctctcctacagctgcatcaaatgtatttagcattaatttattctttatctttattggctatgtaggcaatgtttttcctattatagtgtaaattctactatgatgagtatttttatatgtaaagctttctctgaatttaggatttttttaagcctagatctcaggacattgaaagactatggaaaaatagaatacagttttaacattcttgacatagttgacaattgacacttgctttccagtgatgtttactagtacagttttcaataactgtttactgcatatattttatttggaaaatagtgttgttgtttttttcctttctggtaatttctttctatactttgcatctcttatttttattgagcatggacttgagagactttaagaagttttgtagggaaaatacacaccgagaaaataaaaactctaggaaaagttcacaatgttttaaaaatagttttgtacataaagctatgatttttgcatgggaactcatttaaattaaagttaccaagggaattccatatgtaaacttttccttgaactatgaacttctgagacttcagaaagattttgactgtgtaggttattctgtgttgcgctatggggtccgcctttgtgttgctgagctggagagcgtgcctctgctgccgcgctgtgtcagtagtggggattgcacttttgtttccagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaagtaagaggcccagccaccctccctggcagccctgcccacacttgtcacattgccctgtcggatcttcctagcgcttcttacttctgcttccttatgctttgtcttccttctccaactaaatgtcagctcctggagaggagagaccttgtccctcttgttcactgctgtttccccagcatccagaacagcacctggcacatgttatgtgttcagtatttgccaaaatgaatgaatgaacaaaataaaaatacatcacagtgtgaaaaggatcagttagctgggggaaaatggctgctcttattgaatagcccagccgtggccctagtacacagctaatggctgctgacctaccatgagttattttgaatttcatgtctaaataaagctgtgccctttgttggggaattatagacataagatagtattttattgaattaattcttaggttcagttttttagaacaaattctactgatactgattttgtgagaatttttattttaataagggaaccaggctgtcgattcgaactcctgtgcattgatgtcagagcttgtgaaaccaatggtggacgtaaagacgcagagaaaggtagagagggccacagtgcaagggggcagccatgagtagcatgtggatgataatcgcaaggcgtgtaggtttggggtatgtgttaaaatcagttacccaagttttagaaaataagtttatttttcctttttgataatttccttctgtactttgtgtcccttgttttatttctcccacttaagtatccctgtcggtttaactatttggctcttgaggaaattcatcatgccttgttctattcagaatgctcatttgggggactctgcctcagtttactctagctacctctgtgctagcagcgttgcatgctcccatgttccccacagagcaacacatctggtttaatgctctcactgcatctatttcagacccattttcagaatattgcaactcaactttaaaataggaaaacataaccttggcccattggtggctttcaatttttaaatatggagaagtaaaccacaggactttggcagattttattggcttatatattttacaggtatttttgtttgtttgtttgtttttttggaaaagaggaaggaattctcatgtatgatctttcaatgcaagctctccaagggcatggatctttatcttgttcattgatatagccatccccagagcctagagcagttgtctggtacatagtaggcatgcaattatttttgaaagaataaatagtataaaagctgtattttattcaagcattgaatttagaaagataaactataaatttattactgcttttcaacatgctttggattttaaagctaatggatcttttattaataccttttttcctttcatcttaacccagtgttactaaaattagatttcccattttttcccctatatgaaagataatttacatttaccttgtaaaaattatcaccctgctccacttgagaaccctgctgttgtttgcaaaatcaggaccaagcccatattttttgagagctctctagaagaatttatcttcaagaaaatatggtttggtgtttttggttttttcttttctttttcaaagtcccatggccagatatcctataatatactagatgcatgtttgctaatttttacttgaattttttttaaattgtaccaatcaaaaggttctttttctttccagctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaatgtgtttaattttcctttctgaaaactctcattttaaaaacgttcatttaattatgtatttgaattattttggagatgaggtattttatgagtattttcagacaatgaaacttattagtctgtgtcagattctgagcaatcatagagtcatctaagttgtaaataaaaccttgcatagcac

SEQ ID NO: 37773 - DNA, 3738 bp, Homo sapiens
agccactctgagcagaactgacagcatgaaggtacggggcccagggtcgggggactcatagcatgggggaactgagcccactccagaggcccctggccacagagggcactatgaaggcacaaggagttctcttgaaactcgtaagctatgagggtacacagcgtcccagagagtggggttacttggcgggcggggtgggggggcagggaagaggggccaaatagcaggagagggattcaggcaagggcagtatgtgcatgcatggtgggggcaaatgcaaagagaacaggggatctctggagctgggaaggggctgtgctgaccctgtctgcccatcgccaggcactcctggccctgccgctgctgctgcttctctccacgcccccgtgtgccccccaggtctccgggatccgaggagatggtaagcagccccacactcacagacgcggcctggcccacaggttgtgcaagaagaggctggactgtcagaacagactgtcagggccgagccccagctctgcaggactcaggttcctcctttacaaaatggggcagatggatgacataagcattgctcatctcccttgaagaaatcttccatgactccttgtgtcaaagtcccccagccccagggactgaggcaaaccttggggtgctgaggtgtcagtgatgccatagtcccactctcctcactgtccccatgtccctacccccagctctggagaggttttgccttcagcaacccctggactgtgacgacatctatgcccagggctaccagtcagacggcgtgtacctcatctacccctcgggccccagtgtgcctgtgcccgtcttctgtgacatgaccaccgagggcgggaagtggacggtgagtgggaggagggaacagaggccagagctggttctaatcccagccctgtgaccctgggcttcacatatgcgaacctcagtttcttcatctttaaaatggggataatgatacccacagcacagcttctgagcagctgccaacgcttaattctaagtgcctgaggtaggtgtttgtttgtttgttttgaggcggagcctcactctgtcatccaggcttgagtgcagtggctccatctcagctcactgctggaaactccacctcccaggttcaaaagattctcctgcctcaggctcccgagtagctgggattacaggcatgtgccaccatgcccagctaatttttttatttttagtagagatgaggtttcaccatgttggccaagctggccttgaactcctgacctcaggtgatccgcccgcctcagcctcccaaagtgctgagataacaggcgtgagccaccgcgcccagctgaggtaggttaatgcacataagcctcacaataatcctgggaagtagtgaggaactaaagcccagagaggtgaagtaacttgcccagatcccacagctaggcactcgaactctagaacgcctccctcttagcctctttcctgcctctatacgaaactgggtatgaagagcccaggtgggtgctggcaactgctccacagggggcctggtgccaatgtggacgttgttttagcaaccccactcccaccaccctccccacccccaacccagtcctttaacaaactggccacagcatcacagggtccatgcttgaggtgggcagggcaggaccagaaccttgcccattggacccttgatgatccagtctcatcttctctgctccaggttttccagaagagattcaatggctcagtaagtttcttccgcggctggaatgactacaagctgggcttcggccgtgctgatggagagtactggctgggtaaggcagggaccaggtgggctgaggggctgccccagggccaggtccttgttgaccagctgcccctcctccccagggctgcagaacatgcacctcctgacactgaagcagaagtatgagctgcgagtggacttggaggactttgagaacaacacggcctatgccaagtacgctgacttctccatctccccgaacgcggtcagcgcagaggaggatggctacaccctctttgtggcaggctttgaggatggcggggcaggtataacccgctgttagctttgggaggggctgtgaggggaaagaaggcagggctggccctgcccagtcagccccaacctccttcaggcccctccttcaacccttctggatctggaagggccacagctggctccaaacaagctcaaaccagcttgggcctcagccctggggagcagccatcctggccctgctccaggcaactctgtggtggagcagctgtttctcttcattgcagaagcacatcaacccaacatctggctcagggagggtgcccccatcccgccaggctgccacgtgatatctctcacagtcgtcattgtcaccctctcccggccagctcggggctcagttccctgcctcagcagccccaacccttctctcctctgccaggtgactccctgtcctaccacagtggccagaagttctctaccttcgaccgggaccaggacctctttgtgcagaactgcgcagctctctcctcaggagccttctggttccgcagctgccactttgccaacctcaatggcttctacctaggtggctcccacctctcttatgccaatggcatcaactgggcccagtggaagggcttctactactccctcaaacgcactgagatgaaaatccgccgggcctgaagggctggccccctcaggcacctttcctcccctggacacccatggtctccatgagtgctccctctgctgcccctgatgcatgcttctgctgattcccgagcaccaactccttacaagggggccttgtggctctcagccatgccacatccctgtcacacacccagggcatccattcctaagccagacccggctcccctacacctgaagttacactgccagcagttccccaggcctcttccgagaggcacatggttctagcctggacctggctgggctccatgagaatgagttgcctccaacctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccaccaacttactcccctgtggtgagtaccgtggaaccccagcccacctcactatcatactcagcttcccctgatggcccatcccagcccctgaagctctatgccaagaacacagctaccgcacaccaccctgaaacagccacagccaaggtaggcatgcatatgaggtcttccccataccctctgggtgttgagaggtttagccacatgagggagcagaggacaatctctgcagggctgggagtgggtagggactgaaggtctcaataaaccttcagaacctgaatgaactggcttcatacacacaaacatatttgtttatcccccaaatgtaggcacctggctcctccttgctcccctgctgatggtgtcctaccccgaactccaaaaattacacctggagtcaggtgcagaagggaaccttgtatttcacaggcctcattttgatggcaaaaagacagtgtaataataacataataataataaaaatataatactgaaaagg

SEQ ID NO: 37774 - DNA, 64729 bp, Homo sapiens
tagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgttgtaagtaatttgtattctgttttctttcgctcgccggctgggccttggggggcgtccgggaaggggaagaggtaggcggagagggtggcacgcgagcccgaccctccccgctggtaggaggcaggcaggactggggaccttcctgtttcctcgctcgctcgccgccgcacttccccccgtgtgctgggttcccgcgtcccccgacccttcctggctgggtcagctgccgtcgggccgggggccttccccttccggaattgctggcggaacctctaactcgcccggccactccagcttctccgccccgtccacaaagaaaatcaaaacaacccgaaaacaaaacattgcctggtggtggggaaccacgaccctgctgcacgcgggatcagcacttggggttcgggctcgctctcggcgcccctcgggcccattcgatgttgcttttctgttcctggtctgtctcagtttgctcactctcttcctcccatttccagatgcctgtcttgtgcgccggagttagcccctttccactgaccttgtctgaatgtaggagcacgagttaaaagcccagctttgagcgttgagtccgcctgcctccacctccgcctccctagcattcacaggcggtcggagaagggggcacttcacagggtgccctcctccaaaacgacttatgtattgctttccctgttttgttttgatggggtaaccaggtttcattctgtttccttctttctctatctctggtgatactttttttttcctggttgtaaggcttgaagctagtctctttatgctttctaatgccactgcgcctttttcttttcttggtgggtttttaaaaagtttttttctcccctccccctttctgataatgagatataatttggcagctcattgccagtagattacggattttttttttcctgcaaatatacagcattgtagaggcctaaatagtgagactgcatttcttccatttttgaatattgaagcgtaagagtgcctctttgagaccagggaccgagttttcttcatcttagtagcctcaaaacgcaacatgtaattgacactcaaagttttggttaaattcaggataaagatttttgtggtttctagacatcgaatgtagtaactcaggtctattttttttttgtaagtaaggataatttctttagcacataatcaccgattgtagttttacaattatatatgtgtgtgaatgtgtttctttacaggtgagactctaactttggcacagaccttaatgacttctatcgcaatttatgtattttaaaaggattttccatggctcccacccacccccttaggttattaagaagtctatcacattacttctgtgatgaaaacgtttgttagacttaactaactatacaggtctaaaatcttggaatctgcatggtttctgtttattgatttttccctttcatagaataagagaccctaggagaactgagtctaagcaagattgttgtggtgtttctcagttcaataggagataaatgtttgcagtgatgtcgtgatgactgcgttattaagttaacattttgctgtctttgaaaagggacttctttttctgataatcataccagcattaaaaatgatagatgtaaaccttaaaaggcttcaatgaagaaataacattaagtaatttgtgtcttatttctaggaattaaaagtacttttatacctactttcccccaacattctttgaagagggaaggtatacatttctgtgaaagaccttaggtatttcaaattcttcgcgagttagttcaagtgtgtaaaatggaagacggggccaggcgcggtggttcacgcctgtaatcccagcactttgggaggcccaggcaggtaaatcgcttgaggccaggagtttgagatcagcctgggcaacatggcgaaacttcatctcaacaaaaaacacaagttagctgggcgtggtggctcatgcctgtaatcccagctacttgggaggttgaggtgggaggactgcttgagcccaggaggctgaggctgcagtgagccttgatcatgccactgcgttccagcctgggtgacagagcgagactcaaaaagtaagtatacgataattactgtagtaaacaatagagagaccaaagaatgcctagttaaagaaaaatagggcttcttcctcattaagttgctttgtttttcatgtactgctgtcacactgtcataaatgttgtttttttgatgtgttggattgtgatttcccggctatattgtgtttggctttcatttttggtatacctgtcctaatgttaaatttggatgggtgagtggcattggggcatggaccctaggtgagttgtcggaatgaatttaaatcaaaattatcgaaatttaggatattacagaacattttgatcaagtgtccatattttgtctaaatttcatatgtagctacaaacatacttttggaaagattatagtctgatttaagagtcatggtggtgaagcttctgaaagttttgatagtctttggatccattaaacagtttctcacctagtcattattgacatttatgccagattcattccttgcaggtgcctgtcctgtgtattgtagtttaacagcagccttagcttccacctactggattccgggagctccacccctccatttccccagtaatgacaatcaaaaatgtctccagatattaccagatgtgccctggggtgcaaaatctggttgagaaccacggcattaacgaaaagtgtgatgcccttatggaaactagatgtatttctgccctactctgtgttggtcagatatttttggcatcagctcagttctgagtatcacacatatgataaaaaggtgtgaaggagagtaaccagtatcagtagcatttatgccacatgcatagaatgttgtcaaagttaccaaaaagagttactgcaaggtttaggcgagacaatagcaaaaatgttttcgggggctgcacaaaaaagagggaattgtagtagttttacatcgccataacaagcagaactggtacctgctggtggatggtctgtgcttcccagagcgggatctgtggatgcttggggagggggaccactgagatctttcagagggtacataatgttcaaactattttcatgttattgagatgttttgtctttcaacatttgtacttaacggtgcaaaagcagtggtggaaaatgctgtatccatcataggaacaatcaaggcagagaaccggtattgtatatagtcatttccttccttccttccttgcttgattccttccttccttgcttccttccgttcttgacggagtcttgctctgtcgccgggctggaatgcagtggagcgatctcggctcactgcaacctccacctcccgggttcaagcgattctcctgcctcagccttccaagtatctgggactacaggtgtacgccaccacgctcagctaatttttgtatttttagtagagacgaggtttcaccatgttggccaggatggtctcgatttcctgacctcgtgatccccccccacctcggcctcccaaagtgctgggattacaggcatgagccacggcgcccggctgtcattttatttcttgaagactgcacactcatagtttaaaaagcttttgatgaaacagtaaaaggaggttaattttattaaatcttgacactttgtttatttaatgtactgtgaccacggaaagtacttgtgaagctgtatactggggagtagaatggtggttttgaggagcacttgtatgttgatttgtgagctaaactggtgttctcatggagctccatttttatctgaaagaacaagtgatgaactgtggatattcatatttgagtatttaggagacttaaatgagaataaagcaagtctgtcactccaaggtaaacaactgactattcctggccagtgaaaaattggagctttcaagcaaaatatagaattttagaaagcttgcttttccatcatgagcttgacggtttttcccaatacttaaaagatgtttctgctgacattggtggtaatattaatgcatatagttttaatgctgtataatgtgtgcttaaaaaaagaatgttttttaatatttggtagacctgtataattcagtgaacccatattttccaaatgaccatttgtgatgtaataaaatcatatgtgcattcaagggtacattcagagtgcaaggtaaaccagattttaatgcaacagagtaccaagggcttattaatagggttttaactttcatattgtaactaatctttgcaaaactgccacttgtggagttctggtgtagtatcaaagaagactactcatattaattgaaaatactaaatactcctcttttccagttataatgttgctcccagcactatgggaggccgaggtgggaggattatttgagcttacaagttcaagaccagcctgggtgacatagccatctccacaaaacaaaaagaaacagttataatgttggtttgatgccaggttttcttcatatgcttcaactagaacaatttattgcaacagattgaatgcagaagcagctatgagaatccagccatctttggtttagccagaattaaagagatttacagaaatgcaaaagcatgccattcttactaaattttttgttttggaaaatagtttttttttttttttttttttttttgagacggagtctcgttctgtcgcccaggcgggagtgctgtggcgcgatctccgctcactgcaagctccgtcttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcctgcctcggcctcccaaagtgctgggattacaggcgtgagccaccgcgcctggccgaaaatagttttttaaagctatgttaacatgtaatgagtttcttgttatttaaatgaataaatactttaaaagttcttcagttataatttccaatgtagtggatattggtaagcataatgcatgtaagaaagagctctttggagtgctcaatacattttaagagttttacaactcgtaaaggggtcctgagaccaaaatgtttgaaaacttgagaaatcctgcttgagaacagctgccccaagatgaagtagacttttcagtggtggtatgagctgtccatgcagcacctctggtgtttttttgtttttcgtttttcttgagatggagtcttgctctgttgcccaggctggagtgtagtggtgctagctcggctcactgcaacccctgcatcccaggttcaagtgattctcctgcctcagcctaccgagtagctgagattataggcccgtgccaccacgtccagctaatttttgtatttttagtagagacagagtttccctgtattggccaggttggtctcgaactcctgacctcaggtgatctgcctgccttggcctcccaaagtgctgggattacaggcccaccacgcctggcctctggtggttttctgaacactgtctggtggttttctgaacactgcacctcagcccaccccaaccgtctgtgatttaaataaaatttttttgttgttgtcagtgaaaaacaatatagtagataacctttaggaaagataacagaactgtgggagattttgattctcagattttaaaatttggagtttttgtagtgaattgctgctcagtaaatgttgattatggttttgagatgtggtgttctgccttaaacatgttttcagtccatattttttggtagagaagttggaaggcaaggtattggagttgagtaaatttatgagcctactcagttcctatccctgattgttttcctcaccttcttaaggcagaagccagttctggcttgataacaactttgaaaatgttttggctcatcagaacattctattcttgggtaactaagtcaactttaggttaacattacaattaaatttcatcttcagttttatctaggcaagtttataaagctagcttctttcaggtaaaatgagaccatttggcttcttagctagttctcattttgggagggtgtgtgtgtctcttttattctgtatgttcagggttctaattacctagcagcttttaaataattggacaatgccagtttatgatttacaaagcagcaacattataggaggtaattggttcccctaaaagttggttaaagttgaggctcaaaagaatacctgaccaaggtcataaaggtactaaattgtagattggggcttaaatcagctctggattctgtgttgcattgtcattccagtacactataccatctcctgtggacactgtagggaaccatgtgtggttagctcagttggagtctttatttatttttgagacaggaactcactgttgcccaggctggaatgcagtggtgtgatcatgggtcactgcaggcttgacctcccaggctcaagggatcctcccacctcagcctcccaagtatctgggactacaggcacgcaccaccatacgtggccaatttttgtattttttactgtgacagggttttgccacgttgcccaggctgctctcaaactcccgggctcaagcaatcccaccttggcctcccaaattgccgagattacaggtggctcatgccaccatgcctggccagttggaatctctgtatagtttcaagtagaattaattttcaagctcaattttttttgtgtgtataacatgtaaatctcaaagtatttacataataaaaatgtatacaaaagtatataaacaaaagtaacatatagtgtatacttgtagtatacacagaatgtaacatactatagaacctgagatcttgtgcattgcttaatgattggatatattctgtaaaaatgtgttatttttcagattttattgtgggaacagtgtacttaacacaaacctaaatggtatagcctgctatgcacctaggcctatgcaccaatgatatggcctgttgctcctaggctataaacctgtggcagcatgttactgtaccgaatactgtaggcacttgtaacacattaggaagcatttgtgtatctaaatgtatgtaaacacaaaaggaatagtaaaaatacggtattatgctgttatgggaccactgttatatgtgtggtctgtcattgactgaagaattctgttaacgtggcacacgactactttcagtggctttatttgcatatatattcttatttaaagccatgcacagatttgccacttagacgccgctttgttgtggccagtaccttttgtgggagttgcttttttttttttttttttttaatctttggattgtatgtaggcctgctgaactgtatagcaatctcatttgtggaaacctaaggatttgggaaagaaaaaataaaggcattctgttagatttctttcttcctcttttgttacagaattatttttcaaatttttattccctctatattttgtccagaaattggattcttggattttacggcagtttttataattttgaggttgatcaagaatagtgtttgtcattttgatcattagaaacatttaaattacatttcctgaaattagtgtctgtaatactatgacttactataatcttgactattttctgatacattttcacactctttcgtactttttcaggtcctgtttcatactttattaaatttacatttctttcattttcaagttgtacttggcaagttgatgtagcagtgtacaatttggcttttttttttttttttaagtttctcctagccatatgagagagagggacacaacacacacgcgcgcgtgcgcttgtgcgcaaaggggcagttggaagtaccctttggaagtgaggaaaaataacttggccattgtagtaattgaacagcaagtaccctttctctgcataagcaaccttgaattttcagtttggccttgggctttatcatacatactttattccccttgagcataaacaaactattaacatcatctttgagcctctgctgctgctttactaaatattggctggatggcccacctgcagtacgtttttaagaatatagtgggatctaaatatttttagtaccacttacacagaacaccttacggtgggccagttaaccatcgttttaatttcttagcaaatagattattttggcgataatcttgcctgtaagctactatcatgccgtataccttgtgaaaaaggagattgtattattttggctaataattaatatttaatgcacattgagatactttagagagatcccttgtatcttttctgttcatgtcctttgaatgagcacattaaggttaagacctttaaacagcaaattctactgtgatgaattgttactttaaataagttaactgtagtttatctgattggtttcaaagaagaatatttagcaagtttggctttcagttttaactctatcatgcaaataataaagtgttttctgttaagtagtagctataaattggggcagttgactctgttaatatcatgggccacaacttgttccaaatgcctaatatcactaggtggggattaatcagtagtgcctgatgagttttgtataaattgagacacaggcgggctgtggtggctcatgcccgtaatcccagcactttgggaggtcaaggtgggaggattgcttgagcccaggcgttcgacaccagcctgggcaacatagtgagatcctgactctattaaaaaaaattaaattgagatgcaaagtacttaaacattaactatttaaggaaaacaccaatggaaatatgatgttctgtccttttgtgtgttagtcgtctgcctagattacgcctctcctttccgatcatttactgtgtacaccttctggcatagtcatgattttatctttgtttctttaatggtttttttcccaaacttctactttgcacttgttgtttaaggatctgaatcccagactaaatttgagattgtcattgaaaacagagactaccttaagcatctttgtatttctgattttatttagcattgtcttttatgcatatttaggaatttggtacatttcaacctcataaatactgtactttctgacaaaaggtagatgagaaaaaagtgcttttaggaaaattgagttgatgtttaataacttggccgccctagcagcttcctggagcaataaataaagcaatatttgctttggatttactatttctagccacagagtattgcactaaaaagctattttaaaaatctttgtttatttcacaaaatagtgttttaattagcataaactgagtttttagctaataaccaaaagctaattattgttttaatttgaagatttgtttggtgccccttgctgccattatagggggttattttagcctccttgctataactattctaatttaatggtgaacggtagaattagttgactttcaacttttgcaagattattaatatttactttaaataatttaacatgttgaaacaagtttataaaatataaggtaaaattttacggtctcaattctgcttgattgtgtttctatgaatgtgttatggacataatatacaaatagttaaaaaaaaaactgggtgtcatggtccatgcctgtaatctgagctataagggaggatcgcctgagctcaagagtttagatcagcctgggcaacagagcaagacaccatctctaaaattaaaaaaatatatatctttatctatatgactacatattgtaaatgatgtgcagaggtgcctcagtatagagatgattattataggctatgatatcagctatctgggttcatattctggtccagtaaacttagtcaagccttctttcttagtttaatagtaagagttgttagaaaaaattgggaataatgtaaagtgcttgacttaatacgtgggttatgttgaaatttcagtagatggcagctatgatcgtaattatattctgcaacttttttttctcctgatacacatgctgctaaacatactatctcattgctttattttggcatagttttaagttgtaagcatgtactgtaattaacaagttctttactgatggatatttaggtggtttccagttttacttcattgcatactctgctcagtgaacaaccttgattacctttctgtgttagttctgtgagaaaggttcaaattccagaacctatgagatcaagagagttaatttacaaatgaatgaactaagtaccaaagaagctccctttttaggggatagccctgggatagacactgctcatttcaagcttatttctgttgtgctggaattcgggtccctattttggtctgtcttccagtctttgcacccatactctagcagtggctggaaatgtatatattttttattgtttgttttttgctttttttggggatggagtcccgcttgttgctcaggctggactgcagtggtgtgatcacagatcactacagcctcagcttcctgggctcaagagatcctcttgcctcagccttctgagtagctgggactacactacaggtgcatgccactacagctggctaatttttaaactttttgtacagatggggcctttctatgttgcccaggctggtctcaaactcctgggctcaagggatcttcctacctcagcctcccaaagtgacgggattacaggtctgagccgctgcaccaggcctggggatttagctttttatgtaatttatattttaaaaatgtgtgattaaagagaatatgtcttccaatttcatggctttcagtttgaaccttctgtcctagtatttttgtaataaatagatcgctggagataaagttgctagacaaacttttaaaattggtatgtgcatttttaattttgataaatatcatattgccttttaaaatgatgtaacaagtttgctttcatcgtgatgaataagggctcgttttttttacaccatggccaacattggaggttttttgtctttcattcttaccacatatattaaattttgtttttcattaatcaggttgtcttaatttgcttccctgatatgcagtgaaacttttttaaaaattgattgaagaattctttatgtattcagactgttgctgttttggcataagctgcatgtattttctccttttatcatttgctttaactttccttatgtgctatattgttattatataaaagttggaatattttgatgtaagtaaacctgtttttatggcttttgcgttccgtgtcttgcttgactaaggctctgaaaatgttttttattttctttcagtgcctttatgctttttaaatatttctgaaatagcatctgggttttagattttactatggacagtcaaagccatttgagtatttcatagttgtcttcactgatttaaaatggttatcagtatatgtccaaagatgatcatgctttgcctatttgaatgtatgaccattaaactccagttaacaaatcataggaacttgcactatttgcattaggtatcttttttttttttttttgagactgagtcctgttctgttgcccaggctggagtgctgggatctcggctcactgcaagttccacctcccgggttcacgccattctcctgcctcagcctcacaagtagctatgactacaggcaactgccaccacgcccggctaatttttttttttttgttatgtttagtagagacggggtttcactgtgtcagccagggtggtctcgatctcctgacgtcgtgatccgcccgccttggcctcccaaagtgctgggattgcaggcgtgtgccaccacgcccagcctatttgcattagatttctaactactgtaccaaggtggttcttgatagttgagattgtatatattagttaagtcgaatgtctaaccttttgaaacaaatatcccgccaaaataaatagccaacagtcaacaaaaatgtcactattctttctaagttcctaaatatttatcctaattagagtcatcttgacagccctgcatggggaaaggaaagacctgtttctcagctttggtctaaaaactttcgtatttggaaactgctctttagtgttatgtgttgtagttgtaaaattcctagtttgttatccaaagtaatgaagagatacaataaattctaaggtaaatctgcagagatgcaacttaccaagaataatataactagtggcagaattgaaaccagagtaatacgacgagtagcagaagtgaaatcaggcctgctttctcccttttttatcagattgtttttgagttgagaccagactttgtagtctgtcctgaatgctgttaccagaagtcacagtttttttagtatacagttatattttaggaagacatacttagtagtaatatgcatggtggaaccatgtgacaaaggagtggaaggaaaggagttgggaccaagattgccaagaatcagaactagaatagttgaaaacgaattgttatatagaatgttaaaattaaaacaattaaaaggcatgtattctatgtgaactttgccttgatgaaaataatttaaatattataaagaaaactcctcgtattctaaggagagaagagttctgaaaattctttatacattaccttgaacctgtaagaaaaggtgtgtttgtaggggaggagtgtttggctgtctttttgtggttttgagagggggcagaattcatatatgtactattagatgtaggtatgtatttatgtgtaactctgatccagaaaggatgaagacttttaagaatgctttagtcataatattaaaaactggcaagatgtttgcattagatgtggatgaaaaggaagaataaggatagatacacaatggagcaaaatattaggctactaaaaatagttcttaaggaaatacagtaacttttgtatttttatagagtagagagcttgctagatggctgccagttgcactctaagaattcaggcagtaccctgaaggtaaatattaattatgttggtgagacgaaaatggaccagttgctcaagcaaagcacagtgttcttcatattaaaaaccaggaagacattttaaggaatcacaaatactgcagctatatgtctggtttgtatttttcctttttgtgttacgtaaattgtagaagtttatttttcaaagtagaatagtgtctgaagaaaattaaatactggtaaaaatgtttctagaatgggcagatgtctagtgcattcaagaatgggaggaggaactttgcattcttgggattggtagctgtctggtgtatggttccaggagagtgtcagtgcatatgtaaggcagaagaatccttaatctttggaggtttatgttccaaattgcccaatattggagtatatagttttgttagaaggagaacagcaacaaaaagattccttaaattgttttatcactctacttaatttctaatgttaaatggaaaatcttcacttccatttaaagtgttacaatatttaatgtttctactttggacgtttgaaacatctgggagcctggaattcttagtctagctccttaagctcatgctgagccatttttattggagacacaagtatcttgtaaatttcagagtatgcatttgtttctttttatttggtaggtctatgttaacgtagtttttccttttctttctttctttccttccctttccttcccctccctccctcattctctccctctctttcttccttcctccctccctccctccctcctgggctcctatctcaaactcctgggctcaagccatcctcctgcctcagcctcctgagtagctaggactacgggcatgtgccaccaagcccagctaatttttatttttcatagagatgggtgtcttgctgtgttgcccaggctggtctcaaattcctgacctcaagtgattttcccctgctgtgcctccctaagcattgggattatatgcatgagccatggtgcctggctcatatatattctttcttgaattagatggaacacatgtggttttatcttgacagaaagtaatactgaggctagatgatgtgcctacatttggaataaagtaaataaaaatttccagcttgcgtctgatttatttccccatcaaaatgttagtgtaatcaatattttttcaaattaggctgaacaagtcttgtgcgcgtttagaaatcagggcctgtattctaatgttctagtgagaaagttaaagtagacaggagctttccaagcattgtttattgtgacaatgaaagcctaaagatttgagtaagaaaaaaatgggaagatttaggaatcttacagtggatactctttgtttttttaatgatccaaactgaactggtaatgaatttaattccttgagaatggaaaagaatgcagagaaacatattactcgcacaaaacaaaaatagaagtttattgcttgaagctacaaaagtataatttcagcttatacttgacttaaaagctctccttgcttgaaccagatctagcctagacaaaataaagtttttacactttttctggctttacttgcgttaaagtcatttataaaagcattcataatcccaggataattgtgaaggactgtagtttattcagaaaaactcatgaagcaatgaataacacaagataatacaattacgttaggatatgtggtaagcgtactttgtattgtgcacttgaaaatttaagagtagatctcaggttgcgtgctcttatggcagaaaaccagaggggtacacagggaaacttttggaggtaatggatgcgtttattaccttgattatgctaatggaactacaagtgtatgcatatgtccaaactcaccaaattatatacattaattacgttcagtagttttggtatgtcagtgatatctcaataaaactgggggaaaaaaaaacctgtgtgtgatgaacaagacattatgaattcagttacatttcatgtgtatattttaaccttaggagatgctacatatgattggaaaacagaacatttttattttgtcttcagcaaatgcttttttttttttttttttttcctgagatggagttttgctctgttgcccaggctggagtgcagtggcacgatcttggcttaccgcaacctccacttcctgggttagagcgatgctcctgcctcagcctactgagtagctgagattatagcatgccaccacacctggctaatttttgtatttttattagaaatgggtttacgccttcttggctgggctggtctttgaactcctggcctcaaatcatctgccctcctcggccccccaaaatttgctgggattacaagtgtgagacaccatgcttgggccagtcttcagcaaatgcttaatgctgatggggattaacatagcttttgagtagctatgcaacttagattaaaggggcaggaggaaacgatctaatgtgaattaatttctgcaagagataaatctgattcatatttattcagtaaatgttattataaaatctgaattaaaattaagacagtatgtaactagaccaggcaacagtaaatagatgacacgcagtccagcagctaattagtaacacgcagtatgggcttcttggcattcttagatctttcttgatatcacaagacaaattacagaacagtctagccgttggagtatagaccagaacccagtggatttgttcagtaaatgtatcataagccttacttgcatagcattcttagatttagcactttattgctttttgcttttttttttttgagacggagtctcgctctgtcccccaggctggagtgcagtggtgcgatctcagctcactgcaagctccgcctcccaggttcacgccattctcctgcctcagcctctccgagtagctgggactacaggcgcccgccactacgcccagctaattttttgtatttttagtagagacggggtttcactgtggtctcgatctcctgacctcgtgatccgcccacctcggcctcccaaagtgctgggattacaagcgtgagccaccgcgcctggcctttattgcatatgtagattatcacactttaacttaaagtagaaattgtatttagaacttggtaaaaaaaagtagctgtggttgggcatggtggcccatgcctgtaatcccagcactttgggaggccaaagggagcggatcacttgagctcaggagttcgagagcagcctggccaacatggtgaaaccctgtctctactaaaaatataaaaattagccgggtgtggtggcatgcacctgtagtcccagctactcgggaggctgaggcaggagaatcggtggaacctggaaggtagaggttgcagtgagctgagatcgtaccactgtactccagcctgggtgacagagcgagactccatctcaaaaaataagaggtagctgtgtgtgtgtgtaaaatacactttttttttttttggtagagacagggtttcagcatgttatccaggctggcctcaactcctgggctcaagccattctcccacttcagcctcctgaagtgctgggattacaggggtgagcccacacctggcctataaacacttaatttcttaaggaatggaatttgggagaaataaccgatccagattttgggtctttccttattgtgtacttggttttgtatgttattcaactgttagtttaaaattattatgttgacttcttaatttaatgaaaaaatatttatgaaaaaagattgagtcagatttatttcctaagcatttaaagcatgctatgcctttttacaaatttggaacttatcttaaaatggataaaatagctgtgtgtgtgtaaaataaaccttttagactagcatcattatcgaagtgtaaatctcttaaaaagatcattaacaagcttaaggtatattcaccctaagggaaagaactatattcagttctttcccttcaaattttgtttaagtttttgctatttgcttcattatctatgaacttcgttcattgtaagccagatgccaggtttcatttggggaatgtcttatattggtaaagtagcatttctgtagcgtgtttatcaatgtttaagaaacagattttggcttcttttcaagaggtgaaatttctcagaagtttactatattctgaattagtgttttctctagcaatgtatttggtctggattctaacttagatgtttaagtagtgacagttaaaatccttggggcaggattttctctttggtcacttgcttttggtcactttttgtcaaaaattttgggggtattgcagggaaccaatcatgtttagaaatgtgtgttactaaattagtttttctggtcttactgatttgtttcaaattgtagaattcttttggcagtaattgtatccaattttgtttatagtccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggtaaatagatattctatatttttttaactcggaaacttttattaatgttgacataaactaattttgaggcattctctacttacttagaagaccagggttatttgcccagatctatatatctgttttggagaagagggatacttaagagagaaaactttttgtttttgagacggagtcttgctcgttacccaggctggagtgcaatggtgtgatcttggctcaccacagcctccgcctcctgggttcaagcgattctcctgcctcagcctctcgagtagctgggattataggtacccgccaccacgcccggctaattttttgtatttttagtagaggtggggtttcaccatgttgggcaggctggtctcgaactcctgagccttggtctcccaaagtgttgggattacaggcgtgagccaccgtacctggctgaaaacttttattttctacatagagttctcttcccttaattttgatgttatttatttttttttctgaagaattaattttgattttttatgcttttggttattatagtactgaattgtctggagaaaaaggaatgccttactcagtgtaacagtgcctgtatatatatatagaaagagagagagagagaaagcgagagagagagcgagcgagcgtgcactaactacaatatactgtgcttctgattgcttaaaaactcataatttaggaagaacgcctatttaaaactttaagaaatttaatcagtaatgatctggaatacttgattgataattgttttatcaacaggattttaattttgggaaaactaaataacctggtaaaagagtggatacgagaaatcagtgaaagcaaggtaaggcaacttttttgtatatgaaataatttcatatatagccaactgaacacagcaagtgtcttatataacctgttcttatttgagtggatttggagtctttaatgtggagtcaattttagactattgataacagattttacattatttttctagttaatttggaagcaggaaaaactgaactgagttaagcgatttttaaaaataagtatagtactctttgtttggaacatttgaaaactgaaactcagtaattgtaaagtacttacactcttcacagaaataatggatgtttctctaaaaaggtgctttaaacatatttgagactcttcttaccttttaagaaattctgccacagttagtttttaaaaaagattttcaggtattattcaaactgaatatttatttatttatttattttttatttattttttttgagacagggtctcgctctgtcattcaggcggagtgtagtgacaccattatagtgcactgtaacctgaaattcctgagttcaagcagtcctcctggcctcagcctcccaagtagctaggactataggcatgtcccttcacacctggctaatggtatatgtggagtcttgctgtgttgcccagactgatctcaaactcctagcctcaagcagtcctctcatcttggcctcccaaagtgctagtgttccaggcgtgagccgctgcccggcctatttagttttctgtaataacattctttgggtttccttttttctttctttattgagacagagtctcactctgtcacccaggctagagtgcagtggtgccactgcaaccaccacctcccgggttcaagtgattctcatgcctcagcctcctgagtagctggaattgcaggcgggcgccaccatgcccaactattgtttttatttttagtagagatggggtttctccatgttggccacgctggtcttgagctcctgacctcaagtgatccaccttccttggcctcccaaagtgcttgggattataggcatgagccactgcatctagcctctttctttctttctttttttttttttttttttttttttgagacagtcttgctcagttgcccaggctgaagtacagtggcaccatcttggttcgctgcaacctgtgcctcctgcggccaactgattctcctgcctcagcccctcaagtagctgggattacaggtgtgtgccaccatacccagctaattttgtattttagtagagatgggcttttgccacgttgaccagctggtctcaaacttttggtctcaagtgatctgcccacctcggcctttcaaagtgctgggattacaggcgtgaggtactgttctgtcctctttttttttttgagacagggtctccctcttgcccagactggagtgcagtggcatgatcttagctaactgtatcctccacctcccgggctcaggcaatcctcccaccccagcctcctgagtagctgggactatataggtgggcaccaccaagcctggctaattttttgtagcgatggcttttcaccatgttgcctaggctagtctcgaactcctgggcttaagatatctgcttgccttggcttcccaaagtgccaggattacaggggtgagccactgccccagcccctttgagtttctaacacttcattatgaatactcatacatacaactcataaatacatggctgggcttcttctggtagagaaaatgtatttgtagagttgtgtgtggagttcatttgacccatttaaaaaaataacataaatagtggtaatttttccagggtagtacaaaatccgtgtttaatctataatataactgaaaggttgaaaagagaaccaagggtaaaggaaaaatttcatagagcagggagacagggtgtcaacttaaaagttgtagtcttttggttttaatgaaatttatagtactgtttacttatgcagtgtatatgtatatttcaaaatacaaattaaacttcagcaaatgtagtattctaaattatggactttacgtaccatgtgtttcttactgattttagtttctgatagaaaataagattttttttttggtttgtttgacatctaatactcttcacttaaaaatgaaaaaaagattttgcaagtgaaaatgtttttccatgacctgaattaagaaatcttaatttctgggttacaatgatgataataagtataaacatactaatatctaaaaatgtagtttataatatactagtcactagtcaccagccaggtatttaaataaaaattaaaattaaacattcagattcttgactacactagcaacatttcaggtgctcaacaaaagtgataacagtgacagaatatttacatccttgcagaaagtaccattggagagtattcttcaaaagattgttatgtcttaatagagaagtctgtggaccagtgttttaagatagtttctccttcacctcctttgtaggctacttgtgcacacgtcttgctggctaattttaaataaccaggtcagcgttgccattgaggttttaaaatatctaaacataggaagacaaaggctttgcttacttttaagaaatacaacattacagccaggcgcagtggcttacgcctgtaatccaacactttgggaggccaaggtgggcttatcacgaggtcaagagttcgagacaagcctgactaacatggtgaaaccctgtctctactaaaaatacaaaaattagctgggcgtggtagtgcgcgcctgtaatcccagctactcaggaggctgaggcaggataatggcttgaaccgaggaggcagaggttgcagtaagccgagattgcgcccgttgcactgcagcctgggtgacagagcgagactctgtctcagaaaaaaaaaaaaaaaaattacacacataacttgtctattagtgtctatagtgatggttaaatatgctcttaaaaaacaggagtctctgactgtttagaacttggctttagggtttttttggagtatgaaataacacttcattttatgtcctttttcttttttttgagaggaaggggggtggtcttttacatgttttggtactgaatagatattttattatactgaggagttaggtaaaaggaaatattgactaaacacttcataaaattgtttttgtttggacagaccttgtcattcttacgagcagggccattgaatactaaaccgtaaagcttgggactttacactagtgccagggccaggaaggcagtttttgaatgctttctccctcttcctgatgatgctactctttctgagtaagaaaagaaaatttagttgtttctaaattacttcactaaagccttttggaaatctaaaaaactaagcaattatttaccaatattggctttttcttctctgctctgctgtccctttccccttcccgttccccttccccttcccttcttcccctcttccccttccccttctctttttttgagacagggtctgactgtcgcccaggctagagtgcagtggcgtgatcatggctcacgtagccttgacctgtaggactcaagcaatcctcccaccttagccacctgattagctgggactatatgtgcatgccaccatgcccagctaatttttaaaacattttttgtagagacggggtttcacatgttgccgaagctggtctcaatctgggctcaagcaattggcccgtctcaccctcccaaagtgttgggattataggcgtgagccactgtgtgtggctactattggctttcaagtcacttttgatatgataaaaaaaatactctaatatgttgtgggatatttggtaaaaatcgttgaatataatctttttctttaaagcaatcagaatatgtttttattatactctaaattggtgattcattttatatacagcatctttgtcatgaataaagtccccgattctaacgtgctcctgtgggattacatgatcttctcaatcacagtcttctttatagtagtttctagaaatagggcaagaatctaacaataaagaataaacctctttaaaagttgaaaatggtttgaatttcaaatatgattgatctgaggggctggtattttttaagaacttttatagactttgaataccctttatataaatttacactgtaatctttcttggatccactccctcaccccagtatagtatcatttgaatagtttcccttgtgctccactggcaaaataaccattttttgtttcaacagaatcttccacaatctgtaattgaaaatgttggaggaaaaatttttacatttggatcttacagattaggagtgcatacaaaaggtaagtattatttcatttttcttagaaagggaccctttagttcttaaaaattatgacatacccgtctcagttacttgtgtatcatatagcttaggcttgcatggaagagagagtgctttgaggagtctaaatttttcagtaagaaagatgtaaaataatgctgacttctatatcgccactgtccaaaagtattattaagattaaatgaaattagcttagtgtggtgactcatatctgtaatcctagaactttgggaggccgaggcaggtggattgcttgagcccagggaggtcaaggctgcagtgagctgtgattgcattgctacacttcagcctgggtgacagaacaagaccccgtctcaagaaaaagtaaataaataaattaaaaactcagagtttcagtagaggtagccacattttatctgttcagtagccacatatggctagtcgttactgcattggaaagtacagatacagagtagtttttctgttggagagctcttttgtacagtgctgctatctacatatatatcattttccctcaccagaagaatatcactctggaaatagaacaaaaatgaattctagcttttaagaaaactcatggatgccccccgctaatacctttatagacaaattataaaatatagctaagcaaaagcaaaccccaaaaatgtgtattcatagccaatgataatcagttaatagtttatacttgtagttatttcctctatgcaaataaatacacaataaaaatgttacctcggcaaagaacatttattgagcttcttttctttcactgagtactgagatcttcattatcttatttagttcttccagtactgttattctcacataacaaacaggagcctgagactaaaagaggcaataaagcttgaacagtttttctcaaccttctagtggcagagtaggtacaactcaggcatcccgaggctgtactgtctttgggtcttgctctgttgcacaggctggatgcagtggcacagtcttggcttactgcaccttccacctcctgggctcaattgattttcaggcctcagccacctgagtagctgggactacaggcacacgccaccatgcctggctaattttttaattttattttggtagagacagggttttcccgtgttgtccagctggtctcgaactcctgggctcaagccatccacttgcctcggcctcccagagtgctgggattacaggcatgagccaccacgcccagctgaggctgtattctttaaccatgaactgtatctgccgagatagtgttgtctgttttctagtatcctttcctctctccatctcccatcactctgtcccattagtacattacttttgatatatcctgtgtgctgtacaccgttcttcctgttctaataaatagctttcagagtcatacctcagcatcttgtcttttaggaaaatgactgttgacctgattccacattaatctctcccttttatgaccccaattgattttaattctcctttttaaaattctgcctatgtacttagtgctggcctcttatcaagcactgaattaatgacaaatattttaccattgtctacttctttggattcttctgcttgaagtttattttgtaggtcccatttaggggcctggtagagaacctataagcaccaaatacgtagtacatagaggaaaactatttttgttttaccaatgaacatggctatgactaatgacatcaagatgttgggtgtatgtttgaataattccctctccaccatgaaagtacttgctgagccatctttctttgggctcccagtttacttgggccactataaatagaggatgctgcaggatcaaaatataccacatcaattaaaatcatgtttgtcctccattgactggtaattttaagtaaggggtggaacatttttagaagctcaccagtatgttaaacagattctcaacatcaaatactaccatgataggatgcaaaataattttcttgtaatattaattagtggttgatgggcttaattttttttaggtgctgatattgatgcgttgtgtgttgcaccaagacatgttgatcgaagtgactttttcacctcattctatgataagttgaaattacaggaagaagtaaaagatttaagagtgcgtaaatgttcggggtgaaatgggatgagttatgaacattcatttagtcagttgagtgaattttatgatatagccatcatttattgagttcttgcaatttgccaaacctttctaaacacttggcatatgtgtttgtgttttattctttacagcaagcctaaaattataaactcatttacagattaggaaattgaggcaaacaaaataaatatgaaataatctggccacaatcatacatctgatgagtgggtgaagtaaaatatttgaaccttgatttctgatctgtctgatcgaacagcccagtcttaaagctagctatttttgtgtcaggtgttttgctaaagtactaaaactagtagaggcttaaaatgtagtttcagagaccctgaacttgtttactttccttataggctgttgaagaggcattcgtaccagttattaaactctgttttgatgggatagaggtaaggtatagttcaaattgacagttcttgctatgtgctgtcactaattttgattgatataggttaaaaacttggtttaaagtttataattagtgagttggttgtgatattaataacaattaaggcttttaaatggaagtgactgcctattcttgtagaatataccattttaaatctttttaaaaataccaagtgaaatttggagctaaaacagaagtaatgaaaccttaagattgaaatgctattacaaaaaagtttttttggtagcttttccatatgccagttttgtgtgcttttagtctcattaaggcagtagcataatgtgtttttgcaagtaatgctttgctttgacttcatttaaaaattgggagaaaagtgtgagtgctgaaatatcttccgataggggaggatttatggactcaaattcttgagatgatgttcatttctccttgctgctttcggtgtgtgtaattaaagtgatgagaataaagttgacagtgaagcaactttagtaattcattacttttgctgtacagaatggtactggaaagtcacagataataaagtgaagattgtaacattttggaaactgtaagagaaataatttattgaagctgggcacagtgatgtgcacctatcaggaagctgctacaggaggatctcttgagcccaggagcttaaatctagcctggcaatgtagcgagacttaatctctttaaaaaataaaaaagataattcactgttgtactattttgcaaaaaaatggctgcatctaaggttgctgcataagacgctcaactctgtattttatgaaaagtcaagtgactgaccttaataagtagacataaaatgttaaatttggtaaaggattatcaagttcatgtagttttgatttactgtcagtgttttaagtaaacgtaaaaataatctgtaatataaagtataagttgaggcctcattttcctaaaaagaatattactgacaaagaggacttttttttggaaggagacctgacctaactttgtaaactttacaggatcaagatggaaagttagatggctacttaaaacatttaatgtgttaattttctattatacatgctatattaaaaaataatattttaggaacataatattttaggaaatttagtaatcattttcacatttcaatattttttgaagtaattccatcctttaaaaaatgtgtcagtattattactgagttgctttttcagttacctagttttatgagcctataatctttatttctgtccaaattgggggagactttgaaatctgttctttttcattgaacagtttatcctagaccacaagtacttatttgtgtaacagtacaattttttttctgtaggtatgtttaaatgatattttaaaatgtgctcctaaaatactgctttttaaaaagtgatctagtagccaggcacggtggctcatgcctgtaatcccagcactttgggaggccaaggtaggtggatcacgaggtcaggagatcaagaccgtcctggccaacacgttgaaaccctgtctgtactaaaaatagaaaaaattagccaggcatggtggcgtgtgcctgtagtcccagctacttaggagactgaggcaggagaatcacttgaacccgggaagtggaggttgcagtgatccaagatcctgccactgcactccagcctgggcgacagagcaagactctgtctaaaacaaaaaaacaaacaaacaaaaaaaaagtgatcttataaaaggcttgtttacagcgacatccacatttttggaaccatgaaatcataccctcagggataactaccaaagctgtgctgtttctttgcactctcacctttcctttagaaaagaaacaattttgtcagcggaattctatgtcttcaaaattagccttaactgtggttgttttaggctgtactttccccagtgtttttgttttacttaaaactcagttggaaaaacatactgtagtattacagacataaaagttctcagatataatggaatctctttattgagaattatttttggctaaatgtaaggatgtttgccttatatttgagtactattaagttctcatgtataatgagatctccccttattgagaggtatttttggctgaatataaggctatttgcctaaatttgggtactttttagtatgtaatcaatttataattcatatagatgaagagctaaacagttaactttaattcagcatatgtatttactagacttactatatccagtagatgcatttaacaaacttaatacatcaaacttgataattgtgattaaactgacaaccaggtatttgtacatttccatttctgttttaaaaatattgccatgtttgtttgtttttttttttcttttttttttttctgaggcagggtcttactttacccaggctagaggcagtgttgcaatcacagttcactgtagcctcaacctcctgggctcaagggatcctcctacctcagcccccccaagtaggtgggactacaggcgcttgtcaccatgcctggctaatttttaattttttttgtagagatggagtctcactatgttgtccaggctgatctcgaagacagcctcaagcagtcttcctgccttggctcccaaagtgctgggactaccggcgggagccactacccccagcctatattgccatgttttaaaattatctaattaaaatacctatgatacgaaataatatagtttggacttttggagggacattgtcgtgttcatagataatgaaaggatcctggctttaaggaaaattaggtttttgttttgctgttttgagtcagggttttactcctgtcacccaggctggagtgcggtggcatggttttgacttaccgcaacctccgccttccaggctcaaatgatttttctgcctcagcctcccacaggtgcatgggaggtccatagctgagaccacaggtgtgtgccactacacctggctaatttttttgtagtttttgtttttgagacggagtgttgctctgtcacccaggctgtagtgcagtggtgcggtctcggctcactgcagttctgcctcctgggttcacaccattctcctgcctcagcctccccagtaactgggactacaggtgcccaccaccatgcccggctaatttttttgtatttttaatagagacggggttcaccgtgttagccaggatggtctcgatctcctgacctcgtgatccgcctgcccaggcctcccaaagtgctgggattacaggtgcgagccactgtgccagacctgtattttttttatagagacagggtttcgccatgttgcccaggctggtcttgctcaagtgttccacctgcctcagcctcccagagtgctgggattttttgtttgtttgttttttcatagaaatgccttaaaagtagtttgacagatatggaatgttgttttgtttgtgtttcagattgatattttgtttgcaagattagcactgcagacaattcctgaagatttggatctacgagatgacagtctgctaaaaaatttagatataagatgtataagaagtcttaacggtatgagaaagcctacttccttttgtgtacttcagtttttgtcagatattagttgtttttacacaagttttgtattgaagctttttatagctatattgttaacacagtagtgagttaaataaaatgaactttgcctaataaactacagaagagtatgtagtagtttatttcactctacagtattttatacactgtatttcttctgtcattaatggtatactcaggacacttaaaaagaccatctgacttttgtactctgttgctagtgatttaggtttcatggcctaacccaaattaattttgatcctgttattctttagtaatgctttcagcattgctgagatcagaaggactactttggtacaattttatattagcatagcttgttactgtgctcttgaagagcagttcttggaaactttagtggattaagtcttccgcagtatatgtgggaagttttaattgtgaatctgaagttcaaattggggcaggttacagtttactttggtttctttggtcagtgcttacaataggagataaatgctttagattttttccccctctttattgaattagctttactggttctaccaaataaaaatttatgtttacttttaacttcaatctcagaaaatttggaagcattaccattaaacttttgatgatttaatgttgtttttttttgttttgttttgttttgtgtgtgtgtgtgtgtgtgtgtttttttttacccctattaattaggttgcagggtaaccgatgaaattttacatctagtaccaaacattgacaacttcaggttaactctgagagctatcaaactatgggccaaacgtgagttcagaatttgttggctagcttattaaaaatgttcaaacttttgttcaacactaacttatctttttgcttttcccttatcaacaggccacaacatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaagtttagtcttatttctatgacatttctcagcttggtttcagattcaaattttagttcatgatgtagtcatgtaggcagccttggagatcacattgtgtataaaatggcaaactgaaactattttttttccctagtttggccaggatagtaaggcagattctatttgtacttccttgcataaacttaccctctgaataaactctgaattttagcagctaagatccaatttattgataggttgggaaatcagttactatacttttggataaaacttgtacacactacctctttcactcttttaattctctatctataggccattagtttcttgtgattgttttttttttctttttgctttcagcatttatttggcctaatattaaagatacgaattttcataagaagcttttaaagaataaattaacattaagtgcttcgggacaaaaaaggaatttgagattagtcattaacccagatttttttaagtttcttcgtttcatttccacatatgtcaactatgatttaagaaaaagtagaataaaagattactgccattttatattaattgccttggcccaaaaggtgagggttcttggtttttaatcaaattaagataaatcgtccattcctgttcttatgaactcctgctcctccctctgcaaaagagatgttcttttctagtaattttataaaaattagttatttgagacaatttagagctgtgttcaactggaggaaaaataaaaaaaatttagaaccatgccacacttttcagtacacattctggctgttttgggatttagtagcacttataatcaggtgtgataagattaaagaatgtcagaatttcttttttttttttttttttttttgtttgagacggagtctcactctgtcacccaggctggagtgcagtggcacgatcttggctcactgcaagctctgcctcctggattcatgctattctcctgccttagtctcctgagtagctgggactacaagcgcctgccaccacgcctggctaatttttgtatttttagtagagacgaggtttcactgtgttagccaggatggtctcgatctcctgacctcataatccgcccgcctcggcctcccatagtgctgggattacaggcgtgagccaccgcgtccggctgtcagaatttcttttaatgctacacatatataagcaaataatgtttttaagaagctaaccttgatgttaagagtggcaggtgttctccagtttttacctctttcatatgggaccaaagtagctagtttatggaacacatatgaaaatgtggttatgccaccaagttttactactacacttgtcttaccacttttaagtcatgaattctataattattcatacccctttgcctgtgatcagaagtaacttttaaaattatcacttgactttggatggaactagtataaaggcaggaattttgtctttcagtggagatttattctgttcaaggttgaagtggacacatcattatcttgggatggtacttctttatttaaatagtcctttaaagttctttgagtggcagagaacgtttttggtttcagtctgagaaggctaccaaatggtttaagttcatttcatagttaggagaaaaagattttgagtagtctaatgtcgtcagaaaggattaaaacgttgtatgtaccaagaaggcagaatgaagaaggatcacgttcacaaatgctgtatgtttaacaaaatacgtttagatggtaatatccaatagtcttatcaagtgctacaatctttttaaacagggaatggccaaatccagtgctattgaaacagcctgaagaatgcaatcttaatttgcctgtatgggacccaagggttagtgtattattttttcccctaccaattcacactgtgcaataacaagtaaaaatcatctgcataaactccagggagacttccagccttttacttatgaatggtcatgtccgtattacactttcttttagataacctcaactataattgtcctcaactataattgatgtgagaagcataattatgtaccctgtaaaccacatttaattgtacatagtttttaatacagattttactaacattttaatttattctatatagaactaccttgtaagtcaaagttgtgtgggcatttgtgctttaaaaaaaataaaaggatactaaaaatccctgtattttttattttatctaagtattatgctaaagttgggttgttataggaaagctgttacttaatgtttacatgtggcatataacttctaagcattttcactttaattaccatgatgtaattgtaaaaaaaattggtttagatattttagagattataaaaacatggttgggctaaagaagaccttccattctgtttcttgggaagttacaacatttaccgcttactcattttaaatgttaacaacatgcactttataaactgataaaagaaatttaggtttgaataagatttcctaagtttatgaaatcctttttttctaaattattacaatatcaaaaattttaaattctgttgaattacatcaagctatgcattttcaggttttccgaacctcaaggcatttacttttagaggatgtgaatttacaacttactttgtggaaatgtgccacttactgatatacagatttaaaattaacagtatatcatttcattatctcctaacatatcaacatggataatgtagtttcaccgcgtgttaataagcttgaactccttaatagtttcagggtatattaagaacttaagtttctatcttgttgaaaattagcttacaaaacattgtagcatgacatgtctctaaaggtaattgtatgtgcatccccatttctgttgttgaataaagaaaaactaaacatcaatagattcccaagcagaacttttttgttgttgttcagcaggcacactttctagtaaggttgccaaaatccaaattgaagcagatcattagtttagatgaaatctttgattctataaaaaattcctataaaaacaatgtctctctacatggtttttctttctcaactccagctatgaatgaaataaaaaatagaatcattggttcagtttaacaaggggtaaaaagcccaagtatctgttgcatatgtacttgaagaaactgattggctgttgttgtatgtaggtaaaccccagtgataggtaccatcttatgcctataattacaccagcatacccacaacagaactccacgtacaatgtgtccgtttcaacacggatggtcatggttgaggagtttaaacaaggtaagtgtttatccttatgctctgatttatacaggaaggatttacgtaccattgtagacccagtagtcagctgtgcaacttaaattgaagaaggattcactgaagtggattttggtgttcatttatttattacagtatatatttgagaactgacttcaaaaaattaattccttttaggcaatttgttttttataacaagttggaagattaaccaacagttaaaaccagtaagctggtttagttgcatactattgccttgtaaaattataaatgataacagtttgtctacactggttgaaatgagagatgtttagcaggctgtatactcctgggaaagaactttgagcaggaatggggccaaaccacccaattacattccattattttggaggaaccttttaacttttgaaccctagttgtactgttaatttgaaggtatagctactaccaaatagtctttgagagaaataactggaacagattggtttgactgaaaacagtaaaggaaatagaatcagttgtctgactactagctttaaatttagacgtttaaaattcctgaatattttacactttagtttcatctttagtctaaagaggcccatcaagggaagatgcctctatccctttagaaacaacagggaaacttggttttagaaaggcaagaaacaaagtatattggaaagttttccttctcgggtaactggagtgtttaagaaagaaggtcattctatgagcatggcattttagaataattgtactttaccagaaacctggttctcaaaaaatcttccagctttttaaaaaaaaaatgtgtatatatataagagtatgctctaaaatcataagctaaaactatatatgttaaaattctggttttaggattatagtgagtgcatgtagtatgattaagattatttaaaattctagattgtagactgaagtatgcaaacattttaatatgtttttaatttaggtcttgctatcacagatgaaattttgctgagtaaggcagagtggtccaaactttttgaagctccaaacttctttcaaaagtacaagtatgtattttaaggcatgtcggacatgttgctctcttaagtaatggtttaatggtagcacattatgacatttcttcttgctggactaatgttattggaagaattttctttcctgtcacaaggacatactgttttagtgaactccttagttttttttggttgaggtaatgaatgtgaagcccctttgatttttctgcccgatctaactgaactcctgctacatttgtagcaacataagttctgtaggcatacatcagtcatgacaaaaacagtacatctgtatacagtggcaagtggatgcaccctgaaaaatctgtagttaataattctctgctaagaaacagtatttttatctaattctggaaactcattaattgctaggaatctttaaaacaaagacaaagctaataaaatgtcaatatatagccaattaaatgttttcaatagttacagcacattattggcctgccattttcccccaatgttatagccccttcaaatatttctacagctagctttcatgaatctaagtgggtgttaatcattttaattaatggtttaaatataatggtttaataccttagtacaggttaaaagcttcattaattgtgttagttttgatgaaaaatgtaagttataatcttatttaaaaaacagacaaaccacagacttgcacttttatttgccctgggctgaaaatgtgccaaagtcccacttaaaattttttttttaatgcttgaagcttttctgaccatttgatcttgtgttggattgtgttttgtaataatctaagcaagattgctttatgctcttccccaattaaaaacaagaatgatgaccttcatgatgtctctgtgttttgtttctgtatcttttgcatgagaaagcaataacggagccagtaattgtgttctcgaagcactacgttgtcagtaaaaattaaaatagcataatcattaaatactcttattttactacgaatccccccataaattgtgatttctgtttgacagataatttttctttgtttttattttaaccagtgtagaggaagtaccttggaacatttaaactaataaacatgtatgtagatacttttaaaactatgatataaaagagacacagttacatgtaaggagaagaataaaggaattggttttacaggaaagtgctagtaccccttaattcctggaatcaatgatgaaactagattcaaactttgttctattcactttcgtataggactgtgacggggcttctttcactttaagaaagattaatgtttacactgaacaaaccttaataatgtcattttatttgaacaaattcacatcattagaactttggtgctttttctaaagcttgcttaatgtttcttttaaaagttttaaactatgcttcagtccttgctggatagtacctgtaagttctttgactggttaaaagatatattactaatcttcactgaagtttttgtgaaataatcaaatttttttaggttgtaaaaaaagcagcaacaaatagaggaaattacatcaggaaaatttgcatttcagctgagtgtcttgtgaaaacttttaaaatatgacaatgggctagttttatccataccaaattctatttatatttttaattgttctccagaaatttgcctctttaagataaagtgatgactatcattaggcttttggaggtgttcacagatttgaatttttaaagacatcctcatataaaatactccaaagattgactgtacaaccaaatggaaatgtttagtcttcccatgagtcacaagttgattcaatcttatttgaggcatatcatgaaatactgtcagttgatatgtgtaggattttaaatcatgtgaaatatacctgacattcttggaaggagccagaaccatggagaaaaatctcgtttgttttaaaatgcaaactaatcatcttccagaaagacttatcagtgttcctcaagaaaaaggggtaacattgttttgtgaaatttttggagttctaagaaaacagttttttaaatgccgcttctgagataattcaagttaacatgtaactagcagtaaatcattaacattaggaaatgtgaatacttacttcagttgttagatttcactaggaataaaggaaaagtattaggaaaaccaatgtattctctaaggtgcaagatgattttataatttcatgtgtgtatacagtaaccttaaatttgttaaaaaagttaaaaacaggaaactaaatcttggtcttgaattacgtaaacatagaattgcaaacatttttgactaagatatgccagctttttattgtacatctgagttatgatcttcccaggtgagatgaaatggtcttcaagagattcacttagagaatttgttttgcaaatagcagttaggtaataaagtaactaaattaagtgtttttagggcactttgcataaattctaattattttgggatacatttttatagttaaatttatttttaactatgtttttaactatttttattggaaactatatatttttaaatttggggaaaaggtaatggcaattgcatcaagacttcaaagtctcgcatggaggcacttgcgcatcataaacatgacagttttaaacatggcacttgtaaaataggggaccatgatttttcgtacatcaacaaaatgtctaatttagatgtacactaggtttctgtggtctgattgggaccttaagaattgagtaccaatcctggttttaaaaattaaaaatagagatatttagagaatgcagttggaattttgttttgtaaatgaattcctaatgactcaaaatatttgcgggtttttttttattaaacttaactattgcattttatatctcaactcaaatttgtttaaatgtggctgagtaaaggacatttaacctcagcataaatacttgttagaattacttaatatttctacctatatgtgaatgtgtgcatttgtgtgtaagatatatacagagtaggtactctttcccttttggatttcagtaagaagttatgttgaactctaggattcaaaactttgaattgccagcaaaaccgtgtccaaatggattgtatgttttccctttataaataaagaacattgtatatcatttaaggttttgttgaagactaaggtggttattaagaatttccattttaataatgtgttgtaagagtgatttagagactgcgggagttttgtccctgcccttagatggacccagacagctttgtgtttttgtgtacatgcctgatttctatacttcattgtctcctgttacaagtcactgtactttcgtgagagagctctttctgcatgttctttacctttttttttttttttaaccagttagccatttttaatgttttagggacctagaaatcaggttactgagcttgttaggattttgtttgatttaagagcatttggaactccgagtatgggtttttctacacataaaatacatgattttttaatgcttttatatgacttttgttgatttatttgggccatctgtgcttgctcatgtatttgacatattccaaataatgctgagcaaattaaactggtaaaggaagtattggtttgtaggagtttggactgcatattcacatatccctatataccttgttttttatatatctatctctgttaccttgagtttatagacttcaagttaactccattgaactttacaatacctctgccagtaaaatgtgtactattatcccattttacagatgatgtacacaagacttagaattgcctaggattacatagctgtgaagaattaaaaccatttttcttttttttgttttgagacggagtctcgctctgttgcccaggctggaatgcagtggtgcgatgatctcggctcactgcaagctccgcctcctgggttcatgccattctcctgcctcagcctcctgaatagctgggactataggtgctcaccaccatgcccggctaattttttgtatttttagtagagacggagtttcactgtgttagccaggatggtctcatctcctgaccttgtgatccgcccgcctcggcctcacagagtgctgggattacaggcgtgagccaccacacccggctgaaaccatgtttcaaatacatttttttaaaataagtttggtagtttttctctgggtctaggtcagatttttgctcttggttagaaactatacttataaaatgtgttagaaagtattaggaaggttttagacttttcaaagagtaaaataattttaaaattgtggttatactgctacttttgaaactagtgtcagtactagatgatgtcagtttgctttttggggtagagattctggtgtgaaatttggcccccagcacttctaaaatgggtactgtagaagagtatattggattgaacttttttagtcgtaggaaactgaatcattgtagttacattttagttgtaaatagtttgttttaaaaagacttcattatttatttgatcatgatgctattttctgaagtgaaaacttggcttttgtctaatatgaatgggattgagttttggataaaaatcagatttctttgttgctgtcatgttagtgattttttttttcttttttgattatagaaatgtatactcttaaaattgggaaaaaaatcacagggcctaactgcagtattcagtttaattttcactactatttcatttgaatttaaaagcatgatgtgtttgatactgtttttgaagttactgttgtagtatgtgtatttagtgataagtttttgtgtctaaagcaatggtgttttgattctattgaaacatttttgttataagtagattatattttagtgaacagctctttaattttataggcagagcactcaatcggtgtcattgagcaaaattattaatgcttatttatgcttcttgaattaagctgctttttggtaattattcataaagtcactgcctttttcagaagaattaaactcactagtagttagaaacatggaatttagcatatatgattttatgtgcatattgagattgtagtcccccttgctaaattgatgtggatctataactgtaaggaagcttattactttatggtttaatatccagcacaaagcgtgtaaataaaataaatagcatgttgtctttatcttcaaaggcattatattgtacttctagcaagtgcaccaacagaaaaacaacgcctggaatggtgagtataagaatagactttacagaaaaagcaaacttcaaaatgaatcacatagccactgaacacagtaggagatgggaggaagtccttaaaacttctagtttggtttgatttgttcacaaatggagctttactgtgtgtagtggaagtacagaaatcaggagatccatatgcaacttatttttttgtttgctttatggagatccgtgcataatttcttaattgtatatttaaagtgcacttatagcttgtttttcttaaaatttttgtgtggataacttttgtaaccttgctggtgtgaatggagtgtttcttggctcttttttccccgttgtttggcaattttgggtagaacataaggcttctggttttatctgtgggagttcagctagttgaaatgccctggtatgtgcattttatttatttatttttaagttaaccaaaactttttgttaatactaagtgacatttgttcagggtgggcttggtggaatcaaaaatccgaatcctggttggaagcttggagaagaatgaatttattacactggctcatgtgaatccccagtcatttccagcacccaaagaaaatcccgacaagtaagcccttttctaatttaatttcttcttcccatttccaatttttattcatagaagcttttacaggcattttttataactagtataactattctgttgactacatatggcttatagacaatttagaacttataatttagtttttcctgatcagaaacattgaagagaaagactgtttcgtgagaaaaatcagcacacattttttttctgataatattcttccaatgatgaggtgcctgttagctagagtttacattctacagttctgctttaatactgtctttaccattccttcttaatattttttcttctcctgttttgtacaatagttgtcagaatagctggtataccatacatcagtctttgctttttatcttaattttttgttatgaacttataaaaatctgatttatgcgtgattctggactgttgagaagataacataagaaaaagcagagtcagtttacctttttaggggtcttttatttatgtaggttagttgttgatttgattgtttgctgttcgtatgagactagactctatactttgttgcattggagaattggagagtactagtaatgagcttattttaaaaaataaagcagcattaaaacaagtgaaaggatcattaaatttgtgttatacagtattcttattgattatatagatttttttattttgtaattatataagagtttttttacattttgtggtaattctaatcttaattataacaagaccgtttgatgttccattcagtagataaactgttaaatgttcaaaagtagctaaatcactaattactcctgttatgcttctgttcatgtggccttttaaattgaatttttgaagtttaagaaatatctattaagttctagttaaatttctgtatttagaaaaatcctttttttcccagatttttctaaaaagattattctttttccttcattagtttaaagataatttttctttgatttcagtggctttggttctttagaatcatcattaaggacattgactatcaatgcacagttagtaagagtatatttctcctggatctctgtttatgttgtagtaggaatatagaggacaggtgtgggtgaggactttgcgttttcatggagcttgggcttagaacttttagtttgctcatacatttgtattgtaagtttttccatgtctctgattgtcagccacactgatagctacattttcatgaaatccagataaactatggtaatgctcttctttgcagggaagaatttcgcacgatgtgggtgattgggttagtgtttaaaaaaacagaaaactctgaaaacctcagtgttgatctcacctatgatattcagtctttcacagatacaggtatgtctttacttggataatcaaaacacttcagttcttgcatatttcaaattgtcttgatgcataccatagtgatatttacaataattgttgaaattacttgcgaatattgaactatcatcagaataatggttttgtattagtctaatacagattgagtattccttatccacaatgcttgggaccagaagtgtttaggattttttcagattttggaatatttacattacacttaccagttgagcatccctagtctgaaaatatgaaatttgaaatacttcagtgagcatttcctttaagtatcatgttggcactcacaaatttttgcattttgtagcagtttcagtgtcagatttttggattagggatactcaacctgtgtatacacgatttttctctattgtggtgaccttaaagttaagtagaaccattccaaacttgacttgcgcataatttcttgagaaatgggaaacaacttgaatatatggttgtctagactgaatctgtgtctaactgccttcatcatcttgaacctgagaaattgatgaagcagaacttgtgatgacctggagaaattttccgactatggggattcaaatgttaatgcataggtgggaaataggctgattatatgtagatttcagattgacctgtaccctaagatgaaaggtagttcattttaaccaaagaccaaatggtggatgtagttgagagaatgagtctatatgtagctgcacaacttttaatgggaatggcaaatactacgcatagggacaaccgcatttcttctttaaggactaatccttttctctcgcagatactgtccttctctccccatttaaaacaaatgtagtaagtggcatttttattccctttgaggagttttcacttgagaacatacagacttaaaattaagaaatgttttacctaattacaggagagaaaaaagttagtgccagtttgttaaaaagtcagtatcgtacactaactgtgatataaaggagaaataaaaggaaaaggatatgtatttcaatatgtcagtgctcagatacagtgacactagaagataacttaagagtcaagtgattgcactttatgtagaatcgcgagcagtgtgacatctataaattctgactgatacaagtgttgtctgtagggattcagctatcaccagcagcgttagcattggtgacctggtaaaagtgaaagttgcaaataaaaagtgatctgattttgatatgcttggtggtagttgtattcctggaaatttcaaattaaaatactctattttttgtttgttttttctcgttttttattttaaatactccattttttaaatttaaaattgaagtgaattcttgtttaaataattgccaagtaggtttttttgtctttaggaatgtaggaaggacatggtataattctgtgttgggtagaactgtccacattgaaagatatatagtgtttctaggcataataccttttaatcaatacaataacaaaaatacctctgcagatttttagaatgtcgtatgtagggtgatactccacctgctgaacaccacagaagtattttttcctgaagtaaaaattctgatgttaactcatttatgaactaataagtcacggatacttacctggattagaaatttgttctgtacattgcattcaagttaagatgtttatcaaagattgcactaatgaaccatcaagattttcaaggatgttttaggtattttgggaaggaaatatttagttgtcctgtatattgaaacactttaatccaatactttatgggatttttaaagaaaataggtttcacatattcagcacacaaatgttcactcccaacccctaccagtttcttttcaagttattttggttgttcaacctagagacattggaatcagtctttgactcctgttttttccatatttgatgttaatccactataaaatctttttgcctcttctttcagaatacattgaggtttctgctacttagtactgttcccactgctttcaccctaagtcctagccactatagtgctgttggatcactgtcattgccaaaactttctcttttgcccttgcccccttcagctgttcttacctagtgtccagatgatatttttaagccagatcatatcttgcctccttaaaacctttgagtatttgtctcactcaaaataaaagtccaagtctttactgtggtttgcaagcctctgcctgatctgcctttttcattatgtctgtgaccttacctcctgttataagttcacagtcctttatctgtaagttttggagccagaagggtaataaagttagtaagtaatatacccagtgaggcctggagcagcatttggtactgaaagacagtatcatttctgcagggaaccattggtactcacatggagcaaaaggtaaagaccatatagccatagccacaaatagttcagaacagggtttgttactagatgaattttgtttcctatcttagaaaaacttgtgtgttgagagtttttgggattttggagttgcacataagggattatggatttctacttttcatcttcttcattggcatttttcttgtttctcaaatgttccaggcattttctgctgcttagggcattttgttcttgatgtttgctttctctggaatgctatttcaccaggtactctcagcttacatcctcatgttcatttaaatcttcagtcagatgtcaactcagtttccaggctgagcttcctatcctactccctacgtggtttttctcagtaatacttatcatcatctgacacggactatagtttatgttttatttttttgtgtttattctattctccctactgtaatgtagaccctttgaggctacgttggtctttgttcactgcttatctccagtgtctaggacaatatgaatcaagtataggtgtttcataaatatgttttgtatgaccgacttttttactttttggggccctctggatctaaataatttgaatttatttaattgtagcattttctttttgtacctgtgacctctgttatttaaattattactatattagaaagtatgtcattagttagttttatcttgcagattcttgtaaagatacctttaggtatagtttaataagtttgacttattttacagcatgtgttacatacttgggtaaagttttaaagaatagtactggtagcataaaagggtatgggtgtaagaaacccttttcccctcatttctgccatttcttaaagagttactctttagagttactactttaagagctatttaaagggttactacactggaagaattaatacattttgtgcttttattcagctcatcttgtggtaaaaggagtttgctcaggcaatgaattatgtcagattaggaataggtcttgaccgatctacagatatgcagtattgatggaaaaaggatccctacttagaatagtttctctggagtgagtataactgcctttattaaaatgtttctatttcttgtaacaatttcctaattgtatagtttataggcaagcaataaacagcaagatgtttgaggtggatatgaaaattgctgcaatgcatgtaaaaagaaagcaactccatcaactactacctaatcatgtgcttcagaaaaagaaaaaggtaaatttagaaagtacttacaaaagcattactaacataatgttttatgcatctggactatcattatttcagaatttaggctcagttaataagtcattttaaatagatgacagctttttaaaaatctgtttcatggagcagtttcattatgtgaaatctgactctaatcagttttcttgcacacagttgctttagattttagaaggattagtggtgatgcttcatatccttactttgtatatacccgtattctcttttaggactttttattcttattcacttaaaaatcccacaccagtatttaattttctttcctttaaaaagtaaactaaattaaattagtaaggaaatatgtgggtcaagtaaattatgtgagacttttaaaaaatgaaagtcgctttttttggtgaatgtaaaaaatataacgtatattaaaaactaaaagttgctgagtgtaaaggaggtcatgaacagaggtcactgagttaatattttgcattacattgttctagtgttagtgcttccttttgaataacttagagccattttttccttatttggactttagtgagcatattggaattttagtggacagatacaaattacgttttttctttaagtgatttcaaaaatagatggtttattcttataatggaatacttcacagtatgcagcagtgaaaataaatgaactacaactgcatatactaatatgttgaataaaaaaggcacatgtatgtatgtatcacttgatacttccatataaagtttacaagtttaaaaacctaaaaaacaatgtatttaggagagaatatgaaataaaagtatatgttacagaatgacaactactgcattcaggaaaatggctggttgtctgggattggggttgggaggaaaggaatgaaattaatacacaaaagactttaattttataatattttgtttcttaaaacaatatattatgatacaaaagcattgaagttaattaaaggcaaggactctggagtggactgccttgttcaaattcaggctctactgtttcctacctgtgaaatttgagcaagttacatggcaaacatcttattcttgatttgtctcatccctaaaattgtggcaatatttttacctattttattaggtatttcatgaggattaaatgagccaatacataaatacatgtaaatggtggtttagactagctcctggcacataataaatgctcatattggcttttgttatcaccatcattgttattcacaacttggagataggtagatagatggggaggggtctaaaatcagtttttaaggtttaaacatgatgttattctaatttttttttttttttttgagacggagtctcactctgttgcccaggctggagtgccgtggcacaatttcggctcactgcaagctccgcctcctgggttcacgccattctcctgcctcagcctcatgagtagctgggactacaggtgcccaccaccacacccagctaattttttgtatttttagtagagacggggtttcaccgtgttagccaggatggtctcgatctcctggcctcgtgatccgcctgcctcagccttccaaagtgctgggattacaggtgtgagccacagcacctggccaaaaattttcttcttaacctaatggtttactaaaaatttagttaactaaataaaaattgacaaaaatgtaccattctcaatgtactatttatacacagactgttcagtgcatgtttccacatatttattgtaaaattttccatcaagcagttttattttaaaattaaagtatctcagctagagcttagcctcaggaaaacaaaactaaaatatcaagttaaacacttgctttctaattgtcctttagtgttgtattattaataggttaaatcaattgtacttaaatgtaaatttatcacatacagaaaatataaacattttggacccgggaatggtggctcatgcttgtaatcccagtgacttgtgaggctgcagtaggaggatcctttgaggctgggagttcaagaccatcctgggcaacacagcaagactccgtctctaaaaaaaaatttttttgagaatggtggcctgggccttatagtcctagctacttgagaggctgaggtgggaagatcatgtgtgcccaatagttcaaggctgcagtgaacttatgattatgccattgcacttcagtctgagtgacagaacgagaccctgtctcttacaaaataataatttttttaaaaaagtatacaaacgttttatgttttcagaagtgaaagtagattatgttctttagaacttggctatttcttatgaatatttaattcataatcaaatagctatttaataaacagctatttataacagataattagatttctcagaatcatatattcagattacctttttaaactcttagtatttccatgacaatattgatatttggaaccatcttgtgtacattttaagtaaatttgaatataagatgttttattatttctttaaatatagtcatctagaatataaagagaatcattaatgattggaaatttgttttttggtccaaaaattctatcagatgaagtaactataatttcacagcaaacctacttttaacattttatttatacacagactgttcagtgcctgttaccacatacatatttttaaaaggtttttgattaaacttgctattttgtgacctgcctttttttgtgttaacatatcgtgaccatctatccaaattacatttttagtggttgtttaatatctctttatatagctacagtatgattaaatctaccctgtatttgagatcatttagattatttctaagtttgcattagtaaaatagcactttcttgcttaataacaagtgtctaggagtcaagatctatgaatgttttgtttggactcttataaatagcttccttttattaactgctttttgcaaagcactgtacgagtcctttttatatttaatattccaccaacccatgggtattgtctttagtagcagaaactgaggggttgagaaccttgccctgggttatgtagtatgagctgtgaattggacctaggtctgactgcaaagtatgtgtgtgtgtttctttctgtagtatgttctttgttttattttattaaaaattatgatagaatatttatgactatttggctttgaggtctcttgctaccaaacttgatctggatatagaagcaaacaaagcaaagtagcttaatgctgttttgtgtttagaccaaccagataaactttcacagtttatccccaacagtggcctgttaactcacagctgtttggccacttagtgaggcaggtaggcaggtaactgtagaactgaatataatttacttactgaataaatcctcatatctagtggagagtaagattggtagcattgttgaatagaagagatactcatttataatattaggtacttctatttcacgactgacttcataagcaaatggcattactctctcttcctctcctttctaccaaatctcatcttccccatttgatcaattttcattcatgtacataagtgatatgtctagtgctaaatcaaagataagaatattttgttatttggggaactagaaagcagagaatgcaggcacatgtataaggaatgtatttttgtcaacagtataaattattttcattaaaatgtttctgtaggtaagtgaacacaggctaaacattctggaaaaaaaaattaagctgaatgtaatattacagtagtaccaaatagcgaaaatttaaactctgttactagaaagcaactttaattccatgaaaccatccatagtttttggtttttctgcattatttgttttggggtgctttgatttttaaggaggaccaacattaggatttgtatattatgtttagttttcagaaagttatttctgcttttcttttcacaggataatttacagtattaagcatgccatttaaaaaattctgaattgcaattagagcactgaagtctcttgcttttgagagaggctctttttattgacaaatagtaaggagtggcaataagttacactttttgaaattaaaaaaattttatatttattgtaggataattagaaatctatatgtaaacaaaatcacttctagtcccactttccagagtcattgtagtcccatgtttattgttgagacatttctttcttgtgtgtgtatatttttagagttctctgatttgagattcttgtgtttttatattatagtgtttttaatttgtgttgtatcttacagtcagtatgtacatttaatacggcatttctttctccctttttctcccacataagaactatatttaatgttgatgccttcttagaagaaagtacttgactcccaaatcgttgccttttagagtcagcatggcacatctaactttcgtagatttagtgatctgtgcttttcagtaaaaatcatatatgttaagtaaaaggtttccatgtttcaacatttggatgaaataaagatatatttgataaaatgttttattgtttgcagcattcaacagaaggtgtcaaattgacagctctcaatgacagcagcctcgacttgtctatggacagtgataacagcatgtctgtgccttcacctactagtgctacgaagaccagtccattgaacagttctggcagctctcaggggtaaggaaaaagagggaaatagaagtggaggggctgtttgctaaatcaatcagatacattctctttttgctattaaagtcatctatttagaatgttattttcattccatctactaatttttttttaaatagcaatttaattcccaggtttggggatagtactttttggttttgtcttgtcatacttaacattttatttttgagactgataatgtcttcagtcagatgtgaatgaatgttagcacataacccctccaaattcatgtatttagatagctactgctacagtgcactgtatggtgtgctgatgagaacagacaaaaggaacaaaaccacctttctgtcccagagctgcttatacctttgtaacagggaatgtgtctatgatagttagggaaacctgttttagaagagctagatatctgtctaacatttacagcagttaaaattttaaaaatttattattattttgagaaatggggtctggctgtgttgtttaggctggccttgagttcctggatttaagcgatcctcctacttcaaccttctgagtagctgagactacaggcgcatgccactgccctgggtatgaagcagtgaaaaattttcagccaggtgcagtgactcacacctgtaatcccaacacttggggaggctgaggtggtaggatcacttgaggccaggagttcaagaccagcctgggcaacgtagtgagactcccatctctagaaaaaagtaaaagaattaggtgtggtggtatgcacctgtagtcgtggccactcaggaggctgaggtgggaggattgcttgaacctgcaaggttgagactacagtgagctgtgatcccactgctgtaccccagcctgggcaaccagagtgagaccctgtcttaaaaaaaaaaaaaaaaaaaaattttgagtctcgctctgtcacccaggctggagtacaatggcgcgatctcggctcactgcgacttccgcctcccaggttcaagcgactctcctgcctcagcctccggagtagcttggattaccgtcacctgccatcatgcccagctgattactgtatttttgtggagacggggtttcaccatgttggccaggctggtcttgaattcctgacctcaggtgatctgcccaccctggcctccccaaagtgccaggattccaggcatgagccaccacgcccggcctgtattacaatttaaccaatggcagaagtgcgggttggggaggattccctggatgagtgtgaaatagaaaatgctgaggtgttgtggatgtgtttttttctttcttttggacttcatgtgtatatgtttttaggcaaatcatgcataatccaaagacttcaggcctgaatatgtcctgtaagtgttatcattttaaaagtttttttttaagtgaagaaactaacattttaataagaattttgggatctgtgaaagtctgtgtcctttgagtgtgtgcacaaatataaaatgtgtacaactgtactaaataatttcacaaatttagttttgaagtttagtttcttgaagtaatactaagtaacttctgtaaataaaacttctgggtttttagaatacgattgtatatttgctcaacaagcagtgagtgtttattatgtactaggcaccttgctagccatttcaggctttcttcagcatctgtggttgttctctggccaactatccttttctttttagtcatttaatatttgtgcccttgagggctctctcattattcttttgtctgtttatcccctcttgatattgtccctgagtggtaacacctgctctgttgactacatttacattcatataccaatgatatccatagctttaataagttgactgctccgtggttccctgtggatgtcatgtaagtaccaaaaataacaagtcttcgaagtgttgcctacctcctcatggtgtcatcattcaccagtttcagagtgtgggtgatagctctgagagagagagagagaaagagagacagacacacacacacacagacacagatagagacagagagagaaaccagaggacttttctgcttttgtttttcttttaggaggtaataaaaccgtgaatttatttaaatgctaatgtgtaggatttacttgagacaggaaaattggatgggagagtaaaggagtgtgatgatttgagtttcttgagatgacaggagttagtgagatttagaacatagattgggcttttttatataataaggaataatttctttgtataggaaagaataggggttaattatagaaataggtgtgtctctttaatatttatacttagaatttggggtaatacttggctagtggcttttggttggttgttaagtaggaaggtcatttgagattggcatgagaaagagaaaatgagagagaaacttcgggggagtaaagagggtttaaaataagttattttaaaagtaagatattgaaataatccccttgtcacttaaaggtctttaactgggccactggatgggcttttagggttttataaaactcttatactttgtatacagaagtttatttctgttttctgtttctcagaacatttgctcattcataactttttttttttttaataatataggtttttttttttttttcttgtagagacgagggctcactgtgttgtccgggctagtttcagacttgagctcaagcaatccttccacctcacctcccagagtgctagggttacaggcgtgagccaccatgcctggcctcttattaataactttttaaaggatttttgttcgaaaaaatccttcagttaagtctcttagccaaaattagctaagaatagatcttttagaaccactctggcgatatagtagccagccgccatatgtgacaatttaaatttaattaaaattaaatagtttctcactagtcatattttaagtgcagagtagctatgttttaatagtggctaccatgtccagtagcacagatatagaacattctgtcatctcaggaagtaacattagacagtgctgctttagaaggtttgtgtactatttactgttgttatactttatccaataaagtcagttgctaaattgtatgtataggaagtaaaaccaaagaatcatttactttacaaaataatttctatatatgttatagattattgtaattttttttttatttttctatttttaaattttgagacaatttttaatttttttttttttagcagaaacagtcctgctccagctgtaacagcagcatctgtgaccaacatacaggctactgaagtttctgtgccacaagtaaattccagtgaaagctcagggggtaaggagattgggtttgtcaggtttgagaattcttacattatatttggtttagccttcattttgaaaagtgggtttgttaagtagttgaaattcagttttttaaatgccagtttattttttgcatgtaaagttattcatgaaatcaaattcagagaaacaaaaacttacaacttgatactgatttggttattttaatttgtatatactcatatatttgctgcttaggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggtatatatatgaaaaacatattagttagccatggcaacaccaactgcctatttttaaatccagtggaagaaaagtttatgaaccaaaatagagaaggatcaaggaacaaagcttttagaaaattttaggtgtgtctgtagtgctttagtgctgtagtttctcttcacctttcccattcttctcagtaactacctctgctataaagctatgccctctcatttaaacttctttagtgtgtgtagttagcaggtattgtctacaacagaatttaacatgaaattacatgtattcttaacttattattctctaatgactaccttttatttgtactgattttttgatggtcctttggacagttttttgcttctgtgatccaaaaggagttttggagtttctctactgtacttggtgttataggaccatcaaataccagaggttctcagggacttcttactgaatgataagtgcatgcagccagattagtttttgaaccttaaatggttagctctctaacccttaaagaaactttctagcatcatttgcatttttgttttttaactcctgggcacaggcgatccttctgcctcccaggtagctagacccacaggtgcatgccaccatttccagcttaattttttgttttttgttttgagacaggggctggctcttttgcccaggttggagtgcagtggagcaatctcagctcactgcaacctctgcctcccgggctcaagcaatcctcccacctcagcctcccaagtagctgggactacaggtgcgcaccaccatgcctgcctaatttaaaaaaagatttttttgtaaagacagagtcttgctatgttatccaggcttgtctccagctcctgggctcaagcgatcctcctgtcttggtctcccaaagtgttgaggtcacaggaaccactatgctttgcaagctggtattaaccttttatactacctggtttataattgttacagtcttagttttgggaaaaccattaaaactgtacattgatttcgtatgagtcttaaaatagaggtagtcttgttacacaattttatttctccctcgagtcactttcatgttgttttccaatcagtgaggcatttgcaattgccccagagatgacagtctaaaagcaccaatttcattgtgttttttttttttgctaagaatgtatttagtaatttacttactacaacacaatttctttagagtggaaaaaaaacccctctagatttctcatggattctattatgttttgattaagaatggtgaaaaattattttattattttattatttagcttattctctgaagactttttctttcttttttttttttttggaaatagctgctattaactaaaagtaatctgatgaattttgtcactcttaagatggtaaatgagaatgaaaaacgggtattgtatagtactttaaatcccccagattacttacgatgcctaatacaatgtaaatgctgtttaaattgttgttatgatgtattttttaatttgtgtcatttttattgttgtattattttttatttttctaagtatttttgatccatggttggttgaattcgcagatatggattccacagatatggagggcccactgtaaataatcataacttagaagatgtgttctgaaaactcatctgtgtctgtgtaattatctcttagggcagtgattttcatcattggttgtacaacagaattagtttttggggttttttttgttgttgttgtttttcaataaagattttagggctttctccaaactgaatcagagatcttctagaagttaggcctggagatcctattaagagccctgctgccacatgattgggttgtgcagcagctaaagaatatactcaatttttgtgtcaattacacattcagactactgatactggtttgaagttgtcacggcatttcagaactcaaatttcttttgacattagtaaagtgtatttaagcataattctatgcatttaacatttggttttctttatgttaaaaatggcaccctaagagctctaaataagtttgtactagtgcagtattttgcaattttgtttgcacttaccttggtagaataacacttgtgtttcttgtctggtttagaaaagcaataagaatatagaatttttaaacttaagtatggaaaattaaaaatacatataaaagagtcattttatgtacctgtgtacccatcacacagcttctgttataattaactctcagccaatctttgtaatcttaattctttcagcctttttcattttctcttgccattgaattacttaaaagcaaaatccaaacatgtttcattagaatcttaaaaatcatatctaagaatgaaagcattaacagtaaaattagcctactcacaaaaattaacaatttattaatatcatcaaacatctagtcagtgctcaaatggcccctgattgtttcattgattttttaaaaaataggctgtttgtttaaatctggaagcagaaaaagatccctgtgttgcaattgtttgatatctctaagtgtcctttaaaatatagattccctcctccatccctcccccacttttccctgtaattttttttttttttttggtgtatgttttctcagtctggattttgcttacagtatttctacggagttgattaatagaactatagcattttaagaagataaggggtattaggttattccatgggctaatctcatttcctaccagaagaacttgctgtttagtggcttttccagttacggatctagttacagttagaggcaggattagaacccaggcctaaatctcatggtgctttagtcaaaagaaatttgctgtggtagaagtaatcctgattttgaagcccttcttaattgggtcttttattctctgctaatgagtacttggtattagaaattttagcaaagcagaaagaaatactggcctcactcagtaatgcactaacgtgtatatagataggaaagttttagatactctgaggtagtttagttctgcttaatggtcatcatatcctaaggtttttcaaataaatataaatggtaatgtaaaataaaaatcgaaaatgtttgctctatttcctggattatagctaaattaacctctctctctctctctctctctctctctctctatatatatatatatacacacacacatatatatatgtatatatatatatgtgtatatatgtatatatttaaaactttctgtatggaaaatttcaaacatgtcataagtataatgaactgtcatgtttgcatcacctagcttcaacagttaacaactcacagccagccttgttttatctacatacccacatcacttccttccccattgttttgaagcaaaccccaggcataacaaccaaaaacatttctttgtatatctaaaaataaggacttctataaaatataagtaccgtatatttgtcacacaaatattaataatccatagttttacatatcagtcagtattcagatttggccaattgtgacacattactatttttaaagtttgcatatttgcagggtacaaataaagtccttattggaattgatcgatactgtattaaatctcttctaagctataagcctgtggtttttctatgcctgttttaaaagtcacatttaaaattaaattttaattctgctgagaaaatagtgtcaaaatagttattaagacccaagcaaggcatttctcaagtcttgtattctgtaggatgttagtaggtcgtaccaagagcaaggattctctggttaagcttgggaaaattaaagtggagttctttcttgatagaatttattagaaccttttatgtgccactctgtgtgaatctcccagaatgggggtgatactatgccaagttcctaaagttgtatgatcaggaactcttttttttttttcttttccttacaaaatatatttctatgaactcttagtggttttggaaatgtactttaggtggtgatctgcagtaacagttttcctaatgctctttttaattttattagctactgaagccaaatttaatctgataaaaacattttaaaagagggaccagttatctattttaaggctgtagttgatcttacaggtttaattattttatagttttaaagtttataaagtaaagcattgattggcaaataatctaaatttttcattttagagaataaagcttttttttttaaaaacaggatgaaacaagtgaagatgctaactgtcttgctttgagtggacatgataaaacagaagcaaaggtatactaatttagcctttagaatacatacacaattaagagtacagaagatgtaatagaaatgtctctaaaatattgtatttttgtgctataggttttagatttttttagtattgtttattactgttaattatgtaatgctgaacactgaagggaatattgtgatgagtgaaacacattctgtgcctttaaaggagcttataattaagtagacaagataagtcatgaatgtaattaattacattatcaaagaaaaagtaattgagggctgggggccacggggcaagaaaagtaagatgttatttctgactgcagaaatagcagtacatgtcttcattgaagaaagaagtagcatttgaagtggtcctcaaaggatacataggatttttgatagtccgggctgagatcatgatctgtctctttgggttgagaatttgttatgattatagaagcagtttttggcgtaaggttttggctagaacctggggtacatggggcttgaatgaggtgtagatggggtggaagaaatttttttttccccaaaatgtaaaagactcattttttttccctagaaattgaaatctattgaaggcttttaactttctttccttgtggaaaaattggaaattctcccccttctcccaaattatccagatttctatgatggatattttaacaaaactctcttaggttttgtgtgtgccctcataatgcccttgctttataattttgattcactttgtaaaccaagaaaaaagtatgtgtatcattatgtaatctacaaaattattaatggcttcatagaatgctgtcttaaggctatgattatttttatccaaccaatttcctatccatagcaattatttccatttaaaaaagaaagttgtgctttcctgctgtaatattggttacagctaaataccatatctgccattcattcatgtttatttacttagcataaattaatggaagaagaattattgaggaaaatagtatgctttatcttaaagtttggtatacatcaccaagttgtcctccaggaaggctgcatgtcttccattcctacttcttacatcttatttaccttttttaatttcataggagaaaacaatatttcgttttttttttttttggtatagtttcattgaaattgaagtttttatatttttcttttcttctttgtcctttttttggttttttttgagatggagtcttgctctgtcgcccaggctggagtgcagtgggacaatctcggctcactgcaacctctgcctcctaggttcaagcaattcttctgcctcagcctcccgagtagtggggattacaggcacccgccaccatgcctggctaattttgtatttttagtagagatggggtttcaccatgttggccaggctggtcttgaactcctgatgtcatgatctccccacctcggcctcccaaagtgctaggattacaggtgtgagccaccacgtctggcctatatttttattttcatttatttgtgtagatattattttcttttgtgtactgcttttaaaaagtttagagtgatggcatgacatactttaccctgtgttttctgatgagtagaatcagtgcactgattactagagaggggtgaagagaccataaggagggagaaatcttttttagacatattttctacttttaattaaaggtgtgaggttattttatttagtagtattgaataagtttttttttttttttttcctcccacaaagctaagaactgtccttgggtttatgctctgttattgtctgggcaacatttcatgatgtgcctatgtgtgtttttaattattgtttgcttaaaatgtcccaagttggagctggttggaaagtcatgagctagtttgacccatgccttataagatttaagtaggcaaatagaaatttattaatatctgaaatggtgaaataacctacaacatctactgactagatgtttttgtaatgtagtcacatctttctcttgatccctcctgtcttccagtttgtcttctttattagccaccaaacccagttatgttcttttattcttttttaagtctcttttcccccttccccatcctctttgtctcacaggaacaacttgatacagagacaagtacaactcaatcagaaactattcagacagcggcttctctgttggcctctcaggtactaagtgcaaaaagcaaggagaattttgtaaatgtccttaagattagtgtggtatattgaattaaagtgagagttcatagaagactattaaaattaatctttctgaaagtaattacttgctagcctataaacgtatttattgtagttttaaggcagggccctggatttgacggaaccgttctctgggactgtttcgatgttaacccatccccttatattaatatattatttgatactgcaaatcatttaaattctcactagtcatttacacagggttcatatgtaggttttatttgtaggtcaaaagtgaaattaaaactaggaatgaactaaaaaacattcttcgtggatttcttttgcaaaggctaatatatttttattttaaaaatgtatttctgccttatttttccactactgatttcagttagttatttaatatagcccatagctcttcagaattatgttttcatttgtcctagcaattctacttgtgacagaccctcacatacagaatacagtaggcatctggaatcttttttcattgatttgtgaaccttcattttgttgaataatttttttcttgaatcctttcacatgaatgaaccctaacatctagctcaaattctgacacaaagtagatatattctttaatagatgataaaactggttaatgtctacaaagtaactgagataacaactgctgctgtactgatatgatactatgtactatgatgatattttgctgctcctgtgcagctccgagttattttaacgtgatcatttaaacatgtgcttttgctagatgttaacttttattgactctaaagatatataaatattatgtttagtttctgaaataccttttccataatctaataaaactttagggggagtaactaacatcaggaagtatgcttaatattgatacgtggacaaacttgtttatcagtcttaaactgtcctgtgattgtgattgcatgttttttggtttgccacatactctcgggacttattttcatagttttgtcttactgaatttatccctatagtaattagtacccatgggtatttgccttttagatatttttatgagtgagtagaattttctttctaatgaaaggattcatagagccatagagagaaaaatcacccagttatgtaagaagaatgattatgttgatttaaaaaaaaattcattcctatctttggtaatgttaggggcgtacttatttctggggaggtgataatattgtggctatacctaataaagagttcttattgttttgagataaatctggaaatatttatagatgaaatgataagatctctaggatttgcttcagaataacacaaggtgaattgaaagtgggaggacagtggctttgatttgataattgatgaagctgggtaatgaatacatggggatgcattatacagtgctctctactttgtgtatgtttggaattttccataataaaacttttaaagatccatctctgtatttttttagtgttaaagaacgcttgtgatttaatctaattaatatgaaaataatctacctaaaatttaggatgattaaattattgcttagctgtatatatttgtttaatttacagtgtcagaaaataataaatttactgctgcttctgtatataaaatgagctttgagtattctcccacttgggggtgctccaatactagttaatattacagctattagtgttgtaataagtgaatacagtttagcagtaacttaagcattatatgataggtgattcttagaggaacaattttaaaaactatttgaaattacttaggagtttttaaaatattattaaaatatacctatttgaaaattcctttgttgaacacattatttgttgaacaaataatgtgataggcatatttacattccattttgacaacattatagagtttttaaatttgtaatacttttcttcttagaaggtttcttaggaagtaaagcaatggaaaatacatctcattgttaaattatggtgctttgaacaatgttgtgttctttgctttcattctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaaacagcac

SEQ ID NO: 37775 - DNA, 19472 bp, Homo sapiens
cagtcggctcggaattggacttgggaggcgcggtgaggagtcaggcttaaaacttgttggaggggagtaaccagcctgctcctctcgctctcctcctcgtctgcgccgcgtttcagaggttgcccatcagccttgtgatttatttttatatctgctttttataaagagagaaatatatatatatatatatatttttttttttcttcttaagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgaggtgagtgtggccggccgcggcttccacgagggggtcggccagtgggatcccagtcccgaggtgggcctccccgctttcatccgttttcccttaaaaaaaaaaaaaaagaaaaaaaaaagtctttctcggtccttactactttcccctgattagactgcggggaaagggaaagtgcgctggaagcttttagggttgggacgcgcctgcacatgggctggttagctcctgaaacttgttcgttcctgtgtgcataacctggggttgggagattcgggtcagcagatctgtgagagccgggtggggtgagtggggagtaggacaggggtttcggaaagggtccatgtgcttagtgtgtggtctgatgtgtgaaggttttctttcttaactggggagcggggaggggaagggtgttcaatgggtgtcgtgcgtttaaacgtaacctctttgccctctttccttcctcttttgcccattttgtctatccagaattacgttcctacagtgtttgagaattacacggccagttttgaaatcgacacacaaagaatagagttgagcctgtgggacacttcgggtaagagtgggaggaccgcgtggcgcttggggcgggtttccagtcgctgggggatgcgcggcgggtctcgggaaaccgcgcgctacaagccgtctgcgcccctcccaagggattcccacggtccctgttgggcgaaaattgtatcccttctgggtgggggcggcagacgacagcgtggacgaggagatagcagtggggagaggagagcgctgtgtgcccgcagggtgaccccgcggttggagccactagtggccaggcgcagtccgcccgcggagtcgtggtcaagtcgccttgggtcggccgaggtggcccgatactgtggggtgttgcatgggcgctgcgtgcgcctcggcggaaccacccggctcaaggcgggcgcccctcctagatctaacctgctggttggcggggaggcggggagcgccgcgggggtgatgggaggcgggagaaaatcccagaggcgacgcggttacgtgcaattgccgctgttgagggaaagaaactgagcgcaggcagccgcggcgcccgtgacgcctacacccaggaatgcgctggtggcgcaggggccgggcagcagctgaacctcctcttcgcgctgccggccgcccgcggtgcctcggtgcccacctgtaccgagcttttccctttttcccccactccatcccagtgatcacgtccgtttccccttcaccacaccagcccctcctgacctctattgcatcccccactcggcttgcctccaaggccgcgggcaacactattcgcctttgaccttccagtctacttgaattattggcgccgcggtgggttatattcatgggtctgaggttcaaggccgggttattgctttcccatgcgcccacccacctacctggcgcgcggtggtagggagggctaggtaccctcccggtgggaaggcatccggccccccggctgagttaggggtttaggccaggtcaaaggccggggagtggcaggggggcaccatctgaggtcttgggctgggacataggcacccgccgccctaaccagcggtgtctagcgagtttgtttccaagaagggtgtcggctatggaaaagcaggacccactgggaaggctgggtaaaggcccctgcgcttagggctgggaatttagcaaggagctgggttgctggcggaccgagccaaatccgggtgaaactggcgaggaggaacgcgcaagtgccaacaagcaggtttgctgttaggcggggaggccccgaggtggagccgcgcccagcggggagtggcctcgtggaggtgtttctgtgagcttcccacagaaccgctgggcttgaaccgctggagcccccgagggacgcgggggttcagagagcaagaggaaggaaccagactgacagggtcgccagaggcagtcccagcacaaaggcaagcgagaagtctcgcacgagcgagcgcctctcatggtcggtgccagatgctccgactgctgcagtgagaagggctgattttgtttccccctggagtcaggctctttctcagccgttccaagggcagcagaatcaggactttgccgccgtgttttctgttggggatggtacacagactcgaaactctggagaaggtgttggtagacagaattcaagtggttccttatttcagtagttcctatcagaattattttacagcctggtacttaatgggctctgattcccagacatatcatggtatgtatttgttatgcctactggatggcacagctggtgtggtaccgataataagcaccagtactccctgccccaaccggcagccctgtttggacctaatgcacgataaaaattattttggcacggggtggagcagtgtgtctgaaccagtcgttgatacaaagctgtgtttagatcttagctcctggttaccatggatttctgtgtgcaaatcccctatctccctgggtctcattttcatcatctgtaaaaagaggacactgagctagatgatgtgcaggatctctcccagctgtacacttcttggctttattacgctggacaggcaggtctttttgtttcccaggatgttggttggcttcagctcttagtcttaggggatctggcatcccgtgctggggttttcacagcctgcaaagcaagccaggttctgggcagagccaggcttcctggtggatttaggaatgaaacccatctggacagggagggggaatgggtgggcttataggaatgctgggctatacatttcctatctcaagcttcaagagtgacaggaccaccaatggatatttcggaatagatgcctaaagggctaaattgattcttttaggggagaaaaggcacattgtttgataaaggctagaacataaaccaaaatgtgggcagtttgtagttggaggctgtccttcgtatgtgcaggtaaataccacttcaggtatcttcatgcatttaatcaaaactctgcagttcgtagactctgcacacatagcacaatgccttgcatacagcagttatccaataaaatctgatgaatgagtaaatgagtaatgatatgcatagttgccaaggagatgaggttccctgacatttattcacactgaattacctgtgcacaaagaatggcaactttataaacattgcctttcatcgaattaaagataatcatctgaaatgaatttgtagtgaaataatcacttgtctttttatttaatgaaaccaaaacttatgtatgtttaactaaaatataaaggtttgaaaatgtgatgaagaaaattttgtactgcaaaattatccggtaatgaaatcttagttagaatttagatttaaacaaatggaaaaaagaggcataagggaattatttagaattccattatgttgttcatgaggtgaaatgttagttagttaaacacagtcaccaagcactgcttacttaaattctaagaatagcctgtttccatcaaaagtgatttgttgtttatatctagcaggaaccattgaatcagcaactaattatttcaaggatctttaacatttttccatttaattccaagcttttcatggcaaatttctggacaggactattttttggtaaatgtttgacattttctttgcccactaaaacatttatttagttcagattgtaaaaataattgcatatgccttatgcctcttgatacatttattttttccaaaggccatcaatataactctggagaaaagatcccagccaagtctgtaaagttctaaatgtcagataaattgcactttttatttccctcctagaactttgtgaaagagacttatataggaaaaattgggtgtgcctgactgctcttatatagggagagatacgggatgaacattgtcctttgaatgatatttcctgtcctgtttaccctcctagcagaagggcaaccatttagaagacagaaacagttcctctcttatctggcctctttagttggacagcttctcataaggggtctacttttgcccccagcagtcatgatcatgcataggcaaactctgccaatttggatgtgagaaagactaccaagtgaaagtaggatatgtgaagtctctttgcaccaagaaaaaaaaataatttcctgctttttaaggcacagtaacttaatatttccttcctttctccctttctccatccatctcttccttttttcccgcatccactataaacaggccctctgtcaagaccttagagatacagtgttaattaagcatggtcctgctcctaagaagcagacagttcaggtggggtaatggagaaaaagaagctcttctggtttagcgtgtatttcattaacaactcatgatgcacctaattttgtcaggtccttgaaccccagtgcccttttccacttggttgcaatgtttttcctttgtcagacatcctagggcttatagatcctctggatcctcttcagataggaaacagctacccccgcaccgccccccccacccccgcccattgcacacaccagttaaagcaactacaaaaggcattttgccagtcaattcttagggctacagtactccagcccccccaacaaaagtaaacaaaacctttgtaaaaatgctgtaggaatcatctaaaagagggaatttttaaggcccataacttcttcattttcctaaaaaatatttttcattataaaatgaacattcttaatagttgcagaaatgctcccattgattttcaaatttcacccaatgagtttctgccaaacaatgggtaatagtttcaattgtgaagtaataagtaagaccaaagtaattctaatatcttgtgcttcaaaattggccacatttgccaagcatagaagtaatttgtagcatgaagccaaatgcctactaataatagaaatgtagtcatttaaggatcactgtatcttttcctaagagatttgattgcagtgtaatttcagcacatgtgatttagggagtaataatcattcattccagctttttaaccaaggcaagttaatgcacattttatttaaggcttattattacttttaacatattcaattcagctgctaaattccccacaataactatgctattgcctcatgaacactctttcgaatcttgtcatgatccaagtttcttttaagccctgagtgctaaagttagtacttcctattttagtttttagcattactaacacttaaggtggtatcctttatttcttagagaaaaagagaggaaaaatatcttagttacctaatggccttaatatgaggacaaacttctctataaacagaagtctatctaagctgttatatttagattattgtacatcaagtatgaagaatggtcttggtgacaagctctctaatgaaatatttcttaacagggatggaaatggttcagcagtattggagattagtatataattaatccagaaaagcagcttaaaaggggatcactgctctctctctccccctcccctttttttttggtgatttagcatataaatgaacacatctagacaagacataaaaatgattataaaaccagtaaacatggtttagtgctttctgtgtgcatacaatctgctagatgctatgggaggagtacagagctgggtgagagcagcttctgcccttaggtactcacagtttcaccatgtgataagacagacatggtgaaaacatgagtgacaataaaatttaaaatattcaggctttcccaaactaacaaaagaaatcaaatgagaagcccggattaagtgtcaggtgtttaggtgagaggagatgccagtagactgagatttgaacagggtaaagacatccttcttccctgacaaccttctttgaatacccacaggacaaacagaggacatagaaagacttcctcctgtctagtgctgtaatacctgtttataggatggtgagcccggaggttctaaacctggatttttcaaggagcaacaagatccaaagagttcttgaaggccacaagggcagcccaggctccctaactcatgacttaatggtcattgaggcccaccacaattcccttcctttctagaagttgactaagttctaagaagtttttaacgtttcttccacgtggaaactcgcttacatttagtggctctcagataaaacaagattctggaagctgagaattataacttaaattaacgttcttggagaaaggaagaggttaagaatttatgaaggagccagagaagcatggatgcttgggatttgaatatcaactgtgaaattgcaggaaaccaagcatttcatcaggtagtaatgatccattggagcttagggtttcaaaactaggtttaattcttaacgagttttcacactgaaactcttatgtaaaagacctgggttaaggtaaaacagatagtttgtatggtggtttccaataagcagtacataaaactgcatttggagatttgtccaccatgcagtaatttccatttaaaccaaggaacctcctaaaaaggggagggggcagtatgaatgctctttctaagtctacatctgtctgtagattttttttttttagccgcatttagtgctgttttttttccaatctggtttcttgctaagttgcacatttcaatgaagcatccaaattggtcattctgataacacccgaaataaccagatgtttcctcattaatccagttcttttgcatgtaaatatgacaccaagaaccaatactttctccagttagctcatggtgcctggcgggctctgccaaatgaattagtcgtggctcagtcattttctgatgtcctttaaatgacttctcagttgctacatattggtcactttctcagagtctcccttggcaaagcaaacattttattgacacggaatgtagttgacgcagaagtttgaccaggtgttgtgcacattggttttgaaaaatgagcctgatgacatagtttgtggaaagatgaattcactcatgggattctactccaagaaatctgattcttagatatcatatgaaacaaaaacttgaatccattatccctatttacttttaggcatattcatatacatatactcttttccctaaagctcttgacttaaccatggttccactgtcagtaaaatattttgattcttacatatttttaagtacctcaataagattaggagtttaaagctaaactttatttaaaggccaaacatatctacctgtctgactttctaattttgtatctacattgcccccagaaatagaaaatctttattccattttaatagcaacacataaatgcccacaaaattttataagatctgttcatagttcctattacctgaatccatggaagaaacaaacatattcttcctgggagtgtttgttgcatatttgcaggcatggtatttgttgtgcagactacttgaaacaagaactaaacagtcttacactgagtcagatacaaaagttctgcccagacttgattcacattcttgagattgctgctaatttaaaccttttcctctgattagagatggcatgaggaaatgcaatcttgtaataattgggcagatcatgccctctcacatgttagctgctgctgcgttcagatgtgctcatggtggtcactaaatataccaaaagttaatctacttttctctgccaaaaatatgcaatagctttagcttactcttcttggtaaaaatttcttaagggggaaagggaagcttttcagatgaaggttcaagttaaataaattatatttatgaaatattcaacaagaagagttttcagttctccaactcctctaaagcctcacagtgtttaaactggtactttgcaaaaggttccataaagccttccttttgggcatgaatcttcttacatatacatttaattatgtacatatatggtgtgttctatatttgcgaaagggtgacttcagcaggcaggtatgtgtctgaagaattagtttctgggtgaggcacgttgtgactattctttggctggaaattttgctctcacccagaattaatgatcttgaatacaaagatgggtagatctgaaatttcaaaagctctctagaactttgctgatgtttgccaaacttgagcaactcagagaaccccaagtgtacacttgttccaatctacccccagcaaagcctttcaactatattttctgggtgagcggggtacacattttgcatatatagtgtagttgtttctttacaatatagagtttccctaagtttttccttcagaggtgtggcaggttacttaaaaaggaccttggaatagggttgcgagcttaaaagtttcatatagtaccagagaaatgctgcatctgagaatttccatatgcatgaagcctattccacatgctgaaaaagagtttcatttgacaagccaaacgcagtccctaaatgttattggactttagtgcattcttaggtactagagcacatactctgtgtatatcaatacctaccatgtactgcagttaaagttgaatactttcatacttagtaaaaattgttgagccctcctgcttgtgctgtgtttagttctacagttagcaccttgggagtttttcatgtgcatcttttaaaaacacctatagaagttaattttttttttttttttttgccgtttggcttcacagggtgttgtaagacttttctggagggatataggagttaggggcaggtattgttcctgctttacccacttactttcagctccttcctttggtgtcatttctgcccctctttattgcttctcacttcacagagtcatttctggaattcctcttcctttttttttggcatgcgttgtctcacgcatacctgtgattccaccgtgccctctccagctttgcttgccttacttcctttgtgcagtctcttgggctttatggggaagaaaaggaaggattccaagtgcttaaacacagagtaaacactgtaaagttacacaggaggtgtttttgtgtgtgagtgtttttgttttttgttttgctttgtttttttttttatcctgaaagtcctgctgagctgatgacttacatctttcctggtgggacagttcttgataattctatatcaatatttttcactgtgaataaatagagacaatagatatttctatctaagacaagataaacttaacctatcaaaaatatagtgaataaatggtcttgttattttaaataaattactcttgtcattggcagtcaaattatgcttataactaagaaatatgggaatcagttttactattacctttggacactcgtgttgatctaaaagcagcactgttcattagcaaaagtaatagaatgggatcaaagtgtcatccctaattagatcatgttaaacctcttaaaaattacctgtctacctccacaagcacggtggtttatttctcataaacctttgcactacatatgtattttcacttatactgttaaccggataaaaacaaaagcagatacaaacttccctgaaaatctggtttaactggagaactccgtttcattttaaaatcaggccagagtctaaattttgcagatatttagatatatgcactaagcacagaagccagcccacttgattttagtaggtagcagtctccagcaggtgactcagggctgagcacaaagccagatctcctttgtggccataaaatgggtgggggacgggaaacatagtccacaaaggggggaggggtattcccagcagtcatgtggtggcctgaatgttgaaaccattcctcaggattttcctggcagtctcaattttaattaaactcttttatcctctttgtatttcttcaatcgcttttcctaatttttttatttggaaaagatggtctccattgtcatagagcagtattacatctggaattagcagtgagtactctaacatcatacaaatcgtatcctgaaaggagctggtaggcacctggaacagttctctaaagataccaggtctgcttgtactggaagctctccacagggagagagtggtttttcctaatgtgagtgatttctgggaaaggagatctctgaagcctcgttaggtttctgacaatcctaactgttggcagctttgccttcctgggtctgggatcaggttgtctctcgcggactttgaggagtagaggaaactctcatttatatgtccagtatttggagctccactctatgatctagaattttctgactgcctgtttggaaagagtcattcaaatgtttacagcaggtgccgtgctagagttagactttggacacagaaacaggaaaggttctagttgagaaagtgtgaacttcttagaactaatatggaaatactaatgtagccataaatagtgttcaaccatctcgtttctgatgcctttcgaatgttcaaatgggtgaactatttgtgaattattctcttcacctcagagtactttcagcgactgaaaaggcagccacagcttgtcattttcagagacggcctcattctaatataccttcatacttaaaatgacttgactttttaaactctaaacgctttaagcttctgggaaatatctttcagctgtcagcctctgctctaccagggtcctggttccagatgtgggtaggcagctgctgcagctcatgaacagctctgacttaattctctatttattcacacttttcttcctgattcttgtaacattcttttcttccttgcttagcagacacacgtggcttgaagttgtcactctccatcgtaaaggagctagagaaaaagctgcactgttgcctggggttccatagcagatgccagggacccagagtgtactgtgtgaatagagggcgatgccccctgactatagtgccttttagatcacaagaacagcctccaagcaaatgttgttttgatagaaatataaacagtgacattttttctaaagctgctttttaagtctctcttcctgactttgcctattgaggttttgatttatcaagggacaacatgtcctgtttttctgctcaaaatggaaagtgatgtcaaaatgaaatagacttttaaaaagagtttggtggtttagattttctttttctactctggagtcagatacatacgtgtgtatatatttgcctagtaaaatcattttcatgtgatgcttgtgaaatgtcagcatacggaaaatgatttcttaaacaagcggcatttggcaggctgtatttagttttctagtcaatcatttcataactataggcctcatgtaattgcccatcctttggaattcttaaagaaatagaagaaacttccttgattgactagagagttctgtggttaaattaattggctggtgccttgaacctttagggtaccctggacttaattcaggttaagatccttagatcatgcctcagtgtcactctcagagatgggactctgtaaaaaagcgacatgatcctatacgacatttattacattcttgattgtaacaggaagaaaatctatatagggtttggcgataagttaaaataagcaagctcaaaggtcaatggcctatgtaaacttacatcttggagatgggtaacactgatgtggtttctctttgcatagttgaacccttcctcttcctctctccctcattcacccctatcctgctgtcagaattgatcttgagttttggtctctttcccaagaagtagttcagtttatggttcttgctaccactcagcttttaacagcagtaatacaaccataatgcccatagttaatacgtattgatcccttactaaaagccaggccctgcctgggtttacttaatctcaggtatgtatgttgtcagcatcttcattttatgagtgaagaatcagaggcacagggtcctaaagctaccttgccccctccctttttagtggtggaggcaggtttacacacaagaccacctggccccaggtgcttccctacttcacccaggtaacttcaggccctagtctttgaaccatacagatttcacttaagatcctggccctcttcttgaatttatgtcagacacatgtgaggcttcattcatcatatatttctaagcaggcttttgtgtgtctgtttgaattcttttccaagaattaggggaagtgggagttgggtcgtgatgtgacagtcaaaggacttagccggaaagggtagagttaatgcatgacagacaaggggactctcatctgaaaatttgtgtgtctttgtttcttctcaggttctccttactatgacaatgtccgccccctctcttaccctgattcggatgctgtgctgatttgctttgacatcagtagaccagagaccctggacagtgtcctcaaaaaggcaagtgctgggaaatgatgacacacttcagtactgggtgatgtataaatagaaacgtggggtttgttgggaagctcaaagactctaatcaattccctgccttacaatttgtaattaaacactagaaagaaccctttcacaccaaaatggggtttccactttttgatgatgaacttgcttgaaattttatttcatgaagctctgaaacaaaataccttttaagggccttcatgtttgtcctttgggagaaaaatggtacagctaacaacagttatatttgattactatcatattcatgtgttccttccttctttcagtgactcaacagattgcatcttagtttacagatttacatttgacctcaagtcagatagtgaaaggaatgcaataatggctattttaacaaagaagctgtgttttagttatggtgttattagaaacagaaatggaactagtgtaggaggaatagggatgtgtccaatgtgaattgtctgatgatcaggtatctgtctagtaattatgaccaggtatctttctagtaatatggaagcagtgcttgtaaacatgttatatattataatgtacacatagtttatggaggcaaaggtaagtcaggttccgtaggaacctaactaaggaagctatggttggaaggaaccagggggagatcaagaggaagaggacctattacaggatgggtcacaggaactagggaggccagtgggaggaaggggcgtttcttgaccttcagcagttgagactcagcctccaggtagttgtagaaggcacatgccgtgttagtccatggatcagcatttattagccactagctattttctcagccctggcctgtgtgctgtggggtttcagaatcagatccttgttggagcactccctctcctccacacactggcttcaacaccggatgtggctgagagcaaggcagtgtcaactgaggggtgacccatgcagcccagtctgagtatggtatggattgagaaagacaaacatgcaggtgtggctaggttggttttgtttttttcattttaatttttagtggaatttatttgtattttgtgtgtttttattagtttacattcccctattatatttgattgcttggcttgtgtgtcattgtgaaatcaggatttgaagtataataatccttctgtctctactaaatattacaaacagagttcaataaaactcttagtagatctctttcttaatagatcaaagactcttttttcctttttagctcctttcaattttgagtaatacatatctaacacaaataatgctaatgcttgtcaaatccaggcaggaatacacctttcctgtctttaatgcttgtaaacaattgctagacatgcagagggaggccaaagtcattacacagctgaagagcaacataacaacatgtctagttctgtctggagataaaaggggttgcttatttactagagattttacttgatgtagtatcaggctatgcataatttatgatgaaaagcctttctcctgttttattttgcttttgtcttctaagaccaaatgaatagtgactttgggcttatagatattaatgagtatgttttacattcctgtgaggtttaaggctcatgataacccctgcggtttgtcttgattaatggaaccctttaagtccttcactatcaaagaggaggttagaatgacttgaagtagggaggatttcttttttttttttttccagttcaccttccacttctaatgccagtgccacctagcatgtggtaggtgttcctacataattctgaaaggagtgagggagagagggagagaggaagggagggaggaaagaaggaaagaaggaaggaaggaagggagggagggagggaggaagggaggaataagtggacaaaatgggctcttatggaaagtatattactcctttgaatcctctggtgtagtttgcactagagttcgttacccaaagtacacccctagatttggagatgtctcctctagtgatcttttaagttattcttgcaggatgtccctcttatctagtgttatacttaatacatgacttcatcacccccagtattctgtgaatttccttccagaagacacagctatgtcttagtcatcattgtcactgccacagtacttagtagaacacttacatatttgtgaatgtgggtgggaagagtcaggcgccacttccccatctcagcctctctaggccctgccctcaaaggccaaagatctcctgtgaccgccctgaactcttgactcccatgctgttgcagagctcaagcttgaggaaatgaagccacaaaaagctgcttgcttgttcttaaagaggacagttggaattccaagccaggcattgctgaaggttctaataattcttgttagatcatgaaacaactagacaaattggaatagattgaaatagttttaaactaacttgaaggcatatgagctacaggaccagctgccttcccgatgacccaagagatgttcctttgcaaatgtcatggtctgtgttgatgcaaccatgtgaacagaaactccttcaaggcaggatgttctgttttattaactatctcaggtacttaaaatagagcctcagctcgtggtggcatgcttcagtgtttcatgatgggatcagggaatgcatacttgtgctagtgttgcctctgccttatccccagccttctagtgaaggaggatcagatccacacatcgaaggatgtggtcacttgttaggatatataattattcttaagacacatttatctttaagagacacaccaataattaagacattattgaagctacctttggacaacatctaccaagtctctttcagtagcaacagatgagtcacagagagggagaatcaatcataatatacataattattctctaatgcttaaaaagtagtaaaacttcacatctgttcaggagataaatgcaaagtttgcttcttcatctcaagggacactccatttttaacatcttttctgagtttcattctaatgtcagccagtggagaaatggttttcatgatatggataccgttactttgttcatttttaatcttttttttttttctttcatagtggaaaggtgaaatccaggaattttgtccaaataccaaaatgctcttggtcggctgcaagtctgatctgcggacagatgttagtacattagtagagctctccaatcacaggcagacgccagtgtcctatgaccaggtatgtatgttgcccatgtgcaaaactggattttagaaagagtgaaagaaatggactatcactcataataaataaaataaaaagtagctgcttttctaaaggctcacccagtggtcagttgtgaaatttaaaatgctgtcatttattagtgtaattacatgatattcgggtacataaacagttgatatgctaaccttgtatatttctgcacctcccagtaggtttaaagttaaataggtttaagagagaatgtggtcaaaatcagtaatactctttaagaggggtaatctgattttacagtcggcagtacaataataaggctgttgccagtaaagtggaacactccataacaccatctttcagagagtcttcatttctgtaagcatttcccccaagtatttagaaatgagaatcagtttcaaaagctcattctcataaaacctacaaccagattctaaagagagttcatgttgaaataccaaaattttattaagaatcatcattttaaataccgcagtcttcttagtcttccatttctcattagcaaaaaatttggtattttaaataagtagttttggttaatgtgcacatgcttattgttgtgtacgttggtggtatggttcacacttagaaattacatatgttgtgtttcataaagtaacagatgttacaatagtattattcctttcctcaacgcatttcggccctaagtaagacacaatcacatacatttcaaaatcgattttaaatttcattcattgcccctgtttttggtacaacctagtcactagtcttgaatgccatttaccctcaagaaaagagaaatgaagtgcaccatgaggcgctggaacaggttctcaaggccacatcgccacggccagagctgtgtggaaaatgcagagtttatgttcatgaccttcagctaacttacttcactagtaagcttctctgcgccattccatgcttgctgtgaccctggaaaacctgaataaccagttaactcttgcttgcagttgatagtgaagatgaatcacttcgttagctccactctacacttctttgaatcacctcatgttaagtgtttgataaccagggtcttcctttgttaagatcagcctttagcatttattcagagctctaacacctctaatgagccatgagagttgggcatcttagggatgggctctggactgcaaatagttatgaagtaataaataaggcagtttacattttaacaactttttttttttgcaatgacacttggaaaattcagttaacatatcagcaaacgttttgcaatgtgttattattttgtggtattagaagatgctagctaactttcccccaaagtcttattgctggttaaaatcccttcttttgcttctcagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatactttttttttcttcaaataaaaaagtaaccatgtctttgtctaaa

SEQ ID NO: 37776 - DNA, 30541 bp, Homo sapiens
ccgtccgctaagtgcctgggctctcccgctcgcgtcccagtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcaaggcgctgcggcgcgaggcgctcgggttggagcagctgcgcgcgcggctggaggacgcgctgctgcggatgcgcgaggagtacgggatacaggccgaggagcggcaggtccgtgcgcggggatggcgcgctgaccccatacccgctgccgtcgccccagcaccctgcccttgacggcgtggggcagcggccccttcaccaggggcgcggcgtcgcggaccggtagggcccgcccagagggtgcccgaatggcatggggacccggactcggtccgctggtccatcgactcagcgggcgagcgcggggcggcaggtcctagcggatagccccgtcctcgtcatggggttaggtggcagctgctttaactcttgacaagcgtgactgggcgcatcctgataggccaccctgttagctctaggttttccttccattttccgtgctccgtagactcagtagacccagatctaagagtcaaccgagaaacctctctcacttgcagaagtgacggcttatggtagccccgctgtctatagcgctcctcaggggaaaactcaaattaatttccaaaacggtttttattttgccaatatgatttcccagttggaagccgcagttgtggctctctgggcggctgccttgtttgatcttgggaggggcagcaaccctcatgcagaacagagcttgatcgaagatgttttgctcacagcacacgctgacgtcagatctctgcgtagtgtaaaagttgtgggaaagtggggccctttggcaggatgttattacaagtgcagagtgatataaacagttactatttcagggaagcaaaccctctgacaccggcggggtgacacctgtggctgatgtaaactatgcccagtccagccctagcgtttggccctcgccctgccctgcctcagccagaattggaaatattcccaaatcacactatcagtagttctcaaaaggacagatggaaataacatctgcacaatttcacaaatattttaagagtacagtttgcagctgtgagttaaagatttgagactgacttttaaaaattagaagtgagaggaacatgggggttgtcatatggaatgactgcggtgatgtgacaggtatccacaggtgatgagtaaatacctgttgattctccctgggtccccagcactgccctagactttcagtatgcaaagagctacaggctagatgggaaatcatagaatgcaatatggtactacattgggatttaatcttttgagttgtgggttttgtttggcttccgcctcataacttttcaaagtgttctcttggggctttgccatagctagagcagggacagggactgacccagtgtgtaccgatttccacttgtgagcacttgtgtccctttgcaatgacagtggccaggggtctgagttccacaggtcctatactcgttgttgagtgaaagttaaaaagtgccttaatgtggcattcatggagatttgaccagtggttattttgactctccaaaaaggagtatctgtcaaacctactgcccagggaacccctttgtagggaaccctcgctaccaactcaggggtctgtgctgtgcaggcaggtttagaaaatgctgctttgagccacgctgtgtggaccaaatcgtcaccatgcgttcacagccacagctcacttggcacatttcagaccttcaaattctggttccagtgttctttcttagcggcaaagcccttttccccactaatgaaaccttcagtggaactcgtaatgtgagccatatgaaagcagagttcccctgactggaggagacatggggacttgaagtgcagttagaatcctgtgcagccctcctttgacacagggactccagggcccaccggggaagtgcttttcctgaggtcatacctgccctcagagtgaggctgggaccccactctccgtttgccatccagtgatacttctctcttgttggaatttgctgctttttcctaaaagcaaagagcgaggaaaatgtcaataaggacctggtttttttttttgttttttgttttgttttttttttggttttggttttggttttggttttggttttttgagacggagtcttgctctgtcgcccaggctggagtgcagtggctgatctcggcacaccgcaacatccgcttcctgggctcaagtgattctcgtgcctcagcctcccgagtagctgggagtacaggatcccaccaccccgcctggctaatttttgtatttttagtagatacagggtttcaccatgttggccagcctggtctcaaactcctgacctcaagtgatccaccggccgtggcctcccacagtgctgaaattacaggtgtgagccatgtgcccggccattttttttttccagttccaatttgcagaggttttactgcactaagtgttaccagtcactaccttgtccatatactgaatcttccctcagttaacttaagtcaactccatttcaaattgcattccagaagattcagcaccaatcacagagatgctaggaagtttgtgaaagagggagtatggatgatttaaccccaagcctgtaatttttttcgggttctgtagaagcttactatggggagagtgaaaaaatcctaaaaatgggttgaattagtatatggtaataaatatcttattactaagagcctttagcaagtgcttcgtgtgtgccaggtaccacagatgcccttcacaaatattcactctcagtgcccacaccagtgttacgaagtgggtactaatataagctccattttacagaggaggaagctgaggcacataagtcacctgattagtaagtagttaagccaggattcaactcaggctctagtgcctgagcaactgaccgctgggcgtccgtttctctcttctgtctgtttgatcagagagaaacctttaaccagtattcttgcattcatagcataatgataattgctcttcctaagggctagcccgaggtactctgctgatttcaagtcctaaaatgcttttagacccctccagctggctgaatagttttggcattaaaactattttctttcatttctttttttctgtgttccatgtgctttaatgcccccctcccctggaggcaggagctggaggcagcagagggtgctgccacattgtgcccagctctccctgcctctggctatagcttctgtggctcaagggggaagatgcttgctaggattctacttgaggggaaactggtccttcccagatggcccatgcgccttcactgtatgaggcggtagtcattggcctgccccaggcctggcctcagatttgcccgagaagagtttgctgaactgacatccaagttcccaaatgtgatctagatcacttgaagcctgagtgacacacccaggctgcaggagggggcttcagaaaacacttgaagacatttgcgataaagtggagaccagcttcaccctgcaaacacggagatttttgcttatgaaagtgagcccttagctgctgaggctgactggaaaaggcttccaagcccccaaaacatgattgaatgaaagctttttgtagatgggaaggtggggtgggattaggatgggattagctaagggtcagtgctctgcagctgtcctacctggccctgaattctgactctgccgctctttgggcaggttacgttccttaacctgtctgcaattcagtttccccatttgtgaaacgaggtactggaagtagctcccagggtgtgtacaactggttcattcgttcagctaacagccgttgagcatttagtgtgccaagctcagttcttcatggttgcagattcagcagtgaaaaatgccacgtaaaacaaagaaagtcccttgacctgagaggccttcaggtggaaacagcgtgtggtttttcggggatgcctcagccaggctgccggtgtggctagggcacagtgaacagggggtagagtggccactgcaggacttgggcatttactttgagtgccatgggaagccactggaggttctgagccgaggagagttggggcctggctgtggcttagtggaatcactgttgctgctgttttaaaaatagactgagtggactcagggatgccttcagagattgttgcagtaacccaggcaggaagtgctcgaggcttggaccaggggtctcagaggggcccctgcgttcaagttgaagccaacggcatttgctgccagattgaatgtgatgggagagggagaaatcacagtggacttcaggcgttgtggcctgagcaactggaagaagggactttccttgttttacgtggcatttttcactgctgaatccgcagccatgaagaactgcgcttggcacactaaatgctcaacggctggtagttgaacgaatgaaccaattgtatacaccctgggagctacttccggtacctcttatacgctttactgcggggcattggttaggaggacgggcctgggtgggagattcaagttccatgtacgtgtgttcagtttgagatgcttcttacacacccacctggaattgtaaaatataacttgagttcagggtgctgtctgggctaagctataaatacttcgtcggcatccagttcgtgcttattgttatgaatacatttaatttttgtgtgtagctgaagttatcacagtatttaaatcccctggagctctacctttcaaggttgcaaatgacagtgatatttgtgaactgtcccacaggcttgctcagtgagcggtagctcaagtttggctaagagaaaattaattcttttgatactgacagcagcatgcctttcctggtgtggagcaagatttcatcatcggttgtgatgctgcccaaaagttctctaaatagcaaaaaggtgacctctctcccaagcttttgcagcattaggtgaaactgcctctgctcgggtgagatgtagcgtcccgtgtctggggctccagtgcctctgtcctgacccacagcttgctgactggccaagcagagcccaagtctgaagttttattccacagcaggatttgttgtgatttctgcagagaccactgggagccagttaagtcttatattcctgcttccaaacgtcaactaattttcctttgacaatttaggaggagctgactcacatggaaatgtgactgaaactgtacttattccaacttcaacacagtttgattttcctctttgtattttgtgggtgcagaactattctgtgtgctctgggaggagtatcttcctgcacaccccttccacgtgactaggctttcttgacctgctcaggaggtttgtggttggagagctttcatcgtattttttttctaagcagtttaacaacatttgaacttctttgtaaggaataaattactataaatttttaatttgtaatagttatgtcaaatttcctgtagtaggaaggacacacatacatacatacatgcatacctacagcccatcttgtatgagaaccttgtacctgaattgtattccctctaaaacaggggaatgtaggattttgacattgagatttaactctagaatgtgtgaatattgtggctaaattgtggcagtgctgtcacttacatcaagactggcagttgctctttggtgagcttctctgtttgtaatgccagctgtgggatctgttatcgtttttccaccctgggacataagccagtgatttttaagtttacttctttgctttaaaagctaaggggttttaaactacttcaggaccctttatattcagggaacctaacagccatcattggcatagaaatagaactgttatgagaagtgggaatatttattggctgatcatgcattttaaaaaatgataaattctggctgggtgcagtggcttgtgcctataatcccagcactttgcaaggctgaggcgggaggatcacctgaggtcaggagttcaagaccatcctggccaacgtggtgaaaccccgtctctactaacaatacaaaaatcagttgggcgtgatggcaggcgcctgtatacagtcccagctacttgggaggctgaagctggagaatcacttgaacctgggaggtggaggctgcagtgagccgagattgtgccattgcactccagcctcggtgacagagcgagactgtctccaaaaacaaacaaaacaaccaaaaagataaattccatgtgcaatcttgtagagttcattccttggtttcacagacatatttattatggaccctcagcatcttgccgggtgcctttggtgaagggattccagcagcaatgaacataatattccctctcccagtagtcttaccgtttttgaattctacaaagataaatgtttataggtctagcttagtttagttaatgatgttcagaaataatgctacttcccattacaaaccagaagttaaaagtacatggacttatttcaatgtttaaatacttgcttggttaattgttccccagagtaactaacaactaggaataaaacaaaactggaaatcggtgcagctgaagcccatatgtttgtttgagaagatactgtcgacttcaaatagtacattttgaggagggtgatatgatcttgatcatttcattttaaatttaattgagcagctatgtgctgtgtgacttgtatgtggtgggcactggtctaggtctgggattcagaaggccgcagtatctccctgccaggtagagaggcaggtcggggacccggccaggggtgaggggagctgcgaggagcacccaggacgcccttactagctgcactgtgcaattacggttcataaagcagttttatttatttttattttattttttgaggtggagtctcgctctgtcgctcaggctggagtgcagtggcatgatcttggctcactgcaacctccgcctactgagttcaagtgattcctgttcctcagcctcctgagtagctgggattacaggtctgcgccaccatgcccagctattttttgtattttcagtagagacagggttttgccatattggccaggctggtctcgaactcccgacctcaagtgatccgcccgcttcggcctcccaaagtgttgggattataggtgtgagccaccacgctaggcccaaaaagaagttttatatctgagtctgtagtttgtcatttatgcccagaatgcatttctccccagatgatcttaaagtagcttttctaagtgaaacaaaactctgtatcagtttacctgcttattgttggagaaatcatgactttggggagtacatttcagttcaattctgagtgacttatgttttgaatattgtaaaacccctgatttctagtcttggcttattttccatagcgtcttagtgactggtttgaagcactggctctcctaagcagcctgatgtctaaacggtagagatgatttgaataaactcctaagcattcattattaatagagagtctgaacagagaagccagtgtcctatcaaaatgttccacatgcaataaaaaacttccatatggaagagatacaacattggaaaccatcctgcaagtgactgcatgtttaataacgccgggtgtttttctggtctgctaataaccctggtctgtttttcaattcgatcctgaattgttggtaccttcagttcgacccagtaaagctccagttctctgatataaaagtctgtctattctctttagagagtgattgactgcctggaggatgagaaggcaaccctcaccttggccatggctgactggctgcgggactatcaggacctcctgcaggtgaagaccggcctcagtctggaggtggcgacctaccggtaaggagactgtgctgagttggccttgacgaagccatgggggtgtaacttgcacatgaaggaaactggtctagggaccgtagcctttgtggagtcactgtggctttgtgacaagcagagagcagcccttggcatggccaggcaaggagtccgaggccaaaaggaagaggaagagtagggcttgcttaggtcactgagcaggtgtctccagcaagggagtagctgagccgtgcccccttacctagtgtttgtatgttctggggactgctgaagagcttcacacatgtcaacgtgttggatcctaggaactggagactgtgtttacagatgaacagactttgctcagagaagttacagaactggaaagtggagggccaggatgtgttagtgtgttttcacaccgctataaagatcctacctgagcctgggtaatttacaaaggaaagaggtttaattgactcacagttattccgcagggctggggaggcctcaggaaacttacaatcgtggcggaaggcaaaggagaagcaagaaccttcttcagaaggtggcaggagagagagagagctcaggggaaactgccacttttaaagcatcagatctcatgagaactcactccctatcatgagaacagcgtggggaaaattgctcccatgatccagtcacctcccaccaggtccctccctcaacacgtgggggttacaaatcgagatgaggtttgggtggggacccagagccaaaccgtgtcacaggatttggacccaggaagtctgtgtctatctgcttgattgttgctttgaatctcagggctctgatgccaccctgtgtgggtttggccctgaactgaatctcttccaagagattagcatggtgcatgctaatgtaggccaactggctttatgtatcaagatgttgacttgagttcaaggtaaccaactctgatgaaaaggtcacaaagcgctcaaaggggctgggtgctgggtggggcagagaatgcagtccagtccccctgggtgtggcctgcaggccggcggaacagtgctcctcccctccttggcatcaccctcctttcccctgggtgccagtgcgtctttgattgaggtggtgccccttgtttcctggcagctctcatgctcagggcagctatgaaggagccagggtctgtgacgcttacagtggaaggaattttagagacccagttgcccaacttcaggaacactaacaatagccagctttatggcgtccttactgcctgccagacgtggtgctgagttctttgccactattctctgctccgagtcaactctgaggtgggcaccactctcccctcttagaggtgagagagagaggccgggaggttggggctgcaggctggtgaggggcagagccagccaggtctggtgccaaagctgtgccatccccaccaagccgtgtaaaaagggcacagtgcctgctccgttcccaggattgtggaacatgtggcagtggagggtgtgagcaagctgtggaaaccgctttggcagaagagtcaaagtctggtcatctccagtggtgtctccttcacaggtggcagattaaacctggagaggttaagaaggggaccaactcccctggtgaggggtagagcagggaccatccccaggcctagttcagcacatcttgtaggctgcctgtgtaatcttctgatcatgattttttttttcattttttttattattttttattttaattttaattttatttattttattctatttttttttttttgagatggagtcttgctccatctcctaggctggcatgcagtggcacgagctcagctcactgcaacctccgcctcctgggttcaagcaattctgtttcagcctcctgagtagctgggactacaggcccctgccaccattcctggctgatttttgtatttttagtagagacagggtttcaccttgttggtcaggctggtctcgaactcctgacctcaggtgatccacccacctcgccgccacaaagtgctgagattacaggtgtgagccactgcgcccggccctgatcaggattttttgctctaagaatatcaaggtgacctgaattgctttgatgtctattaaaagggtatctggctgatacgttgcttgtagtttacattgcagcctgggccggcctcactgtctttattttctggaagacttacatcagccagggttcatctgagccctcactcccatcagtgaagagggagcagctctatcaggcagcccctggcctgggccccaggaggctgctaaggggtgaggccttcccagggacatggagtccatggaggagccacggcttcaccaagggatgaattgaggggtggtcctggggctaaggccatgagggcctttctggatcccccatttgagagccttgctgccactgaggggctggtggccggggctcagagaaaggggaaaagatgttgccagactggacttcccaaagcccattgttggcattctccttggaaatcttgtggggtgaacagttgcacaattaaattggtagggcattgaaacacacgttgagttagatgatctaaactttaatatggaaaacttgaaaacactcgggctttatttgggggaagaaagcattaatcaggaatttttcatttgtgagtgacagaaactctcctcagactgccccaagtcagaaaaagaatttattactcatatacctgaaagtcttgtgctggtctactctgtgttatgaaggaataactgagactggataatttgcaaagaaaagaggtttattttggcccacagttgtgcaggctgtaccggaatcgtggtgctggcatctgctcctggtgaagcctcaggaagcatacagtcatggtggaaggtgaaagggcagcaggcatgtcacatggcaagagagcgagcaagagagtggggaggtgtcaggttctttttttttctttttgacatggagtctcactctgtcacccaggctggagtgtggtggtgcgatcttggctcactgcaacctctacctcacgggttcaagcaattctcctgattctcctgcctcagcctcccgagtagctgggactacaggcacctgccaccatgcctggctaattcttgtatttttagtaaagacggggtttcaccatattggccaggctggtattgaactcctgaccttgtgatccacccgcctcagcctctcaaagtgctgggattacaggcatgagcccctgtgcctagccggtgctgggttcttttaaacaaccagatctcatgtggactcatagagtgagaactcactcattactgagaggacagcacgaagccattgatgagcgatcccccccataacccaaacaccttcctctaggccccaccttcaacacggaggtcacatttcaacatgagattaggagaagacacacatccaaaccgtatcaaatccttagtttcaggtacagctggtccacatggcgggatggtctctctcttctggactcttcccaccacgtggctgggtggggcccgaacagctccaggcttagggccacccagtctcgtgcccgtggtcatcctctcggcctctccatctctgctgggtcatgttcctgcctctgagcccatcactggccagaggaatgtagggctctagagctttgggttggggtcccagcctcttatgagtcacatggactgagactggggtggtgggagttaccccaaatcaggcactgttctagggcagatgccaggcaggcctggaaaactgacttctgtgtgttaggtaatgccccatgccagatgaatcttttccctgcagggcagttggatttttctattttctttctgtaatagttctctgagttagaatcaggaaacttattttgtgccttgcctttggaattttgagctcttttcttccctacttcgtcctgccccctgttctccatcctgaaaagccagtgtaaacatgggcatcctgcctcagagtccggggcctgcctttttggtagggtattcacaagccacggggcctgcctttttggtagggtattcacaagccacgggcccagcttttcagggcatcgatcgcgagccgtttctgctcactgtcagcagtctgtcagccaggacagagtttattttgtctgtctatggctggcgtttccctaacccgattatggattgatgtggccatctcctaggaatttaggagctactcgtgctttcaggggagcaagcgatggatttcactgtacctctttctgctgtccaagtttgcatggggaaaatgaggaccctgccaggagcttgcctgacaggccctgccccgctgcagactcccagccctgctgggtaggatcgctgcaggcctcccgcctctgtgctccggtatagtctcggagatgcccgttgacgaagaagacatacagatggttgaatagaacccattcttttgtataagccaaaaacttaccatttttgaaaatcaccagtgcatgtctggaagacaaaccctcgtcatcctcgatgtgagtcttgctcagtagtctgcactgctccgattcggaggacaggtgtgaagttcctgtttgtgttcgtggacttgcgctcttctgacccttattctttaactaaagtgctcatttgatctctgcaaaccttgacccacctgtggtggccgttgccccagaattgctgagttgactgtcatcatcctgtggcttattggttctcattcacatgcaagggaagggactgtggctctttaatgcttaaagcacgttttgctgggatttgtccattgtcccaaggactctcaaatgtactgaacacctcccaacccagatctttggcccttctaggtgactgtcacagggaaggagcaacattaaagtaatcataaaataatataattgtatacttgtaatttccagagagacttgcaatttataaataaatatataatttaataaaataaacataagataataaaattaaaacaaagcaaacctccaagagtctaagactggggttttgcctttggccagtgcatggccagggaagctgctggcagctcgcctggcaggtgaagatgagatcgagacctctgagcatcctaagacgtgcagcaccatccctccctttcctcctgcattgcgggtggcagtgagcgggagctgtggggctgggcgtggggccatggatactgagaagagaggagacacaccctgcctgcagctggcaccaggctgtactggctcttgtctcctgtcaagagtagcggcagttgtgtggggctcgaggtactgatccatttgctgtatgatcacagggtcttgcctggagtgtgcgttttattgcactagcagcagaatggtaagggaaacatgctcggggacagggagggactgcacctgcgaatctcccggccctcaagattctgatgaggttagtgacaggtggaaccggcacagtggtttcaaacctccctggatgattgtcaggtaccaccagggtggagaatccccggtccagggcctcacagctcacagggcggcagcatgcgcattgtgaggcattgcaagtttgttgggaatgcagaatcttgggcccacccagacatactggaccgaagttggcctcgtaacaaaatcccaggtgattcgtgcgcacactgctgttggcagagtggcccaggcgcaggtaagtgctaggtcttctcacagcagcctggaagacaagatgaaggatgggttgatggaggagaggggaagcagtcacagtgggaggcggggcttgcaccaggacccacgcgccagtctgggctgcttgcagttgcatgcggcagtccccttagagctgccctgggcctgtccgaggtcacagaatcctgtggagccatatggagaggccacactttagagaaggtgatgacttggattggacagaatctgaagctctgaacacccgagatgagcaacacaactcattcctcttaagtcttgttttgcagagtcatgtcaaaatgaatactttatctagttttcccaacattttgttatgagaatttccaaagataagaaaagttggaagaataacgaatgctccatttgagttctccagtgaacatgcgactacatttgctttatctcatgactgtccaccccgtgtcatcatccatcttactttctgatgcattccaaagtaggtgccattatctctgaccatgaatgggtgacagggagtgacagctgccttctgtttagtacctaccatgtgctaagcgctttgtagactgtatctgcaatttttatagcttcaccaaagaagctttttttccatgtgatgacacccacgttcaaggaggttacttaaaacgttacacaactcgtaattggagagcctgagattttaacttcaggccttcacccaaggctgttccctccatgccctgttgaacgtggaattagaaaggagctggatgtactgggatgctgggcagatgatggtgtggacctagtccctgtcctcagtggtaggatgatgatgtgtcgggtgcagtgggagggaggctgatgaggcacgcagggagggcttcctgaagaggcaatgcttgattcttgtaggaagagaagctggaaatgactttttggaaagggttttccaggcagagggaatggccagggggaggccctgaggactgtgctagtgtggtatttatgacagtgcccgtctctgggcagctgggctttgggggcgtgtcatggagggccacgtgtgatggatgggtaagagccacacctgccctcagccttctctggagacaattgatatgcaggatacgatgctgggtgggggcctgcaaagacactgccagtgtgggcttcacgtcaaggaacatgggctgtagatgaggcagcatggatctggggagcctgctacacagcagggaacctgaagagctgcaaaagactccagcacgaggcttctggtgatggggagggagttgtgagaatcaggggaggcttctagagggattgaagattgatgaaggtcttgaaagacggggaagtgtgagcagacacagaggagagagggagagggactatagggggtagtgtggcaggagggacacagtatgttgaggtagaaagtcaagcatattccagtaatggaatgcacattcctagggggtagtgtcgatggttcactgccccctaacagggaaagctatccatgggtcactgccggatggagcacttcagactgaggtgatgagaagagatttgcaaagggatgtggggtttgggcctttgggtggtgggggaagtggggagatgggaattggactggcagaaaggaatcaggaaggagctccgggtgggcaagtttgaataagagaataagttgagggaggaacttgcaaggggagtgaggagaggtctgggaatgaggcagagtgcaggggccttgaacgctgggaagctgcagtggggctttctgtggcatgcaggggcagtcccagggccagcactgtggagggggtaggcagtgctggggaggcagctgcaggcagagtgcaggaggcctgcagtgctggggtggatggggtgtctgggtggctgcagggaggcttccagagtttcctgcagtcgctagcgcccaggcgtgcagacctgatggaggtggctgtggtaggagggaggagcctgaggagctgagaggtaaggaagtatgagagacacgtgccgctgtcactcgctgcaggctagcacagagtcggtaaagcaggtgcttgtgaataatcggatgataattgatgatgagatggtgaaaaccctagcaatgtccagaacctgcagcgccccaaaccctctcactgccgatgtgaagacctggtccagatcctacagagtgaggacgtgcagaagcacagatagaaaagaaacagcttccccatacacacactcagcatagagcccaatgatcagcaagaagctgttagaaaacagaacctttcagaaaagatactcaatattgaaacaacaaatgcaagaatacccaggggtagacagtgcagaaaccacagaacagaaggatgcagaaacagtgtgcgtgacatgaggcccatcctaggtttctggtctggaagacagacaacgcggtctctgtaagaatccagaaagaggcttttgtgttctatgttttggggatgaaagatatgataattgttctaaatttcacctgaaagaaaaaatggaaagctgggtcaaaatgatttttcagtagaaaaatcgaaggaggccttacctcggcagataggaaaatgcaatgcagagatttatttactgcctggggcctttcaggcaaaagtccttttaaaaggttaggttagaaacaacaacatcaaaaaatattgtgtgtgctgggaagggcatgggaagcttcctgtttcttctttctgatcccagttggcagaagcagcgtgttttaatggagaaaaatatgatgtctctggtctccatgtagactgctaatgtagcaacacagaggactcctaatgtttacatctcatcattctagtgatatttctgattgctccattattttttaggccacctgtaccttttcacgtgtctattcaaaggaaaacgtttcttaggggtttcctcaaggttttgcagaagtacattttgtttttttaagttagttcccacctttttttggaagacttataaaaatgtgtgaacactgagacttatctagttactagataaaatacttgaagtgaataaaaatcttgtagttgtaagaatagagttgggcatggtggctcacgcctgtaatcctagcactttgggaggctgaggcaggtggatcgtttgagcccaggagttggagaccagcctgggcaacatggtgaaaccccatctctacaaacgatacaaaaacaactatttgggtgtggtggcacgtgcctgtagtcccagctacttgggaggctgaggtgggaggatcacctaagcccaggaggcagagattgccgtgagctgagatggcaccactgcactccagcctgggcgacagagcaagatcctgtctctacataaataaataaatagaatatataattgaaaggatcgaccagtacctttggttgctggtcaaataaatgagttaacattcagttaactataaaatacagatggtccacagtcccttcccttgttgactcattttagttagctggaaatcagttttctttggaggatgtagaaggaggtggggacgacgtgatcgctgatgtttagtgagctcttactctgtgacagccatggttctgagaactttctgcttcttgattaattcctactgcaaacctgtgagttctctccatttcagaaatagggaaactgagtcacagtgggtttgagcggcctgccagggtcacagaactaggaagtggcaggtctcagatctgaatccagacatcctgactccagaactttgtcctgcgcttgcttcctctctgttttatgagtgatgtttgtctctgttgattatctggtttttttttttttcagtctctagtattgacctagagatggctctgggatgtggttgaatactgaccccagaagcgatgcccggaaatggcccagcactgccacgttacctcctgttatccttcctgtgaagccggtggtctcacctttcccgttcaggtggcgttgctggtcatgggaatggaactcccctctgccccctcccttctgttccctggtcttcccggtgactgaccagccacgggcccgcatctggggtgacccaggcagtgcgtccactctgtgtggagcttggcttcctctgtcgcagtgaggagtcgagggaggcggctctgcggctccttctccagctccggagcctccctttcttctctgcacttctccacctgctgtttgctaggaagcaccccgtgaatcacccacaggccccggccccggccccagcaggctcccgcacagacacggcttctgggaacatcctgacagtgcctcatttatggggctgcacagagcagtggccttgtgcccacggtgctgagtcacggcggattgttcagcaattccattaggataatctatcccagacagagagccttgccttggagcctgctcaggacgccgggtggcccattagggcctggcgcctggccagaggccacatgacagccggcttctgcactgtgggtttgtcctgggctccttaatgaggccagggacttgagttttcttgcacttttgcttattttcctgcataaggggccaccaacctgtggagctgtgtgaaatgcccacaatagcccatgactcaggggattggcatttctcacagtccccgaggcttgggggcagatttcctccaccgctctcaaaataaccaggtttgattgcagcctcagagaacatgctacccatttcttaaagtggtacgaacctattccttaaaaatgtcccttgcagagctttagaggaagtcgtggtttctggcttctcctcagagtcttgttgatgctttcgccgtgtagtcctggggctgtgcggaaggagggtggctgccattgggctggatgtgctacccaaagcatgaactcaatggccagtgcccagccgggtgctcacagatagtaaaggtgacatgtgtcgctgcctgctaggatccggccattgagaagggacacagatgagggatagctccttctccagcaggagcttcttacttataggagagctctgcagggccattttggatgaaatcaccaagagaatttattttcattaatatggcccggagggtctatctgtaggatttgtgctttctgaaatttgtgtgcaataccatggtctctggcctcactgggaggcctagtggtatcgcaggggagggggctgagagctcaggctgcctgggtttgcatttttctctttactggtgagccgtatgcccttgaccaagacgctgtctctgcaccccagtcttctcacctctagagcgaggatgcagccacaggccctgtgttgggggtggcttcgacggtgtaagtacatgagtgaccacaatgcctggtgctcagtgtcagccagggatggtaaaggcctagaaaggggaagctgtggggctgtatcttgtcccctgaacccagccagaagccccacgcagggctggtgcctgtttcgtgtgggtcctgaactctatgaaggtttggtgatgctttggaattctggaagaggagcagatgcattccctttggagggtggggaagacgtatttttccctggacagcaacataccttccgttctaacttgggcagctcaagggagaggccccgtggtacccgaggttcacagctgagccaggccgggaggatctgaactagaacctagtctttctccccacgccctgccctggctcctcagctgcaggacgccaccccttctgctgccgtcatcctggggtgcagagccttggggcctggcttttaccccgaatgttcctctgattatatagacctcagaactttctcagcagtgaaagctgtttgcgttcctggaacctacaatgcttggtcatgagggcgtgggattaatgggttggtgtcctgtttcctggcctctgccctgagcgaagggctggggctctggactcgggcctctgcacatgccccgtccacacacaagcatcccgcagtcactgcgccggggcaggcccgctgtgtgcgccttcgcgagagtgcctcatgcctcctttgctttcttccagctgctcacagggctctcgtgttcatggggctcaccatgtttcaacagatggaaatacaactcagtgcagtttgtccaagctgccaagtccctgctcgggtgtgggcaccctgctccgtttttgtgcccagctctcagccataagattggcatttctcagtgggctcttgttctggatgccttttgccgtgtgcagtgtatttcttggaaccggagttagtgacttcacatgttgctctagcaactgagaaactgttgcacccagagctgccagcagcccaaggggtcttcgcgagtgactggctgacaggcatcccggtgctaagcccctcgccagcaggctgggtctgctgggaccactctcctcagctctgggatctgaagcagtagacgtgaacaacctaatgaaacttctataattttagaactttggcgcagacatagtcaaagaaatcaccttgttgggtacttctcaccattttattaaaggagataacaggatgccaatttggatgaagtgaggcccctgggggtggcatggggaggggctactgacggggggcgctttagcactaccttttccgtctgcctgccttctacttctttttgtcgtctccaaggtgaccccctggaatgcagtttgaaaccacagatgcagtctggctgccttataagtgtcagtccctgccgtctcctggtcagccctctgcaagctgcccccaccagctgtgactccaggaagaacccagtggggggtgtagctgctctggggccctctagcctggggcccacatctctccagtgcccccttgctcctgctcctcttcaccctggactgagaaagctttctagaagggcttggctcgccagtactgccgaagccctggcctggtcattttgttcactgggctagtaggggttgagcgccatgctggctgccagggatgtggcggtgagcagagcaggtggcctggcccaggtctgctgaggctggtgggtgggcttgccagccctatggtgcagccctgcccaagtctcctcttcaggtagaagtcctaaaacaggtgacactatggtcattggccgcataccacgatacgttttattagaggcacttcttactctttcgtttcctaatgaattatgtttgtaaattatttttacagggccttattggaaggagaaagtaatccagagatagtgatctgggctgagcacgttgaaaacatgccgtcaggtaagtaaaagctaatgacttgacttagctttaggcatctgaactgtttattctgtggctagatagtaaagcaccatcatcgggaagaacgggttagatatggtgtttagataacaggagttcatctctcatttaagtaccaaatagattttagtttagtgtgacataatttcaattatgtgaatgagaatgtttgggaaggtgcttgataaacttggtccctctctcgacaggatgcaggagcggaaggggctaatggcactgggcagtgtgagggcgagcaggagtgcacctgaacttgtgtttcacacccctggaagggacactccttccatttccagaccaaggggttatggttgttacacctgtagagggaggtatggccttggatggcaggcaggcagcactctggaacctgctaccctaacaggaagagagatgggaatagttacattgtttacaccaccctaggttgttgtgagcagctcaggaaaatgtgtcctggtgccttgaagactaccttattgaggccaagagcctcaggacagggcccatccttcctatggctgcagaactgacataagatcattaatgttcattagaaagatcctaagaaactgagggataacttgttttttaaccttttaaagccctatagaatcttgaagagctctggctaagcaagtgtcgattaaattacgtatagaatgttgagttcacaccttaggcagcagcatggttttagtcttcattgtttcttttaggcaactcatggatttgacatgtcactgggttgagaagaatatttgggttctagtcatctataactggaagggatctggtcttagacaacatgcagcaaattttctttctaattttgagagtaagtttgaaaaaagcaaaggtgttcatggaagggtaggcattggtcaacctgcctggcatcagttaacgtgtgacatctataaaacaagaattaactccccagatttcaaggtttacttagttacctacatttttaacctgtggatacctaagtttggacatccatcatgtaacctagagagaggggagaaggaagaaaagggcccaggagctccgaggaagaccaacagtctaagccagggccttgctcaaattttcccagttgtgattttggggccgagggagagcacacagaggggctaacagctgttgctgttaacttgcttcattcattcattcattcattcattcattcattatttttcaagcttcttgaaggaaatagagacttaatatttgtaaactaaatttattctggcaattacatattatgccaaaagctttagaataaaaattactagttgggaatttttattagacgttgagcttctagatagttctgttctgttgagtaaatatacagataagttcctaagtagtgaacttatcaatacttgttagtgtgcttgtgtttcttttataatattgcataaaataatgttggccgcttgcccgctagccggtggacctaaacccagtctgtaatcttccatgtttcttgttgaatcttaactgtaaatgagatggtccctgcactattgcctgggggttcatcttctgggacttctcagttggatcagtaggatcagttgacctgaaaagaggagtcttgtagaaaatgtcctggcctggtctctttcctgtatcttgggatctgtgcaaaggaggcctctggccttggctccataagggagagagaaagccctgtccccgctgagccagctggggtgtgggtagacaccaggggcactctcggggtggacggtgctcctggctgcgttctaaccaccagctgccattcctaaagagcggtttcccctgctggggtgtggacaccccaaagggtagcactgtctgcaaacagcctggagcaaagctggaagccctgaggactgcctcccaacttcaggatcatgacactaagacagaccggggtgtttctgcactggctccttttcagataagtgttaaatgtaaaataaaagatcagaaagcttaaagaagttaaattctttaatacttgttggcccaatatggaaatcagtgaaacagaagagtatattaaatagtggaggataatgctatttggtgtttaataatgacacactttgtaattacagagctcttctctgctacagtaaattaaacttacctcaaaaagcagaaattaatgatttcaaaatataagattgtgaaatttcagccacaaaaacgagcacctctgacctctctgggatatgcattgtgctttatgattaatgttaagatgagtgagtattttaatatcagtaactggagaaacgtgttaggctgaagtatttgtagtgctacattttattgtaacaggattttgtaaactgccaaaaaataatttgggcaccaaatataacttatctttataatgagctttctgtggtaacagtgtatatttattatgatggaatgggatttggcctgcaacaatgcttgtagatggaaaagggtaatgatgactgtcattttaatgaatgctttgttcaatttctacagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcagaggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgagg

SEQ ID NO: 37777 - DNA, 153593 bp, Homo sapiens
gtgcatccctgccccttctgggtacccgtaggcgctcccgggcgctggcggcggcggaggagagggagcagcgtcacgggcgcccggcccgttaaaacgctgctggctggagccacctccctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaagtgagtactggggcggggggcggggggccggggacagctggggatccatgcgcctgcgcgggtggtcgcgggagcgcgaggaacgccagcagtggacccagggaagcgcccccgcagcggggctggcagctcagggggatacgcagctctgcgcagcgacgcgctctccccgcgaacaaaagggggggaccctccgggctgagcctcactgggagggttgggagatggccaggcagctaaggcaggagcctgggctcgacttaggagtcccggatccgtcagctcgcagctggtcctgtgaagtcgggtctctcccacagcccagggaggaggatcctctctccgcctgggatgcgccagggcgctggagacgcgggaccgtcctggaaagcgcccacgtccctggagaggggggagtgtctgctggttttccgcttgctttcctaccccctgcgtgaggtttcggagcgcacctgaaattcccagcttttcctccctcgccttccttgggtcggggtgggaggcttggggcggcaaaagggtcaaaaggcacacaccgttctcttttctctcttgactcagttaaagtctgcttgggcacaactctagaaggcagtttcgaaatagaccggctgtatttatttactggttctctctgcggtgtttggatgtcaacatttctaagtaaacgaaggattttgtttttcattaataggatacaatagttgaaactcctgccctcaaagtgtagaggcagcgtcaggggctccagggtcactggaggtccctgcaaacccgggggctccccaaagccgctgctctcacatggcttgcccaccaggctgggaaggagaggtccttctcagggacccggcagcttcctgcctcggctctgggtcactgctccgcgctctgccccagcacggatctctgagcgatgtagggctaaagtattgtgaatgtgatcttattctgtcctcacctggtggaaaattgtgtgtgcgcgctttctttctctatacctgtaattatggatttagaaaatcttcctagaagggctcaactgtgttctgattctgacgggttgaagttgaaatcacaatccaatgtcttagtggttcatgggctaggatggatgtcatagcactgccaacctctttccttttctttttttttctccctttttaaccttggtctttctttctagttcatcctttcaagacccaatgacttggtgctttggcataatatcagggcgtcagggctgagggtctctgtttctttctttaatttttaagtgcacatagtgggtgtccatatttatggaatacatgagatattttgatacaggcatacaatgtgtaataatcacatcagggtaaacggggtatccaaaacctcaagcatttatccttttttttgtgttacaaacaatccaattacactccttttttaaaaaagcccagctgtgtgactaattatactcttttagtttagcttttttttttttttttttgagacggagtttcgctcttgttgcccagactggagtgcaatgacacaatctcggctcactgcgacctccacttcctgggttcaagcgattctcctgcctcagcctccagagtagctgagattacaggtgctcgccaccatgcctggctaacttttgtatttttagtagagatggggtttcaccatgttgggcaggctggtcccgaactcctgacctcaggtgatcggcctgccctggcctcccaaagtgccgggattacaggtgtgaggcaccccacctgccctcttttagttatttttaaatgtacaataaattgttgactgtagtcatcgtgttgtgctatcagatactagatcttattcattctatctacctatatttttgtacccattaaccatctctgtgtccccccatcccaataccctccccagcctctggtaaccatcattctactctgtatctccatgagggtctcttgtttcttacaagctcaaaataatctcaacaatggctgccttttattgctagatgaccatgtgctgagaactctaaatgcatcatttcatttagtcccctcaacaacctcctgcagtactaagatttataaatttaaatcttgcctagatttaaaaaaacattttaaaataaaaattttaaaacaaaacattttaaaataaaaaatttaaatataaatttaaaatcttgcatagatttaaaaaaacaaaacaaaactgggacttgttaggtgatctgacagttaagtggcagaaccaggatttgaaccccggtctgttggaccccagagcctgcttttaacatgaaggtttattgctttcatggtttcagaaaacttcctaagtctattgagatagtcacagaacatgctcagtgattttataattatgtggcagccctgttgctctctgaagctcacagaggccttaaaaaaatgctgggtccacgcagaatggaagctgttcacaagagtgctgctttgaatcctcactctgtgccttgctggctatgtgactttaggagtattgctaagcctcactctgccttcattttctgaaaatagagattatgtctttattgtgtatactaaataagatgatacatatagtactcaaggttaagtgctcaatacgtattgttcacttccattcggttactgcacaacatttatagacagaacctgcttttactctttgcaaggaattatgtaaatattggtcaattcttcaataatgcccttgtagctttttatatcttaacattttatgagaaaaaatttgaaacatgcaggaaaattgcagcaagcacccaatttacagcagtttcaatcctgaaatttttgtacttctgggtcctatgctgcacactgttaaaagtcaggtataaggccaggcgcattggctcacgcctgcaatcccagcactttgggaggccgaggcgggcggatcacaaggtcaggagatcaagaccatcctggctaacacggtgaaaccccatctatactagaaatacaaaaaattagctgggtgtggcagtgggcgcctattgtcccagctgccggggaggctgacacaggagaatggcgtgaacctgggaggcggagcttgcagtgagccgagattgcaccactgcactccagcctgggtgacagagtgagactccctctcaaaaaaaaagagtctggtataaagtccttcttaccctctgtttcaaaccatcaaagactcagtcttgcttcctagtcaaaggcaagaggaacagctcctgatctgtacttgcgtggatcctcaaatctggtttttcttttcttttttgagatggagtctcactctgtcccccaggctggagtgcagtggcatgatctcagctcactgcaacctccgcctcccaggttcaagccattctcctgcctcagcctcccaagtagctgggactacaggcgcctgccaccacgctcaactaatttttgtagttttagtagagaggggttttcactatgttggccaggctggtcttgaactcctgaccttaggtgatccacccacctcagccttccaaagtgctgggattacaggcatgagccaccacacctggcgaaagctgaaattcttaaaacgtggatccagagtctaacttttgaaacttgaatctggcaagttttattttctagactatttttttttttttttgagacagggtcttgctctgtcgcccaggctggagtgcagtggcacaatcagctcactgcaacatctgcctcccaggttcaagcaattctcccgcctcagcctcccgagtagctgggattacaggcatgcaccaccacgtccggctaatttttgtatttttactagagatggggtttcaccatgttggccaggctggtctcgaactcctggcctcaagtgatctgccctccttggcctcccaaagggccgtgattacagatgtgagctaccatgcctgggcctgttttctagatgcgtgtttgcacgcagggggtgtttgattaaaccttttttggaacactctttcaactctcagggtatctatggatccattccataaagcctgggccctccatttatttattaagtgtgaaaattagtacttttgtttctatggcatgacaattgccaagccaatgttgtaacacatgaaatgctggagaaaagaagagtccccttaaaaagaagacatgctctgtttaacttccacacattttaaaatattttatgttaaacactgagtaggtgtaaattaaacagaattgaagaggggagggagactgcagaactggtcttttttagttaagattgtgttgactgctattttaaatttcaactatagtttttagataaaagatatgtaatgtgctatatcagagtagcaaagaaggaacgttttgaagttaggctgaatgagttcaaaccagcctcattcagctgtcacttggtagatttgtgaccctgggaaaattgctcaaggtctctgtgtgtcagttgcctcatctgtgaaatggggataattgtagtaatgcgcacttcggactcttggaagattagatgagataatgtatataatgcatttagcacagggcctcacatgctgaaagcgctcaatcaaggttgaatggttgtcataggaggacagaaggggattgccccagcaatatttgcagaggttatcccaaactcaccagttacagcttttcattgcttccatttcttagtaaattctggttaatgattctgtacatactgccttcctcatgggaacatgtggagaaaggcttctgcacccttacaaaccatctagtattttctcctttgagaaaggttcaaagtaattgctcccagccaccttcaacagcgtttttccactagcagggaggttttttccccgctcagctggaaaatgtatagtgacatttcagcgtggttagatatataaaaatactgctttcaaccaagtgtaattaattgagggagacatgcagacaaggtgccttttgaaaaagcgcagagcttttcagaaacacagttgtctctgttgtggccatttcttgatagatttgtatgtgtcttaaaggatgatcaagattttggacaggggaaatggaggagttggaggcgggagaggggaatgccaggagaggtaatagcatcaactggctgggtgtggtggctcatgcctgtaatcccagcactttgggaggctgaggtgggcggatcgcttgaggtcagcagttcgaggccagctgtcccaacatggtgaaaccctgtctgtactaaaaatacaaaaattagccaggcgtggtgatgggcgcctatagtcccagctactagggaggctgaggtgagagaattgcttgtactcaggaggcagaggttgcagtgagccgagattggacggctgcattccagcctgggtgacagagcaagacttaatctcaaaaaaaaaaaaaaaaaaaaaaaaaatcaacacagacatagtgctggaaataaatgctctatgagtaggagattggaatgaagtagagagctcaaactgcaatctttccataagcccgggggagatgactactatttaaaagttcaaagttgtgtactgactaacaagcagatcgtaaaactggccagcgtttcaggtttcataaacagtgtggaggctgaaataatgcaaattgctggcaatctatataatagattcttggggaaaggtttgaactatcttctgtttggttacatatgctcattttattattttattttggttttgcatcatttctttttttctgattctagaagtaatacatgtactttataaaaaatttgaattcatctgaaatatgaaaataaaaagtaaaaaacgaccatcatttgctccccagatcccatttattcactccataaataggtactgagtgccttacaagtgccaggaagtgttctaggggctgcaggtacagtcttgagatttctcgacaaagtccctgcccacataaagcttctgtttaggggaagttaagacctgggttgagagtgaaggcgtcaaatattacataagcaaacaagtaagatggtttaggtcatagtaaatgtttcatgggcattaatagggaaggggtacttttcatttggtgttcaggaagcgcttctctaaggaggtgacattttgctgtatcaatagcaggaatccaggcagtaaacgtaaaggccttgtgctagaggaagagacagaaggccagggtggctggaacccagtgagtcagggtgaagggcagatgaatcagagggaagccagactaggtagggccttttaggttgtgattaaaacaaacaaacaaaaagtctgaaatttattctcattgcaggagaaactgctaaaaaattttaatcaagggactaacatgaactgttatgttttttgaggttttttgtttttgagacagggtctcgcttgtcacccaggatagagtgctgtggtgagatctcggatcactgcagcttcaacctcctgggctcaatggattctcccgcctcagcctcctgagtagctggaactacaagttcgcatgcctctagagcccattaaaaaaaaaaaaaattaagacagagtctcgttctcttgcccaggctggagtgcagtggtgtgatcttggcttgctgcaacctctgcctcctgggtccgagcgattcttctgcctcccaagtagctgggattacaggtgcccaccaccatgcctggttaatttttgtatttttagtagagatggggtttttccatgttggtcaggctggtctcgaactcttgacctcaagtgatccacctgcctcagcctcccaaaatgctgggattacagccgtgagccacgatgcccagcagccctgttagtttgtgaatttttggtagagatggggttttgctgtgtttccaggctagtcttgaactcctgggctcaaaagcaatctgcctgtctcagcctcccaaagggctgggactacaggcaagagccactgcgcccagcctggtttttgtttttaaagggtcatgttgggtactagatggggaataagtccatagcggggcaagtgatgatcaatgcaagcagcatttgatatagtccgtgattccttcctaatcaattttattttggagaagtggtggcagtttccttgagtgtgaaaggtgtgacaagggccccatgggttgtcctctggaagatcaagcacctggttaagacttaggagagggaggccgggcacagtggctgaagcctgtaatcccagcactttgggagaccgaggcaggtggatcacctgaggtgaggagtttgagaccagcctgggcaacatggtgaaaccccacatctaccaaaaatacaaaaattagctgggcgtggtggcgcatgcctgtaatcctagctactcgggaggctgaggcgggagactcacttgaaccagggggcagagcttgcagtgagctgaggtcacaccattgcactccagcctgggcgacagagtgagacactgtctcaagaaaaaaaaaaaaaagaattaggagagggatagattctgcactgtctcttgacaggcaactatgtaagttattgcaaaactattatagcagtgatataaatattacaaatatgatagtatctagaatgtactttgaacaagcccaattatttacacagttgagtaatgtctgctcataactttgctcataacattatgttttatttttgcaagagtttcctcctgtgttaattgaagaaaaaattaatcatgcctattcttggactgattagttattaaacacatattaataataatatccattcaatgagttttagctatgaacttgagcttattaaattctcataacagccctatgacataaggagaattattattcccatttaaacatggggaaaccgaggtttcagggggttaagaaacttgctgaaaggcataaagctagaaggtggtagggctggagcctgattctaagccctctctgcctctggatgttcctatccactgtctgttattcttggttcagtgctgggtgctgtagagattagagatggaataagacagaatcccagccttcactcttaaaaggtttacagatttggagtgagagacacagccataaagaacaccacagggccgggcgtggttgctcacacttgtaatcccagcactttgggaggccgaggctggtggatcacttaacatcaggagttcaagaccagcctgagcaacatggtgaaaccccatctctaccaaaaatacaaaaattagccaggcatagtggcatgcatctgtaatcccagctactctggaggctgaggcaggaggatcacttgaaccggggaggcagaggttacagtgagctgagattgcaccactggactccagcctgagcgacagagcaagacctgagaccctgtctcaaaaaaaaacaccacaggctgggtgcggtggctctcatgtgtaatcccagcactttggtaggcccaggcagggaggattacttgagccccagagtttgagaccagcctgggcaatgtggcgaaaccctgtctctaccaaaaatacaaaaaattagctggacgtggtgctagctacttgggaggctgaggtgagagaatcgcttgagcctggggggcccggaagctgtggtgagccaagatggcaccactgtactccagcctgggcgacagtgaggccctatctcaaaaaacaaacaaacaaacaaaaacaaaaacaaaaaatccaccgcaacttataaagcagtataatgaaacacatgctaaatgaaaagtacaagtgtgggccaggcatggtggctcgagcctgtaatcccagcactttgggaggccaaggtgggaggatcacctgaggtcaggagttcgagaccagcctggccaacatggtgaaaccctgtctttactaaaaatacaaaaaattagccagatgtggtggtgcacacctgtgattccagctactcgggagcctgagacacgagaatcgcttgcaccctggaggtagaggttgcagagattgcaccactgcactctagcctgaacaacagagcgagactctgtctccaaaaacaaaaaaaaaagtgtgaaattaggaaagaaattggctgtgactggggagctgcaggccaacagcaaagaggggtgtttgcattgggcctgaaggctaaacagggtttcaaaagaggaagagtgtagagaaggggatttcaggtaagctgtctgccccaggcacagaggtgaatattccaaaggccagggtccaggcaccagctttgtttttttttttttttttttttttttttggctgtttctttccccttggcttaatggatcctgggactgcctggttcacttatatgaatgggcttgggggttggttggaagccagcacaggtaaaggccctcttttagtacttcactcacaagttcccccaaaagatagaatcaattcatttcttcactattcacttgttgtgggcgtctcctgtgcacttgttttagaggaacagagctagatgggtcctgaccccacccttaagaattccgtcctactgtggtccatttcttcctctgctgcttcctagcactgtgatcttggacaattggcctaacttccctaagcctcagtttcctcatctgtaaaatgggtatagtgatttctttaatcccctgagaaataaacagaataatgccaggaaagcatggtgacaaatacatgtcactaaatgttattgatggtagcagtgtgaaggctcagctctgttttgcagacgatatttattgagaaatgcctgccaggctgggtgggaggagctggcctcatagtatgagtacatggtggtcctgcatggaagagcagatggtttctagtttattggttataagtgtgggctttcgagagagcttttattttgaggcctggctctgccatgtcctggctctggactttgaatgagttatttcacctttttttcccccacctcaatcttttgctatctgtatctgttctcaataataaccatgaggaattatataaatctgaagaagtttctcaaagtcagtttttgagacagggtcttgctccattgcccatatgggagtgctgtggcacaatcacagctcttgcaagcctcaacctcctgcctaggcctcccgcctaggcctccgaagtagctggaactacaggtgcacaccaccacgtgtggctaatttttacaatttttttgtagaggtggggtcttggtatgttgcccaggctggtcttgaactcctggcctcaagcaatcctcctgtcttggcctcccgaagtgctgagattataggcatgagccaccacgcctggttatttcacctcttaagctttggtttctgcaactgtacaacagtgacagtaatagtatctacttaggatagctgagaattccttgagacacagattggaaatcattcaatacagaggtcagtacatgatacatgtttagtaaatgttaattattatattattggctttacagctatggcaacaggtacataaaaaggtaaacttgatttaataagggtgtgtgagtaagtagggggctggcagcagggtagctaatggagcaaagaggaggggcttagccaaccctggggcttctgaaaacttctggaagagctgagccttaataagaaagaatagaaggaaatacatatgtggaatcaccattaattgttaggaaaaaccaaattggaaccttactgagatatgtagccactggaaaggctaaaattaaaaggactgatcatactaagtgctggagaggatgtagatcaactggcaccctcatgccttgctggtaggaatgtcacatggggggaaatggcttggtcatttcttaaaaatttaaacatacaccaatcataggacccagacggtgcacttctgggtatttacccaacagaaatgagagcaagtgtctctacaaatatttgtacacaaatgttcatagcagcttttttaggaatagccccaaactggaaacaacccaaatatggtataatcatacaacagaatgcttctcagcagtaaaaaggaacagactaaagacacactatgtaaatggatcacaaaatcatcatgctgagtgaaagaagcaagcaagaaagaaaagagtacatactgtatgagtccgctgacatgaaattattttaaaaacttaaactattgtatacagacagaaagtaagcgagactctaactctacaaaaataaaaataaaaaagttagctgggcatagtggcccacgcttgtgatcccagctacttgggaggctgaggcagaatggcttgagcccaggagttcaagaccagcctgggcaacatagcaagtcctcatctctacaaaaaaataaaaaaataaactggctgagtgtgatgatgtgcacctgtagtcctagctacccgggggctgaggtgggagaatctcttgagcccaggagtttgaggctgcagtgagctatgactgcaccactgcactccagcatgggcaacaaagtgagaccttgtctctaaaaaaataaagaaaatgattataagaaataacatgcatgaagttcttcctatgagccactgtgtgcatgttttacatgcatcctccgctccttacaaaacgttctgtgagatgagacacaatatagccatctattgcatttattgttctatttacagaggagcaaactgaggcttacagaggttaagcaattggcccaatgtcactccactgataagtggtagggctgagatttgaacctagcacaggttgacttaattctgctaccttcctaatttcccaggattagttgaagctgccattgatatagatgcttaatgtcaactagacacatctctgtgtttcttagaactgattctgttctctggctcattaatttccttttccattacaaacatgcctcttgtaagcttgaggactacatctcaccacttcaaagtgccttcagtgtcaaactggagtggaagttgaagacgttcacaaaaatggaggagggagagcctttctgttttgaagacttgtagcttcacaaagaaaggctttctttgaatgatcaagaaggatttctaggtcaatataggggcatattactgtaacgtttggcagcaggagctctgcctgcatttgaatcctggctttaccacttcataatagttgcgtgatcttgggctagttacttaacctctctgaatttcagttttctcatctgtaaaatggggataataacaggatctgccccaaaggatgtattggtccgttttcacactgctataaagatactacctgagactgagactgggtgatttgaaaagaaaagagatttgattgactcacagttccacctggccgaagagtcctcaggaaacttaaaatcatggcggaaggcacaggagaagcaagcaccttcttcacaaggtggcaggagagagtgacagagggaagcaccagatacttatcaaacaaccagatctcgtgagaactcactcagtatcatgagaacagtatgggggaaaccgcccccatgatccaattacctcccaccaggtccctccctccacacatggggattacaattcagattacaattcaagatgagatttgggtggggacacagccaaaccgtatcaaaggctaattaagaagattcaatgaaataatacatgaaagcccttcacagagtctggtgctctcagtaaatggtggcgatcatgttaatagaagaggatgtgaagtgggaattgacctgatagtatctgaatagttggagagaaggaagagagagaagttaaatttaagtgggtgaacctcaaggaagaatggaggtgacgatgagcgtggagatttctggaggcgtgcatgagcttcgctgcattggaggagttgtgagataaaaaggatggttaagcaggaccactagactttggtggattaaaaaaggactggcaatatggggccattggaggacaagggatggagggaaagaagtagcatttatttatttatttatttttgagacagagtcttgctgttgtctcccaggctagagtgcagtggcgtgatcacggctcacttcaacctccacctcctgggttcaagcgattgtcctgcctcagcctcctgagtagccggaattacaggtacccgccaccatgcccagctaatttttgtacttttagtagagatggggtttcaccctgttggccaggctggtctcaaactcctgacctcaggtgatctgcctgccttggcctgccaacgcgctgggattacagacatgagccactgcgcctggccggaagtagcattttaggaaggcttgtctggcaatggtgaccaactggatgcaaagtcaggggccctggggataagaaggtcagctaggagggtttggaattatcccatgatgagggctgtatgtccaaatatccatggcagggctggagtctgcaggagcagtgggtttgaaagaaggggctgatcagaaatcttgaagggagaaacccatagtagttattatgtctcagaaggaaagaaggtcttctaagtgctctcaatgtgataggcaaggaaaaaccctgtcattagcctgaggtcttaaccagttaaaaatatcagcatccaggcgcagtggcttacgcctgtatttgcagcactttgggaggcccacgcgggtgggtcacttgagttcaggggttcaagaccagcctgggaaacgtggcgaaatcccatctaccaaaaatataaaaattagctgggcatggtggtgcaagcctgtaattccagctactcaggaggctgaggcatgagaatcgcttgaacctgggaggcagaggttgcagtgagctgacatcgcactactgcattcaagcctaggcgacagagcaagaatctgtctcaaaaaaaactgaaaaaacaaagagttgttcctgatgctgccgtgagattagcatcctcgccttctgctttgagggaaagatgtgagattttcagatcagatacaaagtaacaggaataggtaccatgaatgggaaccggcagccaagtgacagtgttgtgatgggtataggctgggctaggtactttacacaccttaaatttttgattcttagatgccagcataggtgaggtataacatttcagagtaagtcacgtctttctgaaacaacagaaacaaaaaaacgataaggccccgttaaataactggtccgtttagcactacctgcaatagcaaagatgtggaatcaacctaggtgcctattgacagtggattggataaagaaaatatggtacatatataccgtggaataccaccagctagcaaaaaaagtaaaactatggtctttgcagcaacatggatgcagctggaggccattatcctaagtgaactaatgcgtgttctcacttataagtagaagctaaacattgggtacaaatggacacaaaggtgggaacagcagacactggggactacaagagggaggaaggagggagggaagagttgaaacactacctgttaggtactttgctcattatctggctgatggtttcacccagaccccagatctcagcatcatgaaatacacccttgtaacaaacctgcacatgtacctccttagtctaaaataaaagttgaattttttttctttttctttaattttttttttttaagagagggagtctcgctctgtcgcccatgctggagtgcaatggtgtgatctcagctcaatgcaacctctgcctcccaggttcaagcgattctcctgcctcagcctgctgagtagctgggactacaggtgcacaccaacacacctggctaatttttgtatttttactagagacaagctttcaccatattggtcagactggtctcgaactcctgacttcaggtgatccacccatctcggcctcccaaagtgctgggattacaggcatgaaccactgcacccagcctactttatttttaatctccatctagtatttagactagagatgggcaaatttttcttttttgttttctttaaaatttttttttttttggtagagatggggtctcactatgttgcccaggctggtcttgaactcctggcctcaagtgatcttcctgccttgacctcccaaagtgctgggattacaggtgtgtgtcatcacacccagccctgatacactttttctgtacaaggatagatactattttagggtgtgcaggtcatatggcccctgttgcgaccactcagctctaccaccgtactccaaagctgtagcctaaagctgccatagacaggcacctaagtgaatggatgtggctatgttttgtttcagcttgattggtgagcactgaaatttgaattttatataactttcccatgtcataaaatattattattcttttgatgttttcccacagccatttgaaaatgtagaggtcatctcaaaaaagaaaaaaaaggaaaagaaaatgtagaagtcatccttagctcaagggccatagagaaactggcattggtctgggtttggtctgaaggctcatggatccctaccctagacaaataataggcatgtaaaaggtattcacatcacagctggctttttttttgaaacagagtcttgctctattgttcaggctggagttcagtggcatgatcttggctcactgcagcctccacctcctgggctcaagcaatcctcctgcctcagcctcccgagtagccgggattacaggcacaagccaccatgcctggctaattgttgtatttttagtagagatggggttttaccatgttgttgaggctgatctcgaactcctgggttcacaggattcatctgcctcagcctcccaaagtgctgggattacaggcatgacccaccacgcccggccatagctggctttttgcttgctgtgggaggagaaagttctggctgcttggcttcgatgctatgcttggctcttccaaccaccatttgtggctttttgctgccagagcttgtcatgctgctgcattgcccaagagaaaaagtttgtgaggttccacgttccatcatatcgatgatcattttagggttttcacacacaagagacaggattattgcaagcaacagcaatgaactttggaaaactcagaggttttccaagtgtgagatttaaagcctcatgcatgaaactttaaattagtttaagggggcgtaaccagcataaaaaaaatgaaatagaaggaaataggaaatagaaagctgcatctatgctgctaaagttaagtcttatttccgtgcaacctttcgtttgtttgttttgtttgttcgttttctgagacagagtctccctctctggagcgagtctcacccaggctggagtacagtggtgtgatctctgctactgcagtccctaccttccgtgttcaaacgattctcctgcctcagcctcttgagtagctgggaccacaggtgcatgccactatgcccagctaatttttagtagagatggggtttcactgtattgaccaagctggtctcaaactcctcacctcaagtgatccacccatctcagcctcccaaagtgctgagattacaggcatgagccaccatgcccggcctattttgtccaacgtttgttttacttatgcctatgtgtgtatgtacatactgggtcactcttagtatttcttttttttttttttttttttttttgagacaggagctcactctgttaccgaggccagagtgcagtggtgcaatcatggctcactgaagccttgaattcctgggcttaagcgattctcccacctcagtctcctgagaagctgggactacaggtgggtgtcaccacacccagctagctaactaatttttttttttttttttttttttgtagagacagggtcttactttagtgcccagactggtcttggactcctgggctcaagtgagcctcctgcctcagcctcccaaagtgctgggattagaggcatgagccactgcatctggctctctgagtatttcttactgtgatccacagtaagtaaacttatttaaataagtttgcaaagtacaggaacttaaggaaaaggaatgtatctggaaatccttccagaatttaaaacaaaaaatagctctaggcacagtggcttacgcctgaaatcctagcactttgggaggctgaggcgggaggattgctagaggcaagagtttgagaccagcctgggcaacacagggagatcccatctctacaaaacagttctaaaaattatccagtcatggggcgtgcacctgtagtcctagctacttgagaggctgaggcaggaggattgcttgaacccaggagtttgaggttacagtgagccatgattgggccactgcgctccagcctgggagacagagtgagaccctgtctcttaaaaaaaaaaaaagaaaagaaggaaggaagggagagagagggagggagggagagagagagagagagagagagaaagaaagaaaaagaaaaagctaaacagccagaccttagagagaagaggaaccttggtgactaggaatttccagatggcagaaaattccgggtactgtcatctggctgaatcagtcccactcttttgcatctctgagccactgtgcccaagattcaagtacctgggggagaacacagagaagatctctgcgttaaccagagtccatttctgttgcttgcaaatcatcccatctcctgtgtgtgcaaactcctaaaataagcacttttagaagaaacgctgactcgtacaaactttccctgtgtcctaaggcctcctgccagctttgcaactgctgctcgcgggcaagggaacctctccagtctcaggacaatggtggttgggagaagctaagctaaggtcaaagccaaacacagcgagaacttagcctaagtgtatcggaccagctaggatcaagacccaacccttgactaggaaggagggcatcttgaatgccagttccctaagacagcatttcacgggtgaggtgtattctcccatggcaagacattggaggtgctatcatgagagaaagaacaatggatgcttgcagaacagaacccgcagatgaccactaaggaatgacactggttttccttctctaataaaaataacaacaacaacaacaaaaatagctgggcgtggtggcaggtgcctgtaatcccagctactcgggaggctggggcaggagaatcacttgaatccgggagacggaggttgcagtgagctgagatcgcaccactgcacaactacctgggcaacagcacgagactctgtctcaaaaacaacaacaacaaagaaaaaaccaaaacaccgttgcttttattctgataataaaacagggttaatgctcgaaattttaaaactaaaaaaataccaaaagttataaaagagggcaaatgtcatttaaaggaatgctgcagcgaggtagagtctcacacctgtaatctgaggcagaaggcaggagcttgagcccaggagttcaaggccagcttggccaacacagcaagaccctgtctctacaaaaataaaaataattacctgggtgtggtggtgtacctctaattctattattagctacttgggaggccaaggcaggaggatcacttgactccaggagtatgaggctgcagtgagccaagactgtgccactgcactccagcctgggcaatagagtgagaccctgttctaaaactaaccggctgggcgaggtggctcacctgtaatcccagcattttgggaggccgaggcgggcagatcacttgaggtcaggagttcgagaccagcctggccaacgtggtgaaaccctgtctctactaaaaatacaaaaaaattagctaggtgtggtggcacgtgcctgtacacccagctacacgagaggctgaggctgaagaatcacttgaacctgggaggtggaggttgcaatgagtcgagatttcgccactgcactccagcttgggtgacagagctaactctgtctcaaaaataaaataaaataaagcaaaccaacagaatgccaccaacctccaataaccactgagagcatcccttcagatgtcccttcctcccttcccctttccttcctctcctcctcttcttcctgttctgagtcatgtttctcaaggagagacaagttgtactttgggatctggtctcttttctcacacatctctgctctctaggggggcacctccctccctatggatatcacagggagtttttttccttttagagtttgaatggaggaagacttcagacagaactgtacacagcacagagctgcagagaagtggaagattaagagaaaataatgttggacaaattagatgtagcttgtataatctggagctacagtcacgagaataggatgtaacataaagtctaatgtgattcagcaaacacacgttttcattacttttgtgcagatggctctgctaggtgacttggaagggaaggaaaccgaggcagtgttgcttccttcgaggaagacagagttgcttcctttccccccatccactggggacagaatttcaaagagattacagcacagaccagcctgtggcaaatgcatgagccaagtgtgatggggacacagaggcgattaaaatgcaatcattagggctggtcatggtggctcacgcctgtaatcccagcactttgggaggccaaggcgggtggatcacttgaggtcagcagttcgagaccagcctggccaacatggtgaaaccccatctctactaaaaatacaaaaattagccggtgtgatggcacatgcttttagtcacagctactcaggaggctgaggcaggagaatcgcttgaacccagaaggcggaggttgcagtgagccaagattgtgccactgcactccagcctggatgacagagtgagactcagtctaaaaaaaaaaaaaagattgctgttctatttatgctgtgaacattgctgaaagattgagcaggaaaaatggagatcaatgctcagtaagttccacctgaaagacctcctttgaacatagcaactgttcacttggtgaaatttggctatacaggtaatgaatactttgtgagaaatcacactctgtggtctccgagtagcattaacaatctcttgcaacagagaaagctgaaatgaagaggagaagtgtagaaaatgtcatctgagggcgcgcgtggtggctcatgcctgtaatcccagcactttagaaggcagaggcaggtgacctgaggtcaggagttcagcctggctaacatggcaaaaccgtctctactaaagatacagacattagccgggcgtggtggcgtgcacctataatcccagctactcaggaggctgaggcaggagaatcacttgaacccgggagatggaggttgcagtgagccgagatggcgcaactgcactccagcctgggcaacaaatggagactctgtctcaaaaaaaaaaaaaagaaaagaaaagaaaatgtcatacccaacagtgtgttgggtatgacaactactagtgtgtccagccatcctggtttgcctgggactatcctatttttagctctgaaaagtctttttaaaattttatttatttatttatttttgagatggagtctcgctctgttgcccaggctggagtgcagtggcatgatcttggctcactgcaagctccgcctcacgggttcacgccattttcctgcctcagcctcccaagcagatgggattacaggcatgtgccgccacacctggataattttgtatttttttagtagagacagggtttctccatgttggtcaggctggtctcaaactcccaacctcaggtgatccaccagcctcagcctcccaaagtgctgggattacaggcatgagccaccgcgcctggccatgttaactatatattaagatacgaaacagctttctttcaaggggtgcagctttaaaacagtctacagtagcaaggcatttaacctgtactcggaagccaggaaaccttggcctgacttgccactgtgttctttgaaaggtccgtcgttaatgtttgactattcttaatgacaatttgtggcttatcaggttgacgttttcctttcttttcaggcagctgagacttaagggagtgaagtaatttggtggtattcattgcaggggccacatagatactgtcagtacgcttttaaaaatctttttaaagtaatagatgctcattataaaaattcaaacaatacaaaagtgtagaaagtagaaagtactttctacttcaggaagaaaatttcccaccctcaaattgtcattccgtcacaagtttgatgtgtatcttctcagtgttttgttggacatatgttaacacatggattttaaaaaatgaattggatgatatgtgtactaatcagtcttctttttttattcaaactatatatcatgaccatctttctaagtcagtaatacagcattatcttttccttgttttttttttttttgagagaaagtctagttctgtcacccaggctggagtgcagtggtataatcatagctcactgcaacctctgcctcccaggttcaagtgattctcatgcctcagtcacaggagtagctgggactacaggcacatgccaccacacccagctactttttgtattttttagtagagactgggttttgccatgttatccaggctggtttcgaactactggcctcaagtgatctgcctgcctcagcctcccaaaatgctgggaagacactgcatcagccaaaaaaagtatcttgtgtttaatttggcctatgtcttccttttctgatcactgcataatttttcagtgtctggttataccttattttttcttaattaattctttattgatggacagctaggtgatttaacaatttgataaagaatgctgcaataaatatcttttgtcatttttgcacattgtccaattatttcctctatataaattcactttttttttgatgcggaatctcactctttcgcccaggttggagtgcaatggcgcaatctcggctcactacaacctccacctcctgggttcaagcaattctcgtgtctcagcctcccgagtacctgggattacaggcacgcgccactatgcctggctaatttttgtatttttagtagagacagggtttcaccatgttggccaggctggtttcgaactcctgacctcaagttatccacccaccttggcctcccaaaatgctgggattgtaggcatgaggcactgtgcccagcctcctctatacaaataattaaaagtagaattgctgagttaaaagctttcaactaggtttagaatgtggaagatacacaaatctgaattcactttatggggtgcatatttgagactaaattaaaactaattaacttgaggaagaaagaaaatatcgtaattcaaatgatactgtggaaaaagtagcagagtaggagttagaatactttggttctagagcttgttcaccttccagctaactggttgacctttgacaagcttcttaacctttttgcacgtctgactcttgcctccagttgtatctggtctcatgaatcttccaaataattgacagagtcattttctacaatgcgaatatgacctctgcttaagtccatcaggagctcaccattgcctttggggtgaagctaaaactcctagctaaccatgcagcagtctgtgtttgtagcttcctctccctccacgtgcccagccaggacctttgatccacctgttctcacctcctttcattgccttcaatgctcacagtttgctaagcctccagatgttggttcaggttgttccctccttctggaatatctggtcccttctctgaccagctgacttctactcattcttcaagaaatagcttggactttgtattagtccattctcacgctgctataaagaaatacccaagattgggtaatttataaaggaaagaggtttaattgactcacagttccgcatggctggggaggcctcaggaaactaataatcatggtggaagagaaagcaaacatatccttcttcacagggcagtagaagagaaagaacgagcaagaacagggaaaactgccttaattaaccatcaggtctctcgagaattcactcactatcacgagaacagcatagggaaaaccacctccatgatccaatcacttcccactaggtctctccctcaacacctggggattacaattcaagatgagatttgggtggggacacaaagcctaaccatatcagacttcttaccttctcagaagactttcctgacacctacaggttgaactgatgcctcttctcttggcttttgtgaaggcagcatattactttacacatcctctgtaaatagcacacactgtattacaacggctgactttcttatctgggtcacttcattcttttgagggcagaaaccgtgacctgttcatctttgaatttatagtatctaccacagtgtctgacacatacagatgtttgctgaatctttgtggaataaaacaattgatctataaaataagtgattggattcagtaatacaaaattgcagccaagtatggtggctcacacttgtaaccccagcactttgggaggctgaggtgggtggattacctgaactcaggagtttgagacgagcctgggcaacatggtgaaaccccatctctataaacaatatgaaaaaattagctgagtatggtggtgcacacctgtagttccagctacttggggggctgatgcaggaggattgtttgagcccagaaggtcaagactgcagtgagctgtgttggcaccactgcactccagcctgggcaacaaagtgagaccgtgtgtccaaaaaaaaaaaaaaaaagtagaagtttatgagaattaaaagttcaaggaaacctcagaactactaaggaaacatctcaaaataatacagtaaaaaaaacacaaacaaagccaggtgcggtggctcacgcctgtaatcccagcactttgggaggctgaggcgcgtggatcacgaggtcaggagtttgagaccagcctggccagcatagtgaaaccccatccctactaaaaatacaaaaaaattatccgggcgtggtggcgggcgcccataatcccagctactcgggagggtgaggcaaggagaattgcttgaacctgggaggtggaggttgcagtgagccaagatcgcgccactgcactccagcccaggtaacagtgtgagactctgtctcaagaaacaaacaaacaaacaaaacacacacacaaacaaacaaaggaattaaaatggcacactggaaaataacatgaaagaaagctattaaaaaggaacagactaacaaaaaagacatgaaggatataaaaaacaaatagcaaaatgtcaggtgtaaatccaaccacatcaataattacataaatgcaaatggattaaatactccaatcaacaggcaaagatcgtcagactggattaaaaaaaaaaaaacaccaggatccaactatgtattgtctataagagacacacttcagattcaaagacacaaataggttgaaaagaaaaggatggaaaaatgtatagcctgcaagcataagagagcaggagtggctatattaatatcagacagaagaaaatttaagacaaaaaatgttactagagacaaagagggacattttatagtgataaaaacaacaatacaacaattatatatgtgtccaataacaagagtagaagggaattgtagaatgaattatagaacctttacagtgtgaatattgtaacttacagtgtgtaaattacagtgtgttttcagaaccataccttggaacctctccagattctttaccttgtggcctcctgtccactccattctaaggtgttatcatactgaagtgcaccatagtggtggtcttgatggggaaaagaaatcacagtagcactaacaggaaacatcctgagggaagaggcactgtcatttttaggtgtagggaagatgtttaagagcccgttttaaacatctgagcttctggtctttggaattttgtcagcccagagacagtttcttttcttctcaattctcttttcctttaattggtcttcttcttgccatacctcattccttagtcatcctggtcttgatctcagaaatctcacattctcattgatttagcatggttttctactctagtgccagttctactgttggatggaaagaaccatcttctgatgtgacaggaagccttaattattaatttaaaattcccctacccttctccaacttctatggaagttaactcaggaattattggagtaggttgaagattctctgagtgggaggatgggtgagattcaaattagagaagtactatgaggactaaatgaccctacctaagaaagacagtttccaaactaaagttatgggagttgggtacgtaggtagggactcgggaaccatcttggctagagaagggtcagaggaaaaatacagaggaaattcatgggagagagtatcagggtggatatatacggaacagatgcatacttcaaggggacatttagacattttgctctgggatgagcaaaatcaccctctttttcatctcccaacaaaccatttaataaaaagtaagacattactcattatcggagcaggatctgttgatttcgttttttaatttttttaattcatttgtgtttgatgtgatgatgtgccaagaccagcctgaaggtggccaagggcaaaagcagaggttgttatttgcaggctacgttgacactaggtagtgaacttcacagctcaacacatccacacatattggctgaacgttaattagttctgcctagttacagggtttccaaaatggatgagacattctgcctcccctcaaggaatttgtgggctggtaaaggagacagacacagtaacagatcattatgtaatatgctaagtgctttatcagaggaaaaaagctgggtgcaggctgggcgcagtggctcacacctgtagtcccagcactttgagaggccaaggcaagcacctgaggtcaggagtttgagaccagcctggccaatatggtgaagcccattttctactaaaaatacaaaaaattaaccaggagtggtggcacatgccggtagtcccagctactcgggaggctgaggcaggaggatcgcttgaacccaggaggcagaggttgcagtgagccaagattgcaccagtgcactccagcctgggtgatagagcaagactctgtctcaaaaaaaaaaaaaaagaagctaggcgcatcaggggctttgagccttctgacccagcctgggaacagggagaagcacaattcaaggggacatttagacattttgctgtgggaggagcaaaatcactcctggcaggagcgacccccgggctcagttcaccaggtgaaaggaacaggcaaagtcacataagtacaaagcagtgtggtgcttcctgggaccaaaaagcaattcgttatcaataaaacatactttgcgttggttcccatcttaccgaaccttctttcctttcttctttcttccctgcttccttctcacacgccctccactcacctctcagaactcattctatgtgatctctacccaaagcacagtgctaagagcccggaataaaacgggcaaaaccaacctagccattgtcctcatagaattaatcatacaaataaaaatataattttaacctgtggcaagtgctcagacagaaaaaatccagttaggctgccagtaaaaatactagatgtggccggatgtggtagctcatgcctgtaatcccagcagtttgggaggacaaggcaggtggattgcttgaacccaggagtttgagaccagcctgggcaacacagcaaaccccatctctacaaaaatacaaaaacaaaacacaaaaattagccaggtgtggttgtgtgcacctgtagtaccagctacttgggaggttgaggcaggaggatcacctgagcccaggaggttaaggctatagtgagctgtgattgggccactgcactccagcctgggtaacaggaagaccctgtttcaccaaaacaacaacaacaacaacaacagcagcagcaacaacaaacaaaaaactcccccaaacaggtgcccagttaactttgaatgtcagataaacaacatatatgattttgcagtataagcatgtcccatgcaatatttgggacatacttatcctacacaaaaattgttttttctgtgaaattcaaagttaactggatgtcctgccttttttttttttttttttttttttttttttttgaggtggagcgtcgcactgttgctcaggctggagtgcaatggcgccatcttggctcactgcagcctccacctcccaggtttactagattctccagcctcagccccctgagaagctgggattacaggtgcccaccaccacgcctggctaatttttttgtatttttagtagggacagggtttcactatgttggccaggctggtcttgaagtcctgaccttgtgatccgcccgccttggcctcccaaagtgctgggattacaggtgtgagccaccacacctggcctgcatttttatttgtaaacctggcagccttaagtccaagatcccatgagctcacatgactaggggacctgagttaacctgggctgcagtgggagaaggtgattggagaaagcctgacatctgcagaacagggagctgcacctgggagaggaggccggagaggggagtgacctggagaagggaacagcctgaatgcgaacagaaattggccccaacagagcgttcaagagtctgagagaaggctcctggggcttgagcacagacatttagtttactgggatatggagagaggagaagcaattggaaaatgagtaaatatatcatgcttttaaggaggcatgctgtacaagtaaatgtcaggtacagtgactcaggttattgatttgaaagattagtcagtggagacatgtgctggacttactcagtccctctgttgtcaaggaagtccaacgccaccagcactagatccttcaacaatgcagagtcctcccgcaaatgaatctgactttgcctgtaaaccgcggagagtttcaaaaactggaaagcattacaggtggccagtttgtttccatttatataaagtgcagcaaaaatgatctgtcagagagagaacattgggataaatttcttttttttttttttcttctggagacaaggtcttgctgttgcccaggcaggagtgcagtggtgcgaccatggctccctgcagctttgaactcttcatcttaagggatcctctcacctcagcctcctgagtagctggggccacaggtgtgcactagtatgtctggccaattaaatcaattaaatatatatatattttgtagaggcggggatctcactatgttactcaggttggtcttgaactcttggtcccaggcaatcctcctgctttggcctcccaaagccctgggattgcaggcataagctacatcacctggcctgaaatacgcttgaaggcatcctttgaaccactgttatcacagaagtgtggtcaggttcagtgtggagagtgaatgagaagctgggcaggagcctgtgcgagttgggctttgtggagacacacagaaagatgccccccactttaaccaccttcccttgcctcgtcgtttgactgctgaggtcttactcacactctgagactgtagctttcacgtggcctcctctaatatattttcagtgtagccttaacaatgaatcgtagtaacttctcaccttacatgctccccaaaagatgtcactttgggagaacatattcaaggaaccctccccaatcctgacccccatccccaccccagctcctgctgctgttgacacaactgccttagctgtgaggctgtgccatccattggaacctgggactttccaatgttgggatgcctcagcatcatcaagcaaaattggggttctttttgtgtatgctttaaaaaaaaaaaaaaaacttgaagcataaaactattactggaaagtggtcctgatccagactgcaagagagggctctcggatcttgtgcaagaagaaatttggggcaactccatagagtaaagtgaaagtagtttattagagaagtaaagaatcaaggccgcgcacagtggctcatgcctgtaatctcagcagtttgggaggccgaggcgggcagatcacctgaggtcaggagttcgagaccagcctggccaacatggcaaaaccccatctctactaaaaatacaaaaattagccaggtgtggtggtgggcgactgtaatctcagctactcaggagactgaggcaggagaatcacctgaacctaggaggctgaggttgcagtgagctgagattggtccactgcacttcagtctgggcgacagagtgagacttcatcttaaaaaaaaaaaaaaaaaaaaggattccaaagaatgtcaggtatggtggctcatacctcccagctctttgggaggccaaggcgggaggattggttgaggccaggagttcaagactacactggccaacatagagagaccctgtctctaattttttaaaaaagaagaaactaaaaaaatggcttctctgtaggcagagcagtctcgagtgctgctggttgacaattcttgtggttatgtcttgatcgtatggtaaacaagaggtggattattcatgagttttccggaaatggcacagggaattcctgaaactgagaattcctcttccttttagactatattgggtaacttccagaagttgccatggcacttgtaaactgtcatagtgctggtgggagtgtcttttagcatgctaatgcatcataattagtgtataatgagcagtgaggatgaccagtggtcacttctgacaccatcttggattgggcaggttttggccagcttctttattgcaccctgttttatcagtggggtctttgtgacctgtatcttgtgacctcctgtctcatcctgggactaagaatgcctgacttcctggggttgcagccaagtaggtctcagccttattttacccttattcaagatggagtcactctggttcaaatgcctctgacaaagccagcatagatgaagacctaacacccttgagcaaatgaaagatctgtgtgatggaacagttgcgtgtcttgattggggtggttggttacctgaatctgtacatgtgataaaattgcacagaaccacacacacacatacacacacacaccaatgaattggatgtaaaactggtgaaatctgaataaggtcagttatgcaaaatgtcatcactggggaacattgggtgaaggttttttaggacctctctgacatacaaacggatataaatcagcaattctctccaaataaaaagctaaacaacaaaaccgaccccaaacactgacaccttgtatccatcatccaaatttggtcaatgctaagatatatatttttttttttttttttgagactgggtctcaatgtgtcacccaggctggagtgcagtggtatgatctcggcttactgcaaactctgcctcctgggttcaagcgattctcatgcctcagcctcccaagtagctgggattacaggcacccaccaccattccaggccaatttttgtatttttagtagagacagggtttcaccacgttggccaggctggtctcaaactcctgacctcaggtgatccgcctgccttggcctcccaaagtgctggtattacagctgtgacccaccgcacccagccctaagatctttgtattagtcctttttagaaaaataaaacaaaaccttaaagattcagctggagactcctactcagtcctttttctttccagaaatgacccttgtcatggaattaatatgtatttatcttttccacatttgcttttactgtattatgtgcatagtcataaacaatctgtgatatcctgttatacatttcctttggtagcttattttgccactaaacatgttttcaggatttatgcatgttgaaacatgtagatcaattcttttaattttttaactgctcaaagtatttctaataggtgaatataccacaaattcttcaaccaatcttccactgataataggttgttttccatttttcagtattaccagacattgctatcatggccatccaggtataaatgcctttttgggtcaagagtttctgcagggtttttatctagaattgaaagtgctaagcagacagtatgcacatactaaacttcagtaaacattgagaaattgctatccaactgtgactctataaatttatggctgtcccagcaggtggtaataatcaccatttccttatattttcaccagccaacctgatctttccagactgttaaaagtttgccaatctgatggatgtaaagtagtatttcattgttattttattattgtgttttcctgatttccaatgaggttagacatctcttcataggtttattagctggaatttcctcttctgtgaatcctgaggtcgtacccttttgccctttttttttctattgtgttgtcattgtcataggtattttttgtattttgttcccgattgttttgtatgtttgtgtattataaatttcagcttgtggcctgtcttttaaaaaaagactttttattttgagattattgtagtttgcgtgcagttgtaagaaataatacagagatctatgtatgcctttcacccattttaccccaatggtgacattttggacagctaaatacagtatcaaagacaggaaattgacattgatacaatccattcatcctattcagatttcaccagatttatgtgtgtgtctgtgtgtgtgtgtgtgtgtatttagttctatacaattttatcatatatttagatttgtgtgactatcaacaaagtcaagatacagaacagttccatcacaaaggttcctcctgctacttttgtatagttacagttaccttgccccattcaacccctagcaacaacaattagttttctatttccataattttgtcatttcaagaatattaaagaaatggaatcatgcagtatataacctttttgagattggctttttcactcaccgtaattctctcaagatccatccaagttgctgtgtgtatcagccattcattccttttcattgccaagtaatattccattgtatggatgtaccatggtttgttttacccattgaaggacatctggattatttccagttacaggctattatgcttaatgctgctatgaatactcttatgcaaatttttgtgtgaacataagttttcatttctctgagataaacgctcaggagtgcagttactgagttgcttcaaatgcatatttagccttataagaaattgccaaactattttctagagtggttgtaccatgttacattcccattggcagtgcacaagggattcagtttcttcccatcctcacctgcatttggtgttatcattattttttattttagctagtctgataggtgtgcagtgacatcttgtggttttaatttgcattttctttatatctaatgctgttgcacatctttttatgggcttatttgtatgtccatctgtataatctcttcagtgaaatgcctgttcatgtcctttgtccacttactaattggtttatttggggtttttctgctgttgacttttaagagttctttatgtattctaaatacaggtccttgttgggtatgtggtttgcaaatatttcctcctagtccgtagcttgttttttcactttcttgtcaatgaagagtcaaactctgtaaaatatttgaagatacttattctgagccaaatggaagtgaataatgacctgtgacacagccctcaggagatcctgagaacatatgctcaaggtggttgggccacagcttggttttaaacattttagggagatacaaggcatcaaccaatatatgtaagatgtacattgatttggtccagaaaggcaggacaactggaagcaggaactttcaagtcataggtggattcaaagattttctgactggcaattgattgaaggagttaagttattgtctacagactgagaatcaatagaaaggaatgtctgggttaagataaggggttgtggagaccaaggtttcattctgcagtcaaagcctctgtgtagcaggattcagagagaacagattgtaaatatttcttttctttttttttactttttcttttcttttctttctttctttcttcttcttttttttttttttttttttttttttttgaggcagggtctcagtctgtcaccaagtctggagtgcagtggcacgatcacagctcactacaaactttgtctccagggctcaagtgatcctcccacctcaaccttccaagtaactgggactataggtgtgcacctccccacctggctaatttttgtattttttgtagagatggggtttggctgtgttggacagactggtctcaaactcctggcctcaagtgatccacccacttgtcttcccaaagtgctgggattacaggcatgagccaccacacctgacctgattgtaaatgtttcaatcagacttaaagagtctgttctattaataattccaaaaggaaggcaggtataatgaggcatgtctggctctcccttccaatcatggtctgaatgactttttcaggttaactttgacatgcccttggctgagaggagggctccattcagatggttggggggccttagaattttgtttttggtttatactcttcacagactcttttgcagagcaaaggtttttaattttgatgaggtctaatttatcaattttcccttttatagattatgctttggtgtcaaatctgggaactctttgcccccctttaggttcttaagattttcccttgttttgttctgaaagtattatagttttacattttacactaagtctgtgaatcattttattttttgtgtaaagcatgataattaggtagagatttatttttttggcctgtggatatccaatttgtccagtattgtttgttgaaaaggcttgacttcctccaataaatcatcttcacacttttttttttttttttttttgagacagatccttgctgtgttgcccaggctggagtccggtggtgcagtcacagctcactgcaacctccacctcctgggttcaagtgattcttgtgtctcagctaagtagctgggactacaagtgcgtgccaccacacctggctaacttttgtatttttttagtagagacagggtttcaccatgctggccgggctggtcttgaactcctggactcaagcaatcctcccacctcagcatcccaaagtgctgggattacaggcatgagccactgcacccacccttcgcacctttgtgaaaaataatgtgggcacatttgtttggggctatttctggattctctgttctgttccctcaatctatatgtgtattcttccaccagtaacacagtaacacagtcttgttaaagtaagctgtaggtatatgtaatcatttgtgattccttccagcttattcatatttctcaaattattttagctcttacaggtcctatgcctttatatataaaatttagagtaatatcgtttatgtcttcaaaaattaccttgcaggggtattgataggaatagcattaaacctacaggtcattttgagtgtaactgatatctttactatgtggagtttgccaatccatgaacacaatatgtctcccgatttattgagatattcttaattctttcttcagaattctgtaaatttcagcatacatatcctctacatattttgataaatttatatttaggtatttcattttctttggagtaattataaatggtaatgtgtctttaattttggtttccacatgttaattattagtatatatagatgcagttcatatttgtctcttgacattggatcttgcaaactttctaaactcttgtattagctctaatagttttttggtaagttattggagatctacgtagacacttaagtcatctgcaaatagggacagttttatttcttccttcctaatttgtatgccttttatttctttttcttgttttattgcactggctagaacttcagtactatattgaatgacagtagtgagagcagacattcttggctttttcccaattttagggagaaaaaaatcaggttctcaccattaggatgttagctgtagttttgtgtagatacactttattaagttgagaatgttctcccttattcctactttctgagactttttgtactacatgagtgttggattttgtcaaatgctttttctgcatcaattgatacaattgtatgattttttatttttaccttgttaatatagtggatcacacattgattgattttcaaactagctttgcatacctggattgtcccacttagttgtggtgtataattcttttcatccatcattgggtttgatttgctagtatttttagtattttgttgaaaatttttgctctaagttcatgaggaatatattggtctgtagttttcctttgttgtactgtctctctctggttgtggtatgacggtaatacaagattcataaaatgagtgatggagtgttcctttttctttctttctttcttttttttttttagacagagtctttctctgtcgcaaggctggagtgcagtggcgcgatctcagctcactgcaacctccaactctcaggttcaagcgattcccctgcctcagactcccaggtagctgggattacaggcacatgccaccacgcctggctaattttttgtattttagtagagacggggtttcaccatgttggccaagatgatctcaatctcctgacctcatgatctgcccactttggcctcccaaagtgctgggattataggcatgagccaccgcacctggcctcttttttttttttttttttttttttttttggagagggagtcttgctttgtcactcaggctgcagtgcagtggtgcaatctcggctcactgcaacctctccctcccaggttcaagtgcttctcctgcctcagactcccgagaaactgggactacaggcgcctgctgccacgcccagctaattttttgtattttagtagagatggggtttcacgatgttgcccaagctagtcttgaactcctgacctcaagtcatcctcctgcctcggcctcccaaagtgctaggattacaggcgtcagccactgtgcctggccaagtgttaccttttctattttccacaaaagattgtgtaaaatatgtattaattctttaaagatttgatagaattcttcaatgaagaattgatagagattcattttttttggcctatggatgtccaatttgtccagcgttgtttgttaaaaaggaataatttgaaagctcacaaagagaaatatccaggcaatttctggagatttctcctggagatttctcttttgggagtttttaaattatgcactcattttccttaatggttttagaactatgcagattttctaattcgtcttggatgagtttggtagagtgttgtttttgaggaattggtccatttcattaagttgtcaagtttctgcgtaaaaagttgtttgcagtattcccttgttatctactcagtggctatagaatctgtagagattatcacctgtttcatttctgatattagtgctttgtgtcctctctctcactctctctctctgtctgtctctttttagagataggggtcttgctgcattacctaggtgagacttgacctcctgggctcaagagatcctcctgtctcagcctccaaagtagctggaactacaagcatgcaccaccacgcctggctaattttttgtagagatggggtcttgctatgttcccctggctggtctcgaacttctggactcaagcaattctcccacctcagcctcccaaagtgctaggattaaaggcatgagccactgcacccagccctctttcttcatataagcatttagtgctattaattttacactgagtacagtctctgtatcacatatgttttgatatgttgtattttcattttcatttggttctattctttaagttttgttttagaattcttctttgacctagagattatttagaagtatgttgtttaatttccaagtgtcaggagattttctgttatatttctgttattgatttctggttttgttccattatggtcagggaatataacacataattttaattcttttgaatttgttggggattgttttttggccggggtatggtctatcttggtaaatgctctgtgaacacttggaaaaaaatatgtattccactgttgttgggtgaagtgttcccaacttaaatatcaattaagttgaatgttatgcagttattctatatccttgctgattttctgtctagtaagtctaccagttgctcacagtgggatgttgaagtgatcaattgtaactgtagatttgtgtacttctcctttcggctttatgaatctttgtttcatgcatcttcagactctctgttgtttggtgcatacacaggattgctatgtcttcttgataggttgacccttttatcatgatgtaatgtctctctggtaattttctttgctttaaagtctactttatctggtattagtagagccatcctggcttttcttttgattaacatttgtgtatctttttctatcattttactttgaatctgcctatatcattatatttgaagtgagtttcttctagataacatattgctggataatgttttcatgttcattttgccaatctgtctttaaactgatatatttagaccatttacatttaaggcaattattaatgtgttaggatttaagtctgccattttattgtttgtttctcctgtttttccttctctgcttctcttttcctactttcctacaggttacttgacatattttaaggattccatctttttttttttttttttgacatggtctcgctctgttgcccaggctggagtgcagtggcatgatgacttggctcactgcaacctttactttccaggttcaagcagttctcatgcctcagcctcccaagtagctgagatcacaggcatgcgtcactatgcctagctaatttttgtattttcagtagagatgaggtttcgccatgttggccaggctggtctcaaactcctgacctcaggtcatccacctgcctcagcctcccgaagtgttgggattacaggcgtgagccactgaggccagccagattccatctttaaaaaaaattattattgatttttgtgggtacataagtacccaaataagataaaactaaagttccaagccttcttctgttatcattacctttctgtttggagaatttcctttagcctttttttttttttttgagttgtagctttgctcttgttgcccaggctggagtggagtgcagtggtgccacctcagctcactgcaacctcgacctcccaggttcaagtgcttctcatgtctcagcctcctgagtagctgggattatataggctcctgccaccatgcccagctaatttttgtatttttagtagcgatggggtttcattatgttggccaggctggtctcgaatgcccgacctcaggtgatccacccgcctcagcctcccaaagtgctgggattacaggtgtgagccaccgtgcctggcccctttagccattctttaagggcaggtttactaacaacaaattctcttagtgttttctcgcctgagaatgtctttgtttcctcttcattcctgacatctatttttgccagatatagaattcacaattcataattcttttcttttacttcttgaaaaatattgagtcacttccttctagttgccatggtttcaaaggagaacttgactgtcatttaaattgatgttccctttcaaataatgttttatggctgggtgcggtggctcacgcctgtaatcccagcactttgggaggccgaggcaggcggatcatgaggtcaggagatcgagaccatcctggctaacatggtgaaaccccgtctctactgaaaatacaaaaaaattagccgggcgtggtggcaggtgcctatagtcccagctcctcgggaggctgaggcaggagaatggcgtgaacccaggaggtggagcttgcagtgagcagagatcatgccactgcactccagcctcggtgacagagtgagactctgtctcaaaaaaaaaaaaaaaaaagttttatttctttctgaatccattcaagatttttcttttttttttgtcagagtttaaggacatgtcttggtatggatttctttagttttatcttatttgggattttctcagcttcttgaatccataggttatctttcttcaaatttgggaagttttcagctattgattcttcaaataatttttcagtaccatattctttcttttctccttctaggaatacaaattaatttttatttatttattttgagacagggtctcactctgttgcccagggtggagcgcagtggcacaatcatagcccactgcagcctcaacctcctgggctcaagtgatctgcctgcctcagcctcctgaattgagttgctagaactacaggcatgtgccaccacactctgctaaatttttttgtgtgtgtgtgctttttgtagagacagggtctcactatgttgctctgctgatcttgaactcctggcctcaaacgttcctcctgcctcagcctcctaaagcactgggatttcagtcatgagccactgtgcctggcctttctcttttttattcttattttttttgagatggagtcttgctctattgcccaggctggagtgcaatggtatgatctcagctcactgcaacctctgcctccggtgttcaagcgattctcctgcctcagcctccctagtagctgggatacaggcatgcaccaccacgtccagctaatttttgggttttaagtagagatggggtttcaacatgttggccaggctggtcttgaactcctgacctcaagtgatctacccgcttggcctcccaaagcactgggatttcaggtgtgagccaccgcacccagcctttctcttttctttttaagcaggtagccttcctgttgagctatagtatgaggggtggttgggatgtatattcactttcccccttggtgctggggccactttcctagaaaatatgaggaacaaacctgacagtgctgcattgcttcctggtagggggtgtacgtttagttccttactgcgctctactgctgctggggagtgagaaatgatgagttgactcgtaccactttgttgatgcagggtgagggcagaaacttagctccccaatgggtcccactgacaccagcaggtgggggagtgaggcaggagtacagactagccttgcacaaagtcagaggacagtccaaaagaccactctcacttctgacaccagctgcgagtttgggggtccccaaaactgtcctcaactttcatgctttgctagagggactcacagaactccctgaaagctgttgtactcacagttacagtttattacagggaaagagttcagattaaaatcaggcaagggaagaagcctggagggcagaatacaggtaagttctgaacacagagatgacagtggagtaatgggcagctttaattgtcctggcaataacatgtgacaaaatgaatggagtatgtcaaccagggaagctcactcaagccttggtgtcactgctagaccttcctgatacttgtttggtaaagaaatcagagtgccacctccttccactgggtgggggatggagaatcagctctcaatttgttcccacccatgctaccccagcaggggaatcagactgttaccacctgcttctgccacatgggagttggaaaatcaactttaatctcctgtcaatgatgtgtgaaaatacacacaaagtattgccaagcagggaagctctcccaagccttggtgtccagagtttttattggggctcagtcatgtagacctggttgactgcccacattgctgacctcattctccagcccctctgaaggtggagctgatgccatgtgacccaaagctcccatcctgaatcacatcacttgactttctgatgtggtctaaagcccccctgtgaacaaacacacttttattaagcaggacattccaaaggctgagagatgacctcccaggagctgaagtttaaattcattactgcatatcctactttgtacatgtcattcacttttttttttttttttttttgagatggagtctcactctgttgcccaagctggagtgcagtggcgtgatcttggcttattgcagcctccgcctcccgggttcaagtgattctcctgcctcagccttctgagtagctggggttactggcgcccaccaccatacccggctaatttttgtagtttcagtagagacagggtttcaccatgttggccaggctggtctcgaactccttacctcaggcaattcacccacctcagcctcccaaagtgctgggattacaggcgtgagcccctgtgcccagcccacatctcattcacttttattgctgccaggtgggtgtggaggttcagcttcacagtgagctttgttgacaccagtgtaggtggaaaatgcaggcctggctggccatgacttgtgccacttgtccaatcttggtgatgctgattgggatggagactccggctctgccgggctctgccaacaccagggtgagaaggaaagaagagtcatggtgagtagcctcaccttgcaccagctcattaagtctgctgaaggggaggggagagagacgggagacccatcaccagaccctgatgacatggctgtggcaggaaaatcagggtaccaccttcttccactgggtgggggatacaggatcagcttcccactcattcccatctatgtaccccagcaggggaatcagagcatcaccacctgcttctgccatgtggaagctacaagaccagatccccagttggccctgctgaaatgacagggaaggggttgcagtttttccatcagtctttggctggcagggcagatatggttaaaaaaaatttctctataatctcagcattttgagagtccaacgtgggaggattgcttgaggctagtagttcaagaccagcctaggcaactgtattagtctgttctcatgctgctatgaagaaatacctgagactgggtaattataaagaaaagaggttcagttgactcacccttccacatgtctggggaggcctcaggaaacttagaattgtgtgtggaaggcacctcttcatagggcggcaggagagagaatgagtgcaagcaggggaaatgccagacacttataaaaccatcagatctcatgagactcactcattatcacgagaacagcatgggggaaaccacctccatgattcagttacctccacctggtcccgcccttgacacgtggggattatgggaattacaattcaaggtgagatttgggtggggacacagagccaaaccatatcagcaacatagtgagacctcctgctctacaaaaaatacaataattagccagttgtgttgatgcacacctgtagtcccagctgctcaggaggttgaggcaagaggattacttgagcctgggaggttgaggctgcagtgagccatgatcgtgtcactccactccagcctaggcaacaaagtgagatcatggcttaaaaacaaaaatgaataaaaaatcctgttgctggttttctttcttttcttttgattcaggggaactggcttttcttagagcgtttttttttttctgtgcttggtagtggttccaggtcagaggcttttcctttactgtgtctgggatgttggggtatatggaagacaataagaaaactcaggctgctcactgccacgagtgcccaaagtcccaggatccagaggtagtatgtcttctccttttcacctttcagaatctccttatgcttgtctgctgtgttatgtctgtgagttatcagttgtaagagagaggacctgggaagaatgacactactgcatcttggccagaaccagaagtcctgtagcttgactttcactttgcttatgatactgtatttagttttgacttttaatgagtcaaatgcattgaccttttcctctaaggtttgtgtgtgtgtgtctgtgtgtgtgtctgtttaagaaatccttctcgacattcaagtcataaagatagctcagactttttctctagtttttaattttttttagatggagtctcactctgttgcccaggctggagtgcagtggcacaatctcggctcactgcagcctctgcctctcccgggttcaagcgattctcctgcctcagcctcccaagtagctgggatttacaggcacacaccaccatgcccagctaatttttgtatttttagtagagacagggtttcaccatgttggccaagctggtctcgaactcctgacctcaagtgatcctcccacctcagcctcccaaagtgttgggattacagatgtgagccaccacgcctggcctttttctctagttttaaagtgctttccccactcccatatttaggtatttagtctaattggaatttatttttgggtgtgacagtgattttcaaagcatgatccaaggaccctgggtgactgagactctgtcaggaggacgatgaggtcaaactattttcctaatgatgccaagatgtaatttttctttattgtgttgacattcccaatgacagtgccaaagcattggtgggtaacactttttgcaccttagcacaagaaggcagggcaccccactctactcatcttcatattcttcatggccatgtattcacagttaaacaaacatgcaccagtttcatttaagaatgttcttgatgaagcagtgagagttattattgttactgactcctgatcccaagtatgtctttgagctcttctggatgatggaatgggaaatacacgaaaagcacttcttctggattctgaagcacaatggttgtctcaaggaaaagcacttatgcagtggctggaactgaactagctgccttttgtcttttgttttttgtttgcgtagaacatcattgaaagaaatactgagaaactctgatttttcagccttgggtatttgtcagacattctctcaaaaatgagtaaataagcctgtcacttcaaggaaaacaactgacagtgtttgttgctggtgatcaaacttgagctttcaaataaacaattagaattctggaacacttgtatctgttaccatgggcttgatggtttccaatagaagactttttgatgtgattggtcgtaatgttaatgaatgtgattttggggatgaaatgtgtcaaatgtggaagatcagtgtaaatcagtggcctaatgttttgtaaatgaccaatacatgatattccaaaatcatacttgagcaaaagatctttcaaagagtaagatagaccaatgaattctcatgtaacagagtatgaattgatacagtttcagattccacattgcaagtaaaccttaaaaatgactacttcttgagtttgggtgtcatagaaaataagaatattcacaataatctgaaaaggctattaaactactcctgcctttgctaaccacacatttctgtgaggttagattttccttatatactccaaccaaaacaatatatattaaaacagaccgaacatagaagcagatataagaatctagccagacattgaaacgatttgcaaaaatttaaaacaatgtcactaaaaattttttgttttgaaaaatagaagattttaaaattaaataacatgttacctatgttaccatgtaatgaatttatagtgaatttaaaaaataaattattaaggccaggtgtggtggctgacacttgtaatcccagcattttgggaggctgaggtgggaggatcacttggacctgggagattgagaatgaagtgagccattatcatgccacgccactgcactcgagcttgagcaacagaatgagagcctgtctcaaaaatttttttctaaaatttctcagtttcaatttatcatatagttttcatatatatatataatatatatataatatatatttaaaaagctctttgggtcctccatatttttttaaatggccaggaaatgttgatctatggcatgaaatagagatctgattttattaatttttttttttggagatggagtctcactcagtcacccaggctggagtgcagtgacacgatctcggctcactgcaagctccacctcctgggttcatgccattctcctgcctcagcctcccaagtagctggactacaggcacccgccactatgcccggctaatttgttttgtattttttagtagagacggggattcaccgtgttagccaggatggtctcaatctcctgacctcgtgatccgcccgtctaggcctcccaaagtgctgggattacaggcgtgagccactgcacctggccaatctgattttattttcattttctcatgtgaataaccagtttctccagtagctgaagtagtctatcctatccctactaatttgtaatataacctcttgccattagtatgtttccatattcatttgattgtgtgcctagactctttttctattatatatatttatttgttcatccatatgccaattccactgtctttttttttttttttttttttttttgagacagagtctcactctgtcaccccggctggagtgcagtggcacgatctcggctcactgtaacctccgtctcccaggttcaagtgattcttcagcctcagcctcccaagtagctgggactacaggcatgcaccaccacaccgagctaatttttctatttttggtagagatgggttttcaccatgttggccaggatggtttcgatctcttgacgtcaagatccactgacatcggcctcccaaagtgctgggattacaagcatgagccactgtgcccggccaggaattacacttttagaaatttgtattatacagatatttgcaggaatgcatgaagatctgtataagagaatttcattagagcattgtgtctaataataaaaaattagaatcagtctaagagtccatccatagagaagtggctaaactatggtagaactttagagcaaaatattatgtagctatttggaaaagaatgcagaagatctaattgtatcatcatggaatggtcttcaagatattaagtagaaagtcaccaagtggaaaaacaagtcacagaatatgtagagcatgttcccatttctgctaaaaaaaaaataataatacaaaaactcagccgggcacagtggctcatgcctgtaatcccagcactttgggaggccgaggcgggtggatcacgaggtcaggggatcgagaccatcctggctaacacggtgaaaccccgtctctgctaaaaatacaaaaaaattagctgggtgtggtggtgggcacctgtagtcccagctactccggaggctgaggcaggagaatggcgtgaacccgggaggcggagcttgcagtgagccgagattgtgccactgcatgccaacctgggcgacagagtaagactccatctcaaaaaaaaaacccacccaggtgcatgcccaactactaccagcgatttgtcacctctgagaagaggagtgggattggaagagagatgtcaagggaactcttttctttcctttttaaaacctacttctagattgtctgcattttctataacaagaattaattaacatattgcttgtgtacttattttctttttcttttctttcttttttttttttgagatggagtctctctctgtccctcaggctggagtgcaataatagcatgatctcgggtcactgcaacctccacctcccaggttcaagcaactctcctacctcagcctcccaagtagctgggattacaggtgcctgccaccatgcccggcaaatttttgtatttttttttttagtagagacggggtttcactacgttgactagcctggtcttgaactcctgacctcaagtgatctgcccacctcagcctcccaaagtgctgggattacaggcatgagccaccgcgcctggcctgctgtgtaattctaaataatcatcaggaccatgaacctgaccatctgtgaaagacagagatgtttcctggcaggatagggtccactgccattgatattggcaaggtgcctgctgctccttagcctgctgtaggtaccagattgaccttgagtagaaccagccttgagagaagaggaaaggagagccaggccctaatcatagggatccccaggggtgtagatgatgttaaggcaacatcttctctgtgtctaagagaaaaagaatctgccctgagtatgaactgacttgtgtgctttgaggtcagtgtcctaaacaggaagccatgaggtgagcagagacacttccctgctgcctggggctgggagttgggaagtgagaaaacatcctagtggccaccagaaccatccagtgggtggctctgaatcctgcattgatttgttgggagactttggaggaggagcctggtgtggagggttgagcctggtgagttggaggcagcagctggttactttccatgcagagcagcttggagttgagtcactcgacaatccaagggcacctgtggaagcagccatgactcatgctaccttcagtttcacatctggaggaggaaatcactgacaaagcaaagcaaggcgacttctgggggctgccgtgtaggattctcccatgtttaaaaaagaaaaaaagattgtacaggatttaaacatagcatttattgcctgtgttcttagttataaaattaatacatgtacataataattgttgtagttagttattttattcagcatttatcctatgtcaggtactgatgcttcaagctttacatgcgttgtctcacttagtgtttctgaccattcagtgggggagatctgttattatacccattttacagatatggaaactgagtctatacacacacacacgcgcgtaaaacacatagaaaaaaatcacccacaattctacccgccaaagtcaaccaacatcctgatgcgtgtttttctagtaaccttttaatatttttcctgtgtagctaatatccaactattttactttcccatatcctgcctttttcactcagctctaaattatgatcctagtcccaaatcatcacatattcttcaataacttaactagtccatatggccaaacattgtatgtttccaatttttccactgttataaaggttgctgttgtgagttatcttagtgggctaaactccgattattcctctaggaagaacatggaatgatacattcttctaaagaaatgttctgtgtttctatgctcttccctctactaggaggcacttgaacggagtggttgagagttgtaaaaacctatttttatttatttatttatttttgagacagagtttctctctgaagcccaggctggagtgcaatggcatgatctcagctcactgcaacctctgcctcctgggttcaagtgattctcctgcctcagcctctcaagtagctggggttatagatgtccaccaccatacctggccaatttttgtagttttattagagatgaggtttccccatgttggccaggctggtctcgaactcttgacctcaggtgatccactcgcctcggcctcccaaagtgctaggattacaggcatgagccaccgtgcctggccagaaaaatctatgtttgagtcccagctctctgctgatctacaactatgtaaacttgggcaagttatgtcccctttctggcccttgcatacttacctataaaacaaggctaaagtaatatttactacctcaagggttgctgtgaggattaacgatgtaattactgtaggtagaggtatcttagtccatttcatgttgctgtaaaggaataccggaggttgggtaatttataaataaaagaggtttatttggctcatagttctgcaggttatacaagaaacatggtgccagcatctgattctggtgaggggcccaagaatcttacaatcactgtggaaggtgaaggggaacagacatcacatgtcaagagagaggaagagaaaagaggaagatgccagcttctttaacagccagatctcttgggaattaagggtgagaactcactcaatcctgcaaacatggcatgaagccattcacgagggatctgctcccatcatccaaacacctctcaacaggccccacttccaacactggggatcaaattttaacatgagatttggagggaacagatgttcagaccacatcaaaagggcttagcaccttgttattaggcctagaaagcatctcccccttctcctgcctcttgaccaccatatctagcttcagtgacactccttttgtgaaatctctgatatctgcgtggttaaaattatgctcttcccccaacctcttttttttttttgagaaagagtctcgctctgctgcccaggcaggagtgcagtggtgcaatctcaactcactgcaaacttcgcctcctgggttcaagcgattctcctgccttagcctcccaaatagctgggactacaggcacacaccgccacacccggctaatttttgtatttttagtagagacagggtttcaccatattggccaggctggtctcgagctcctgacctcaggtaatctgcccaccttggcctcccaaagtgctgagattacaggcgtgagccaccgcacctggcctctttccccttttttaaaaaaagaaggcgaaattcacataacatagcattcatcattttaaagtgtacccttcagtggctttatgtacattcacagtcttgtgcaaccatcacctctagatgccaaacattttcatcatcccacaaggaaaccacttacccattgaccccttatccacagtagtcactgtacttcaaggtttcccatatcccatatccagcgtggctggatccaagggatcaaatgccatcagtaggactcagtttttctgcatctacttgtgttggcttcactctcgggcagatgctttccatatggcaatcccagtggctctaagcttacattagccatcaggtagcaatcccaacagagagagatcgtttcattagaagtttcaatggaagtcatgggactgagtattattgcctcaacttggataatttgcccatggctgaactgattaccatggtgggggagaggggaagaggtggcggtagaatattctgattggccaggttctgggtcgtatgttcattcctccaaattgcattcagaaaatgggtgctggatggggcaaaaaatcaggtgtcattcaaagttcactaggcttagggagctgggctcagaggccagaggcctgatcttgatcttgtcatcacttagcaaatctcctggccattcaggccttcacacttcctgtctgtaaatgggtttatcaccactcattcaagtcctaattattaccagcgctgagaaaccaatactttctttttccatctcgcttgtgtaatttcttcggagaagcatttggatggtctctgaaccatttttaccctgagaaatgggacttaggaaattatgcagccacattttatatccattctggtcatttcagtaattggttctgagacactatttccccgagcaccatcccaagtataaactactatttccatctgtgttactggaggaaactggggaaagacatttgtgggttttttcccccccaggccaaaaaaaaaaagcaaacaaacaacaacaagaaaaactaaagtagagcccaaaaccaatttgttggttcccagcttggcttaggcaccattctaagcatattccactagtccctccatctccaaactagtcattcttgggagctgacctacttagtgcacagcaaaggaaataaacagaaatccagcaagtccatcatttgagaggcccatgctgatgactcagagaatatataaaatggcaggttggccaggtgtagtggctcatgcctgtaatcctagcactttgggagactgaggtgggtggatcacctgaggtcaggagttcaagaccaggctggccaacatggtgaaaccttgtctctactaaaaatacaaaaattagccaggtgtggtggcacaatcgctggaacttgggaggcagagactgcagtgagccgagatcgtgccactatactccagcctgggcaacagagcaagactccatctcaaaaaaaaaaaaaaaaagccaggttgttttgctcttaatcgggttacgtttgaggattcttttggttctaggtgaccaaaacccactgggttcagccaaaagtggatattgttgaaggattctagggtgtctcacagaacacagggccatggttccactggaattcaggaaggggatagagtccattgtgaatcaaggaggtccctcccaccacctctacctcttgactgtttttctccatgtctcctctattcttctatctcatgggagagtgacagaagtcaggttgagactggaatcttaatctcagcaccaaaagctcagggaaggagcctattggtccagcttgggccagatgttgacacctgatccaatcaaatatggagaggggatgtgagttccattgtatcaacatgatcgtgttagtggtccagaaatacttctgagggaaaaaaaggtgtatgttacacagtgatatcaattaaattctaaactatagtgaaatattattgtcatttccacctcttttaaataaatctgagatggtctaacccctagcatagttcagtttctgggtctagattactggggtttgaatcctggccccaatatttgctgtgtgatcttaggcaaattacttaacctgtctctgtgccttcgttttgtcatctacaaaatgggtataataatattacttacctgacagcatggttggagccattaaatgtgttaatgtaagtaaaatgctcagaactctgcctggcaaatagtaaagatttaacaaatagctattattattactgtaaagttcatttcattatgacagattgtttttcagattattcaaaatatagaagatgtttaaaagggaatttctatgataatgggaaaatagggctgaataaccattactaagattgaatatatcattgctattgcccttgaattctataatttgaattcatattatttgaattctagacggtacttttgatttataaccttaaaagctttagtaagggtttcttctaaacagccttatataaaataatagcaattcttgccatcttacctagcaggaaaaaccaattgttttatcaagtttgccagcataagattgaaatttaaagcctttaatatcttagtttataaaagacaagttacagaatgtctctttcctggatgtcttagaattacagtatcttttagggcaggagtctgtgaacctttgcttaaaggactcatggtaaatatttttgtctttgagggccatattgttaaaggaaaggggtcccgatccagaccccaagagaggattcttagatattgtgcaagaaagaactcaaggcgaatccatagagtaaaatgaaagcaagtttatttattaagtttcttaagttattaagaaagtaaagaaataaaagaatggctactccacagccagaacagcagcttggactgctcaactcataatgcttaacagttttttctaaattatatgctaaacaaggggcgaattattcatgagttttctgggaaagaggtgggcaattcccacagctgagggttcctccacttttaagactatataaggtaactgacattgccatggcatttgtaaacagtcctggcgctggtgggcgggtcttttagcatggtaatgcattataattagtgtggaatgagtagtgaggatgaccagagatcatgtgcgttgccctcttggttttggtggcttttggccagcttctttaccgcaacctgttttatcggtcaggtctttgtgacctgtatcttgtgccgtcctcctagctcatcctgtgacttagaatgcctaacctcctgggaatgcagcccaataggtctccgcctcattttacccagcccctattcaagatggtgttgttctggttcaaacgcttctgacagtatggtctctgtcccagctactcagccctgctgtaacacaaaagcagtcatcaacagtacctaaacaaatgggcatggatgtgttctaataaagctttatttatagatgctgaaatctgaattttttgcagttttcatttgattccacgctgaccccttgccccccgtccaaatattcacaaatgtaaaagccattcttgtctcacaggctgcacaaaaagaagtgatgggctggagatggccttggggccatatttttcataccctgctttaggagacagtgcattagcattctgacagcaggcaggggaggtacaagatgactgtctactgcctcttgggttctaacaccccagatgcatgttgaccccctgctgcttctcatcatgcgtttctcttaaaagatacatagtatttgtggggctgggcgcggtggcccacatctgtaatcccagcactttgggaggccgaggcgggtggatcacgaggtcaggagagcaagaccgtcctggctaacacagtgaaaccccatctctactaaaaaaaaaaaaaaaatacaaaaattagctgggcgtggtggtgggtgtctgtggtcccaggtaccccggaggctgaggcaggagaatggcgtgaaccgagatcgcgccactgcactccagcctgggcaacagagcgagactccgtctcaaaaaaaaaaaaaacaaagatatatagtatttgtgtgactttcttggttttgtgcaacagaaaactcaacccaaactgcatatgcaaaaaaaaaaaaaaaaaaaaaggaatgtactaaccggggtttctacactctaggggtggttgaggcaggagtccaaagtctatctgtttatccctcagcttttatcccctccatgagggctttgttcttaggattcagggtttcttttcccccaggggggttcacagcaaagttctgggtctgactacttctggtgtgtatctgatcctatatctatctgaatctgaacgggaagggaacacagtgagcaccttaggccacacctgggtagggtaagccccattaaatttgcaagtcctgggagcggtggtgccagttggttccccaaaggaaacaggtcctattacctaagaaaggtgaatggatactgggaggcaaatcaacaaatgtccattgcacatgaggacatcacactgtgacatttagaatctaaatgctctgaacaaaatgtataggggaccttccaggaacgggaaattgctgttcctaccccctctttttggagaaattgctgttcctcccattggcaaaattcccctcgcaggttccagcttctttctcttagaacagaccttctggtttggcaagcccagtcccacatcgaggtttagttctggacttctgtgcagggtcatggcactcgcttgattgaaattttgtttggggaagcaatgacctgaagagcttacagcctgggtcaaccactcaccactctcaggaaaagcagacagagccaaactttctagctgggctcaaaatagctattttctgacgtgggtcctccatgactcatggtggagttttccaggctcgaggggactgttgacatttactctgctcctcccacgccacagagtctaactttttctatcttcccccaaacataactcattacctccagtttatcccatgtacacttctttttcaccccagttttcttttattttcagcgatccattccagatccaatatctttttttttgagatggagtcttgctctgtcgcccaggctgcagtgcagtggctcgatctcggctggctgcaagctacgcctcccgggttcacgccattctcctgcctcagccttccgagtagctgggactacaggcgcccgccctcatccggctaattttttgtattttttgtagagacggagtttcaccgtatgagccaggatcctctcgatctcctgaccacatgatctgcccacctcggcctccccaagtgctgggattacaggtgtaagccacctgcacccagccctccagatccaatatctttttcctccatcctttgccaaaccaggacttcagcttctggttactggtgcccacttcaagagatgccaggcagggaactctcaggacacataccaggcctgcactggcatatgtattttttggagacaggatctctgtcactcaaaatagagtgcagtggcgtgatcatggcccactgcagcctttaactcctaggctcaagtgatcctcctgcctcaaccttctgagtagctgggaccactggcatatgccaccacacctagctaatttttcaaaattttgtagagatggggtcttgctatgttgcccaggctgatcttcaactcttggtctcaagcaaccctcctgcctcaacctcccatagttttgggattacaggcatgagccactgcacccagcctcggactgctactttagaccccactttcttgtccaggtgtgatcctgggtgcgtgtgcccagagacgccctggctacctgggattcatccatcaaacacctggtcattcagccaattctgtgcgaacagcaccttcccggctgtcccaccctctgcaaagatctgtgatgctggaaagttgtgtgtggctaagtcggaagaagtgaagttcatctgcataagtgcagtagtgtatttattgatttttattcttattttttatttttatttatttatttgagacagggtcttgctctgtcacccaggctgtggtgcagtggcatgatctcagctcactgtaacctccaccgccttctgggcttgagcaatcctcccacctcagcctcccgagtagctgggaccagaggcacacccaccatgcccggctattttggtttttgtattttttgtagagatgaggtcttgatatattgcccaggctggtctcgaactcctgagctcaagtaatcttcccgcctcggcctcccaaagtgttgggattacaggcgtgagccaccacgcccagtccagtagtgcatttactgatagcacttactgcagctattttcttttattgcatttactgcattcctgctatgtcccaggctttgcacacattagtaggcgttcgatcctttaacaattctttgaggcagtagcaggtcttcctatttctatacttgctcccttagtagatcacactctcatgggaaacacagtgacttttttttttctttctttctttttttcagacagagtttccctcttgttgcccagtctggagtgcaatggtgagatcttggctcactgcctcagcctcccaagtagctgggattacctgccaccacgcccagcctgattgtattttttaaaattaaaattgaaataccatcaataggttgaccactaggactaaaatccaaacttttcagtgtggcctataggccgggcatcatggggccacttcctgtctctccatcttggaacaccccttcccttcctcattttgctccacccacatctgccttttctctttcttttagagacaggatctcactgtgttgtcacctctcacagcttctgcactcgtggatcctctatctgaagcattcttccccctccgtcttcccaggccagcttctgctggtcattcagtgtcagctcaaatgccactttctcatagaggtcttctgtgaccccgctatctggaggagtccccgggatcaatcactgtctacccccgtaatggcattttactctcttcctagccctgtccacctaaatgatgttgtttgtttatcttttggcttgctgtctgtcttcatcaggaggatggatgtttcatttctgcatgcctagctcctagaatattgcctggtgtgtggcgggcatgttgaataaacaaagagcccccaaatgacataggaggccatgccatgtgccccagtccctgcagaggagcgaccatccaccagcagaccctgtgtctttgaaaggaattccagagagagtaaaaatcagtgcctatgaaaagtatcccaactggctgcaccattgcctagcttttgtgctcagtgtttttggttttgttttttcgacatcattggcttttaaagccaggtcaacctttggacttgaaccctcaggttttgcatctcccgctgcactgctgggcagtcgacccttcccaaaccaccagttctagctgagacacacacgaggttctggatttttgctccaccagcaggtgatcctcttcatcttccattgcaggcatctttttctttaattataaaaataacaccatactccactctcaaggaagcactcataactccctaccctataagtgtgggctgtgtatagtgacttccttccaaagaggaagtgaaaggagaaactttacaatggagaaacctggcagacactccctcagccaggggctcaaggtcagcatcaacagtgccaactcatcttgatgggatgtaccacggatgtgaagtgatgagaatggtggccgggcaccatggctcacacctgtattcccagcactttgggaggctgaggcgggtggattacctgaggtcaggggtttgagaccagcttcaccaacatggcgaaaccttgtctctactaaaaatacaaaaactagccaggcatggtggcacacacctgtagtcccagctactcgggaggctaaggcaggagaatcgcttgaacccaggaggcggaggttgcagtgagctgagatcatgccactgcactccagcctgagtgacaatatgagattccatctcaaaaaaaaagaaaaaaaagaagaaagtgatgagaatggtgacttacctctgcagtcttctctccaaactcacaacttgtctcaccatcagaaaaactcaaaattaaagggtattccactacaaaatacctgtgcagtaccccttaaaactgtcaagggcaggctgggctcatgcctgtaatcccagcactttgggaggctgaggtgggcagatcacctgagttcaggagttcaagaccagcctgaccaacatggagaaaccccgtctccactaaaaatacaaaattagccaggcgtggtggtgcatgcctgtactgccccctactcgggaggctgaggcaggagaatcgcttgaacccaggaggcggaggttgcagtgagctgagatcatgctactgcacctgagaaactgtcacagtgtagaagagtctaagaagacacaaggactgaatgtcatgcactgtcctcgatgggatcctggaatggaaaaagaacattggcggaaaaacaaggaaatctgaacagagtatgcattttaatctttttttaaatcccctaaggatttccagtactgatgctttgcctttgtgcttgagatccctgtttagagccacatctcccttctggtgtggattttcagtccgacatgaatgcttccagatttgcttccttccttcttctgccatgatctgactctccctctgacttcacattgaactggacccgttcacgcctgcacacatcctgtttttcccctggctgctcttccctgcgtcccccctccgcagaccaccctcattcagatgaggatatatcccaccctatttcttgggcttacctttctgaatgaaaataatgttcctggtgcaatttatctctcctgtcaaatttccagcctgcagggaattaaatgaggcacatgattttcaggctaagcagtttttaaaaactgaaatattactttagacaggcccaatttattttcctctggattctcatcattttaaccccgccaagcacatggttttaagcagctccatctgctcctctaaccatccttgcgtgacctgggcccttgactgacttctgaattggtttgtaaattggaagaattagggagtcggttaagatgcatgaatcatagctcaggatagatttataattgtctgttttcatgaactcattctgagattgcagggatgggggatatttcagaacaaatggaccttgagtaacagaatgaacctacagaagtgccgaaaaagatttgttgtttatgcaattttaaccgggcaattgttgttattataggtttatcaatttccacaattttaattccacagccctaatgatttgctttgaattaggaagtatatactttattctctcatatggtcccaaagggccttagaaagcaatcggagcccttctgcttgtcattggaagaaatatgacagcatggtttggtgattcattgaaggtcactttgaagtgttggggagaggacactgagtaatgtaaaatgacattacaatttgttaaataatttgccggaactcttgtgtcatctctttcaaagtctcaccctggaaataacacacacgtaattcaaatgcaatctttctggaagtcccacctgggaactgcagtcccaatctgtggcaaagtcttgtgaatatccttaatgtgataaaactttgccttagacggagtttgctttttggaataaccaaagtcattctgggccaaggtgtttgaataaagtggttgatcaaatgaaatttaatgtaaagttattttaactgcttttcttgagtaacgcataaactgatttgaaagcaacaaagaatttgtttattactacctctccttattccagaaaggacttaatgatcttattggagccttaaaaaagttttaaaaggctcaagaaatgttggtaaatttccttttttttatcttttttttttttttttttttttttgagaaggagtcttgctctgttgcccaggctggagtgcagtggctcgatctcagctcactgcaatctctgcctcccgggtttaagtgattcttgtgcctcagcctccagagtagctgggattacaggcatgcgccaccacccctggctaatttttgtatttttagtaaaggtggggtttcaccacgttggccaagctggtctcgaactcctgacctcaagtgatccgcctacctcggccttccaaagtgctgggattacaggtgtgagccatcacgcccggcctaatttacttttattattattattattattgttgttgtttgagacggagtttcgctctgttgcctgttgccaggctggagtgcagtggcgtgatctccacctcctgggttcaagcgattctcctgcctcagcctcccaagtagctgggactgtaggcgtgcaccaccatgcccagctaagttttttgttttttgttttttgagacagagtctcgctctgtcacccaggctggagtgcagtggcatgatcttggctcactacaagctccgcctcccgggttcacaccattctcctgcctcagcctcccaagtagctgggactacaggcatctgccaccacgcctggctaattttttgtattttttagtagaggtggggtttcaccatgttagccaggatggtttcaatctcctgacctcgtgatctgcccacctcggcctcccgaagtgctgggattacaggcgtgagccaccgcgcctggcctacttttattatcttaatatcactcttctcatttctcttctctaagcctaatattagtatttgtggacattgcaggtgggacacaagacctttggtgcttctcatcttccaagagggcacagaatgggatggtgtatgaggtgggatattcccagccaagggagttctgggagggaggtgaagttggggcaaagaattcccatgggctaatgtcctctgtgcttccccaaccctagttccagctgatgtggaattctgagtttggctgctttttcttttgttgatggtggtgatggtggtggtggcaatgatgatgatagtgatgttgatggtggtggtggtggtgatagtggtgatggtgatgatgaaaggggtggtaatgatggtggtgatggtgatgatgacagtgatcgtgatgatggtgatggtgatggtggggatagtaatgatggtgataatggtgatagtgataatggtgacgatgacagtgatgtgctagtgatggtgataatgacagtgatggtggtgatagtgatagtggtgatggtgatggtaaagataatggtgatagtggtgatgattatgatagtgatagtgattatggtgaggatagagacagtgattgtgataactgacattcaccaagtcctcactgtccttatgatgtaccaggcaccacattaagagccttatatacgatctgtcattcaatcctcactgcatccaagggtaccctctattattatccccagttaacaggtaatgaagactgaggattgggaaagttacataactcacttaccagccacacaactagctattatgaaatgaacaaatattacaagctaaggattaatagacccactttacaagggaaatttttttttttttttgagacagtcttgctctgtcacccagcctggagtgcagtggtgcgatcttggctcactacaagctccgcctcccgggttcacgccattctcctgcctcagcctcccgagtagctgggactacaggcgcccgccaccacgcccggctaattttttttatttttagtagagacggggtttcaccatgttagccaggatggtcttgatctcctgacctcgtgatctgcccgcctcggcctcccaaagtgctgggattacaggcatgagccactgtgccaggcccacaagggaaattttttaaagtggaaactcagagaatttaaataacttgtccaggggcacaaagccaggcaggggcagagccaggcaggggcagagccagcctttcaccattcaccattgctggctttgaacatgaagcaaggggccataagccaaggaatgtaggtggccaaggaatgtagaagctagaaaaggcaaggaaactcattcttccttagagccccaagaaggacaggcaatcctgctgacactgttaccaaaacaccaggggattcgtctaggtcctgctgctcactgcacagaaggccgacactgagacaacaattattgctaaggaaggaggctttactcaggtgttgcagccaaggagccagtaactcagtctcacatccatctccctgaccaactaaaatcaagggtttatacagcagggaagagatgtaacaatgtgtaacaaaacaggaacttgggacgggcaaggaagcaatcccgatgaatgaggggtctggcatctcattgtctggatgctgtaatctggtgagtttcagttctttgatacttatttgagaggcaaggaattccctcctgaggaaggaactcagataaaacaaactttaagtttcaagagttaagaccagaaaggtcaatttctatgtttatcaagaaagaaaaaaactgtctatgggactacttgtgttggtttcaacaccctgattttcacgtccgttgggcctctgtcctccagaactataataaatgtgtgttgttttaagccactaagtttgtgtttatttgtaactgagacacagattggcatttttttccactgtcacccctcttgccttgtatcatcagttgttagtatttgttttagctggggaggcagctggagcatgaagtcaacaggaacaatgatgatctgcagggaggaaagccctaggatggcgggataatccccattgtgccccctcatcattagccacagtacttggctggcatttgagcagagtggttatcacagcagcgttcactctcctgcccccgggttcctgttcttccctctcttcaagagcactcaatgcatatctctccaaaccagtgcttctccacctttaatgtgagtgataatagctaacattcagcacactgtgctcaatgtgtgaatcccctcacttaacctccataccaacccttgagatagatgttatcattatccttcccatttcaggaaactgaggcatagagtgtttaatgaagaatcacctgcttgaagggcagcttgctgggtctcctccagggagattttgattcagtaggtccaggagaagcccaggtagatggattttttttttttaatcacacctaggtaagtctcatacctgtgccctgggagcacaataaaaaaactctgggtttaggctgtgtgcagtggctcatgcttgtaatcccatcagcttgggggtctgagatgggaggatcgcttgaggccggtttaagatcagcctgggtgacatggtgagactccgtctctacaaaattaaaaggacgtgatggtgcacacctgtagtcccacctattcaggaggctgaagtgggaggattgcttgagcccagaagcttgaggatgcagtgaggtatgatcacaccactgaactccagacttggtaatagagtgagaccttgtttcagataaaaagaggaaaggaaagaaaggaaaaaagaaaggaaaggggcaaaaggaaatgggaagggaagggaagggagaaaggaaggaaggaaaaaagaaagagaaaggaagaaagaggaaggaaggaagggaagatggaactaaggaaggaagaaaggaggaaagaaagaaaaaggaaggaaaagagagaaaggaaagaaggagaaagactctgagtctaaacccgtggttttcaacaaagggtgattttgtcccccaggggatacttgccagtgtctgaggacattttgggttggggagaggatgctactggcagccagtgggcagaggccagggatgctgctgcacagcctacagtgtttagcacagcccccagcacaaagaagcgtccaactccaaatgtcaaagcactcacaggctatggagcagcagtgagatgaagctcttgctctagccttggctcctgcactcagaatgagtcttcagatgttctcagattacacttccagaggattaggctggaatttgtctttcttgtgaaagaaactctttgtctcaagtgttgggtcctcccaggattcctccccaaatgggctatcttagtttctcctctactcctcaatctcacctcttcaccttcatccttatttcctatttcactgcaaaagtcaagggcccagcctggccaacatggtgaaactctgtctctaccaaaaatacaaaagttagtcaggcgaagtggcaggcacctgtaatcccagctacttgggaggctgaggcaggagaatcacttgaacccgggaggtggaggttgcagtgagccgagatcacaccactgcactccagcctgggagacagaatgagactccatctaaaaaaataaaaataaaaaacaaaaaaaaaaagtcaacggcatcaaatgctctcctctgctccctttgtcatttctttgtacttggacctcttagatcttggacttctatgaggtcacagaggaagagcatgtttccagaaagaaattcctacaatcagccagttctgcataatcttgtggttcacgagaggggaaggaccacagcttctccttgagtccacctgggaagggcatctgtggacaccttctctctgcctccctttccttcctcccagttccttcctagagggatggtgtttgatttctgaggccctggacatttcttccagctcatcattcaggttgttcagagcatttggaagacgagcttttctcttgccaacactgaccgcctcttgcgggaagatgtcgcagcattattatttaataacccgtgtctttcttcagctcatcaaagaccttccagctccagataaggagtcggggtagggagtaaggaaacaaagggatgagggtacaggaaaatcccagctgccccttatcacacaatcaatatattcaatcaatatagttaatagcaatgtgccaatgtcagtttcttggtaaagttaacaaatagtggaaattgagtgaggggggtagaggggaattctgttggctctttgcaacttatcactgcccatctccagttttctggtgcctttgctcagatgctgctgtggagtcccctccacagagatacctgtgtccttctccccaccttcctggctcccaacagactacactgcctgagagagctgaagtcaggcattcattctgcaggggattctgggtcacagctgagccagtcctattaggatttagggggcagccgacctgtggggcctgcaccgcacacactccttctaagggtttcctcacagtccctgctgaaggggagggtctcgtgtgacctgtggctccacccaggttgaacgtgctgaggccctgaccaaaggcagggccacccataggctgccaggggctggaggtgggacgagagggtccatcagaagtcctttcatgagagcagttaagagggaagcagaagagtcctgaaatggagaaacacctcagggagacagaatctttgaggaaggggaaggtatcagggagaaaagaaagaaggagatgaatggagggtcccaggatggtgaacaatgacttgggacttgggagcacttgaaatgtggccattccaaattgagatctgttcttcctttatttagttttgagacggagtctcactctgtcacccaaactgtagtgcagtggcgcagtctcggctcactgcaacctccatcccccaggttcacgtgatccttgtgcctcagcctcccaagtagctgggatgacaggcacgtgccaccagacgtggctattttctgtatttttagtagagatggggtttcaccatgttgtccaggctggtgtcgatctcctgacctcaagtgatccacctgcctcggcctcccaaagtgctgggattacaggcgtgagccaccgtgcctggcctgaattgagatctatttaaagggtaaaatatacatactggacttaagacttccatactccctccaaaaaggatataaaacatctcattcgtatctttaatatattgattacattttgaactgataatcctttagatctattggattaaataaaatatgttagtgaaattaatctcgcccatttctttttatctttttttttatttttaagagacagggtctcgttgctatgttgcctaggttggacttaaactcctgggctcaagtgatccccctgcctcagcctccagagtagctgagactacaggcatgtgcctccgcacccagctctttttacttttttttttttttttttttttttgagatggagtccgttctgtcacccaggctggagtgcagtgactcgatcttggctcactgcaacctccgcctcccaggttcaagcgattctcctgcctcaaccttctgagtagctacgattatagtcacctgccaccatgcccagttaattttttttgtttgttgttcttgttgttcttgttgagacagagtctccctctgttgcccaggctggagtgcagtggcacgatctcggctcactgcaacctccgcctccccagttcaagcaattctcctgcctcagcgtcctgaatagctgggattacaggcacacaccaccacacctggctaatttttgtatttttaggaagacgggctttcgccatgttggccaggctggtcttgaactcctgacctcaggtgatccaccgcctcggactcccaaaatgctaggattacaggcgtgagtgagccaccgtgctctgccacggctaatttttatatttttagtagagatggggtttcaccatgttggccaggctggtcttgagctcctgaccttaagtgatatgcccaccacccttggcctctcaaagtgctgggattacaggcatgtgcctccacacccagccttttttattttttagaatgtggttcctggaatgttcaaaattacatatgtggctagtgttctatttcaattggaccgcactgatctatacattctctcttttatgacccccgatttacagataaggaaactgagtctcaaagaggttagggcatttgccgaggtcggccgttagaaagatgccggaccatctactcatgtctgcttgacgccaatgcctgcgtcttcacgtgctgttggtgcgtcctcctgaattacttttgtgtcctttgacacgtcagatgtggctggggaaacagaaactcgcagaagttaaaaaaatgtgcttgaggtgccactggagaataacaatcatagccaggatgtgaagcctgtcagtttcctcagccgcaaattcttccatgtggggcgacctcacagagacgggatgtatgggacggcggagtgcaaagaaaggtatgatcgctcttgggggcccagtggcatcctctccacgaggcaggctgggagaaatcgagcagccaggagcttctgggttaaaagcagtgacttcatctctttgggaaacggtgactcattaaaagcaacgggcggcttcccattacattcacgttatagcaagaaggcgaggcacttggtgcatcccgtaataggatgcttgggggttggaatgagcttctttcctacatgaatgattgatgacaacgaagtctagagtgccaccaggagcctttgaaatgcattcagatattggctccctggtcatggggcgcagatctattcccttgggattcaagactctcttttgggtcaatagcagcaactggcttcttgacaaaaggctggagggggccccctctagattctcttctcagggcaggcatgggtctgttggagctgcggggctgtggtctcacctagaggggccaagagatggtccccatgaccatgagtctgtgttcttcaaatttgatggtggctccaattttattttctccccagtgttagtctggcttctttcagggaaaggcactgtgatggcaggaataatgctactgaccactctttgtgatgtctaggcactacaccaagcacatgttgtatacagttggtcctctgtatctgtgggttccgcatccttagattcaaccaattatggatggaaaatattcaggaaaaaaatccacaaattaccaagaagcaaaactttgagtattatgctgaatctgtgtaaatgaagtgatgtgtaggcatcctattagggattataagtaatctagagatgacttaaagtctacaggaggatgtgtggggcttctatgcaaatatttcaccctgttatatccgggtcttgaacatccaaggatttttttttttttgagacggagtctcgctctgttgcccaggctggagtgcagtggcgcgatctcggctcactgcaaactccgcctcccgggttcacgccattcttctgcctcagcctcctgagtagctgggactacaggcgcctgccaccacgcccggctattttttttttttttttttgtatttgtatttgtagtagagacggcgtttcaccgtgttatccaggatggtctcgatctcctgacctcgtgatccatccacctcggcctcccaaagtgctgggattacaggcatgagccaccgcgcccggccaacatccaaggattttggtgtccaaagggaggcctggaaccaatcccacacggatactgagggacaagtatatcatcccatttcatccctacagcagcaacttcatgaggcaggagttattagtcccattttacagaagaggaaactgagacttagggagatcaagtaatttgcccaggtcgcacaattagtgatagagccagggcttgaagcgacgtctgtcttaagccaatgacccctgcagattattagagcaactgttctccacaacagtgtaagcctcttgctagaagctcaggtccacaagggcagagatttttgtctgttttgctcattgctccttccccattgcttagagcagggtctgccacgaagcaggttctcaatgcatagttattaaatgtatataagagcaaacatatgttacagagaactttctgtatgcttgtcacttacatgaatcacctgtgagatgggtatgcttgttccccaatgttgcagatgaagaaactgaggtgcccagagtcactgatgcatggctcaagcgtgagagctggactctgaaacccaaaagcccatgcccagaaccactcccctctcttgccctcttcaagggctggcctggctccccatggtgcctgcacacgccaaccccttttcttttctctcttcttaattttaaatctattttgcaaatgtaacatctgaccattggtaaattgctaaaatttcaatgaatatagttaataacaatgcaccaatgtcaacttcttggtaatgttaacaatagtggaaatttaatgaggagtagaggggaattctttatgctctttgcaactcttcttaaattttttttttttttttattaaagatagtgtctcactctgtcacctaggctggagtgcagtggcaccatcatagatcactgaagccctcaaactcctggacccaagcgatcctcccacctcagcctcccaagtagctgggaccacagctgtgtgccaccacatctggctaatgtttacattttatttttgtagagatggggtcttgctctgttgcccaggctggtcttaaactcatggcttcaagtgatcctcttccctcagccttccaaagctccgggattacagacatgagccaccacatccagccacattttctagaaatataaaagtattaaaaaaaaaaagtatatttaaaaacccaaacaagagaaaaggacatattaggtgaaagttgattctcccccaacactgactccccctacctgagtccctcatgtccttccctaaatgcagcggctgtgacccaagtatattccaatgactgaaatgaatagcacccccacccccagcccttcatttaattgcctttgttatatgagctgggttgaaataatcgctcaaaatggctgattcctctttgagtaggacttaacccatggctgagaattgtccttctagcttgagttctcactgaagtttgaatgagaaccgtttgttgagggaccctgggaaccacatcttgccaagtcattttacatcctatccaacacaggtatgaggctgaccaaaacgtcgtttaagacctttccaacgcaaaggactggaattctattctacaacaggggatgggataggtacccccagtggtactttcatgcttgtaccatcaaacagcaatgaatttcccttcaggaaagctacgcattttctccccaattatcaacctttttgattacctaaaggagaaagccacaatttggtgctagctttgtctttaatgcccctagtacttgctgattcaccttgttaagaaagaaaattcaagcttcattctgaaccttaagcaggctatagtatttagcaagaatttaacagtattgctttgtttcctcaggtttattttcatggctattttctaattatgccaagtaagagtcatttattgtctgtggatgtcatgggacatttccgttagggagtttgagtaaaaaaagtcaatgtcggccaagcgcagtggctcacgcctgtaatcccagcactttgggaggccgaggtgggtgggtcatgaggtcaggagatcgagaccatcctggctaacatggtgaaacccgtctctactaaaagtacaaaaaattaggctggtgtggtggtgggcgcctgtagtcccagctacttgggaggctgaggcaggagaatggcgtgaattcaggaggcagagcttgcagtgagccaagatcacgccactgcactccagcctgggtgacagagcgagacgccgtttcaaaaaaaaaaaaaaaaaagtgaatgtcatgacatactgagtggtatatgacagagtacagaatatgtagctggggtaaattctatgcagtgttgagagttttggaaacactgttttgtagctcttttgaccttagagcatgggcattgggatcagatagatctgggtttgagtttcatttctaccactcattatagcactgccccaattgccccttagaactgatgtttacggtgttttgttttgtttgaataaacacaaaaatttaccttcctaatcttttgtttttcttttttcttttatttttgagacggagtcttgctctgtcacccaggctggagtgccgcggtgcgatctctgctcactacaagctccgcctcccaggttcacaccattctcctgcctcagcctcccaagtagctgggactacaggtgcccgccaccacgcccggctaattttttgtatttttagtagagacagggtttcaccgtgttagccaagatggtctctatctgaccttgtgatccacctgcctcagcctcccaaagtgctgggattacaggcgtgagccactgtgcccagccccctcctaatcttaaaattttagaaagttacattcattttacctgagttcctttctcaagaaactgacctctcggccttccagatagtattaaggaattgaaatttaccagatcactatatgtggacaatgagatgccagactcctcaaccatcacgattgcctaaccaaccacctgcatcctgttgaccagattctcttccttaccccttcctaataatttcccagaaaaaaaaaaaaagaatagggatgtatcacaatgtaacacatggttgcgtttcttccttgctacctctaattttagtgggttgaggagatggatttgagtctctttccatctcctcagctgcagcacccaattaaagccttctctggcaatactcattgcctcagtgattggctttctgtgcagcgagtagcaggatctagacagaacccttgatgttgctgcaacaattgagtgagtgagtttgaccaatcacttatgacctctctaagcctcattttattaatctagaaagagaggttgatatgagctagatcatggctccggtaaacacccaaaatgagcaagctctggggccagtactaggcacgtaaagttataaagcagaagtaaaggcagaggttgtgcagggcaccctgagcttaaattcctaccatgacccctgattggaaaagatgggctaggaaaggtatctctctggtccccagcagtttaaccctccaagcttgtatttaaactagaagtttttagatcaccagccctcatcctctatcacctccaccactcctgtccctgggtagccttactttttgttttgttttgagatcagtgattaaacctgctggtgcataccagggctgcccgggtgctcagctcttgtttgctggtgccaccgctcaggaagcatgcatctccctggggtggcatttggggatgggaagatggatttagctgcctcttcccccagaagtgactcagctcctggaagctcaatgacagcagtggcagttggagccctggggacgtctgtgccttcatgctttgctgtctccacacagcaagcaagctcttgcttggaagtgtgcgtgagagacttgttgtctctagccagcttgaaatgctcctcccgtttcttcccgtgatttgtcctcctcgtggagacattccttggcagctgtcggatgcctgccttctagttggaaaatgtgatcaagaaaggaacagtctagcaggctaatttctatcacacaagttcagactggaaagaagctgactgtgtgtgatattcatttattcaggtcctgtatcagcatttttcactctgatctgaagacctccttcattaaggtccctggacacaacaccccaacccaggtttatcctaatccttggaggtggaggcagggaattgtttcttaaacaacctccctagatattcaccttgcccactgatgtctgggaataactactccctctgtgtctaaagcaatacagtctactcagttttgttatgatgatgatggtacttacgtagggaggtagttcttacatgaatatggttgattacaacaagagctttggagtaagagagatcttgttttaaatctcacctccatcacttactccctttcctgagcctcgacttccccatctatgaaatgggataacagcactgaccacccagggctgttttgagaatcagataaggtaatgcacaggtgctggcatgtgataaatgctcgataaatgttagttattatcgttactgggtaaacctggctttcctaacttttaaactggagagattacagtataccacccagggaaggggttggccaactttttctataaagagccaggtagtgaatatttgaggcttcgtgggccagggagtctctgtggcaactactcagtttttgcaatgcaaaagcagccataaatgacatgtaaatgaatgagcgtgatcagtgtccagaacaactctacttacaacatcaagcatggggctgcgcttggtcccctggccatagggtatcaacccctggcctaaggtattgtgcagactaaatgagatgagattcattcctgtaatcccagcgctttgggaggctgagatgggcagatcacttgagctcaggagttgggagaccagcctgggcaacatggcaaaaccccatctctacaaatagtacaaaaaaagtcactgggtgtggtggagtgaacctgtaatttcagctactcgggaggctgaagtgagaggattgcttgagcccgggaggttgaggctgcagtgagccaagatcatgccactgcaatccagcctggaagacagagcgagaccctgccccaccaaaaaaaaaaaaaaaaaaaaaagatgaggtttacaatgagcccaacacagtgcctgatgcagagacagctcatggcaagaaaggattctaacgatttgtatctgattcaagctttaggcttcgttcctttctcttggggaagaaaaacatccttgagcaagacttttcaacataggtctttgttccattctttgccccaaatccaagctaagcacctggagcctggcaccaccgcctccatcctcccccggggatggaggtaaaatgccagttcctgggatgtgattaattctcttcgtcccacgcctcgccccagggtgtgttgccgttttcagcatctgtcccatggaaatcaggttgcccatctgaactgtgatgagaaaaacaaggatactcatatcgtggggtggttaactacgcactttcgcaggcacaaatgcattcagccctcaccaggaggctggattacgtggttaaggtcacgtggttgtggagtggaaggggggtggggggggagagagagagcacaagctgggtttgaatactatctctgcaatgatctggctgtgtgatgttgaacaagtcactttccttctctaagcctcagagtcatctcagtaaaatagagattaaatgagataatacacagaaagcctccagcacaggtaactattgaattcttgtacagaggaggaaagtgacgcaaagacataaagggactcattcgaggtcttgcggctgatgactagtgtcaaatgaggatttctgacactgcccccgcctagctgttttttgccagaccccacttcccccatgcacttccctcaccccctggtgactcccgctgggacccctgctgcttccagccaaggctgtgctctgtgtgcaggatctcaagcccctggagagagtgacattgttgtcaggaagcttgcaaggctgtggccattcattcttgtgggtttgtggcctcctgaagttcatgtgcatcttaaaacatcagaatgtgaccttatttggaaataaggtctttgcaggggtaattcagatcaggatccagatgagctcacattggattagggtgggccctaaatctaatgagacagaaaagaagacacacagagccacccggaggaagaacctgtgaaaacagaggcagaggttgaagtgatgctattacatccagtggcaaaaaccgtaattacttttgcaccaacctaatactacaaaccaaggagccagcaggggctgcaagggccaagaaaagatccatccctagagcctctggagagcgcgtgaccctgccaacaccttggtttccgacttctggcttcccgaactccaagagattaaattccttttgttttaagcctccccactggccatgaattgttatggcaccacgcttgactctgagataggaatgaatggggggtgtcggacttagaacagctgcctggaccagaggcagctgtgagggtcaaaaagcatgaatttgaagccagacctggactcagctctttcccttgccagcgctgagcctttgtttctttgcgaaaatgagaacctactgaacttgctggcttatggcgaggattaaaagaggtgatgggcagagcaggtgcggcggtcataacgagggcaattgcaagcatatattaaacgtgacgtgccggggtaattcatccctcacatctgttttgggtggtgggctcccttacagaggagaaacagagctgctgagaggttaaccaactccccaaggccacacagccagggaggggcagaactggaactcaaacccaggccatctgatctggtaaggctggtcttctagcttggtagcatcacagcacacagtagcactcagtattaattatctttttttttttagacgtagtctcactctgtccctcaggctgtagtgtagtggtatgatctcggctcactgcagcctctgcctcccaggttcatgtggttctcgtgcctcagtctcccaagcagctgggattacaggcacctgccagcatgccaggctaagttttgtatttttagtagagactggatttcaccgtgttggtcacactggtctcgaactcctgacctcaggtgatccgcccgcttcggcctctcaaagtgctgggattacaggcgtgagccaccgtgcccagccaatattaatatttcgatcctattcctccctccttccctcctttctcaagcctgtcctcactgcttcaatcccaggagccaccacagcatggtgtcagggacagtagtaggacccgaaattggattccaggggccttgaagcataaccagatggccccaggagatctttaggcagcacatcacatgagacatttcctacaaatcctctgcaaacagacatcgctccctctccccaagccacagcctgaggtggctcctctgacctctctccttcctgcttctctttgacactccctcctctccctccactgtgtctcccttttcacccttccctggcagaggctcggccaggtggccagataatcttcgggacccgccatctttagaaggcaaggaggaggtgattgtgaatctctccaatttcatgtttttcccattcacccacctccactctcttcctcccacttatacagttgttcagtgaccccctctccaacccaatagcagattctgcactatttatgttctgcacttatctatttcatgaagtattgttgctccctgaaaatataaaagaagcacacattgctctgagatgctgaactcaaagaggagaaaatcttcaataggctgatgactgacaggtcaaatattttcctctccccatataattgcttggccttttccattgcctttgttactgtttctcttgaaaactgggagttgtcaggccaggcacggtggctcgcgcctgtaatcccagcactttgggaagccaaggctggcagattacctgaggtcaggagttcaaaaccagcctggccaaaatggcgaaaccctgtctctactaaaaatacaaaaaattagccaggcgtggtgacatgcgcctgtagatccacatacttgggaggctgaggcaggagaattgctggagcctgggaggcagaggttgcaatgagcagagattgcatcaccacgctccagcctgggcaacagagcaagacttgctctcaaaaaaaaaaaaaaaaaaaaaaaaaagggggaattgtctcagagagaatgaagagaggccattcatttcaatgtgagaatcaactccagagaattaccttctttctgtctctttagcaaaataaggtgttttgattggtggaggggaagcagataattttggcacatggaacggacacatcacggggtaggtaatggaaaggaactccaatttactgagaatccaacgtctgctgaacaactcagggccgggagagtcccacaggtggacaaatgcatcaggtggactcctagaagagggcgctgttctatctagagatccaagcaggtagggactgacttcagggaagcctgcaaatcacagcgccctaaaccctgtgcacgtgtgcaagggccagggccccaggacatagaaggcagttggacaggtagaaacaggacaactttctctgggcacagtgactcacacctgtaagtaatcccagcattttgggaggctgaggcaggaggattgcttgaggccagaagttccagaccagtctgggccacatagcgagacctcatctctacaaaaagaaaaaagaagacctggtgtggtggctcacacctgtaatcccagcattatgggaggccaaggcaggctgatcacttgaggtcaggagttcaagaccagcctggccaacatggtgaaaccccaactctactaaaaatacaaaaattagctgggcatggtggcacgagcctgtaacccaagctactcaggaggctgaggcaggagaactgcttgaatccgggaggcggaggttgcagtgagccgatattgtgccactgcactccagcctgggcaacagagggatactccgtctcaaaaaaaaaaaagagaaaaaggaaaaagagaacaactttccaaatcatgggtataaggtataccaactttcattattccttgagtataaggaaaaagacagacgcccttgtagaactgaggtgtggggtgggctccatcttgggggcgggtgtggaaggaattagcagatacagatgatgtgatggtgtctcagggtacgccaaaaacatctcctgccccgagtctcccccactaccgatcaaaggccttgaatagcacatcacttatatctcagccattcaccctagaaacatagcccgaaggaaccctgtagatgtgtgcgaagttttcactttgagaacgttcttcactggaacattcttacggtgaaaataattcttacatttttttcctcatgattacagtggggaaaaaataggaaacaacctacatgtctgtggattgcttaagtgcttcgtgatacagccacaaatagaaaaccgccccgccttccatgctgctgccgaggaagaccatccaaggacaggcaggagcgctcaaggcatgttgctaggtgaaaagaacacataacgaaatagtgaggtcctaactttatattagaaaaataagacctacatcacagtggatatatgtatatgcatataatagtataaatatacattcacacgcatatatattaacattttaactgctaacattttagtggactttttcagtctttataaagtgtgtctgcccaggcgcggtggctcatgcctataatcctagcactttgggaggctgaggcgggtgggtcatgaggtcaggagttcaagatcagcctggccaacatggtgaaaccccatctcaacgaaaaatacaaaaattagccgggtgtcgtggcataaacttgttatcccagctacttgggagactgacgcaggagaatcactcgaacccgggaggtgaaggttgcattgagccaagatcgtgccactgcactccagcctgggcaacagggcgagactccgtctcaaaaaagaaaaaaaagtgtgtctgtgtatattacacatattatatatataaaaaaccacatatattcatatatgtatatacacacacatatttatatatccgtatgtatgctcacgcttgtaatcccagcacttcaggaggccaagttgggaggatcgcctgaggccaggagtttgagaccaaccttggcaacatagtgacacccccatctctacaaaaaaataaaaattaaaaagttacctaggtgggcctgtagttccagctacttgggagactgaggcggaagggtcccttgagcccagggttcgaggcggcagtgagctatgattgcaccactgcaccccagcttggatgacagagtgaggcctagtctccaaaacaaatgaaaaaatacttaacactacttggtagtagtattactataagataattatgataaaactttcttctgcctagagtcggctggtcttagaggcttagaccacagggcaaagtggtcgtggtcagggggagcagaggcttagaatctgggaccaggcaggagctgacaaggccttaatcaggcttttgtgagcccacttgtgagcctccactagccatcataacaaagttcccagccaggcgtggtggcctcacgactgtaatcccagcactttgggaggttgaggcgggcggatcacttgacgtcagcctggccaacatggtgaaaccccatcactactaaaaatacaaaaattagccgggcctggtggtgtgcacttgtaatcccagctacttataaggctgaggtgggagaatcgcctgaacctcagaggcagaggttgcagtgagctgagattgagatcacaccactgcattgcagcctgggcaacagagcaggactgtgtctcaaaaaacaaaaacaaggccgggtgcagtggctcacgcctgtaatcccagcactttgggaggccgaggcgggtagatcacaaggtcaggagatcgagaccatcctggctaacatggtaaaccccgtctctactaaaaaatatacaacaaattagccaggcgaggtgtcgggcacctgtagtcccagctactcgggaggctgaggcaggagaatggcgtgaacctgggagatggagcttgcagtgagccgagatcgcttcaccgcactccagcctgggcgacagagccagactccgtctaaaaacaaaacaaaacaaagcaaacgaagtaaattactttggaaaacacattttctggttcccaaagggtgtgctcacgaatacacatttgtggcacaggctgaagtctgtcctcaaggtgtatgatggtcgcagagcaaggctgtgccctggaaccatgtcagggtctgtcccatggtgcagccttggggtcctgatggttgtatttcctgtctcctgcacagatcagctggacatcatctccatggcggagacaaccatgatgccagaggagattgagctggagatggcaaaaattcagcgtctccgggaagtcttggtccgccgggagtctgagctcaggttcatgtgagtgttttggggatgtggccaaggaaagaagtgtgtggaggagagaggaaaacctaatatttgttgatcgtctactgtgtgccaggcactgagataaaggcattatgcacgtttttaaaagcctcatttgattctcaccaccacccagggaagtggatattgtcatctcctgttttaagcaagaccctgaagttggaattgaattcaggccaatctgactccaaaacctttgttctttctgtatcacccacggggaagaaagagggaagggaatgcagaggctgtaccctgtgctggtgtctttcacgagcgcacactctgctctcagataggcctgagttttttttaagcctgtcagcttgggcaggttacttggactctctgaatttcagttccctcatttctaaaatggggaaaaataacaagatggggtctctagcaacatcagagtcacatgggttgaacgttcattatctacagagcacagcattcctgaagagttgcaggtagtctttcaagacaaactctcatttaaaaagttgggctctgagtgtgtggtggtgcacacctgtggtcccagctactcaggaggctgaggtgggaggactgcttgagtcctggagttcaaggctgcagtgagctatgatcgcatcaccacactccatcttgggtgacagagagaggcactgtctctaaaaagcacaaattaaggccaggtgcagtggctcacacctgtaatcacagcactttgggaggctgaggcgggatgatcgcttgagcccaggagttcaagaccagacagggcaatgtagccagaccctgtctctacaaaaaataaaattagctgtgtgtggctgtgtgtgcctttgtcccagctactcaggaggatgaggtggggggatcggtttagcccaggggttcaagactgcagtgaactatgatcataccattgcactccaacctgggagacacagtgagagcctgtcgctaaaagaaaaaaattaaaaatacaaaaaatataaaaacatcaaattaaaatgaaaaagtttttttaaaaattgggcttttgccgacaaacagtgaaaggttacaagcaaaaccaaaccaaaccagaggttaagaggcaacctggctggaaaattccctgcgctgcctgtcagctcacccacccacccaccctccactggaagcagcaggaacatcaaatcttttaggcaggctaggcccctcccctattctttcactgatttttcacaacaccaagaggctgagtctgtgatcatcccattttgcagatgaggagactgaggcttgaagaaatgaaacagcctgcccaaggcctcccagctagtaaatggggagttagggttcagactcagctctttctgcttttaaaacacctcttctttataaatttttagttacttatttagataaagggtcttgctctgtcgtccagggtggaatgcagtgaggccgtcatagctcactgcagcctcgaactcctgaaagcccatactctcactgggacgttatatgaccttccctctcgccacataaaatgaactgcagtattcacagctgtcatttatccagccctttgcatgtgcaagaccgtgagctaaatgcttcccatgcataattccttttcacagacatctctgaggaaggttctagaacatttccacttcatggctaagaaatatcttcccttttgtctggaaataagctaaaatgatacgtgagcattcagaaacaatcctttcctccctgtgttttaaaaggaagacagagaggccaggtgtggtggctcacatctataatcctagcactttgagaggcggaggtaggtagatcacttgaggccaggagtttgagaccagcctggccaacagggcaaaaacccgtctctagtaaaaatacaaaaaatttagccacgtgtggtggcgtgcgcctataatcccagctacttgggaggctgaggcacaagaatcatttgaacctgggaggcggaggctacagcgagctgagattataccatttcactccagtctgggcaacagagagaaactatcccaaaataataataaaataaaaggaagacagagaacatgagtcttgcttttaagtaatcaagatcaagatccctttgtttaaaaaaaaaactacaaaaatacaaaaaatttaaaaatacaaatacaaattaaaaattttaaaaatatatatttatttttatttacctaatggtgctgctgcaggaacaatggttaccactgtgcacttactgacctttactgtgtgcgcgtgtgtgtggatatttgtgtggatgtgtgtggatgtgtgtggatgtggatgtgtggatgtgtgtgggggtgttcgtatgtgggtgtctggatgtgtgtgtatatgtgtattgtggatgtgtgtgtgtggatgtgtgtgggtgtgtggatgtgtgtgtgtggatctgtgtgtgtgtatgtgtgtgtgaggatgtgtgtgtgcatgtgtgggtgtgtgtgtggatgtgggtgtgtatgtgtgcgtgtggatgtgtgtgcatgtgtggatgtgtgtgtgggtgtggatgtgtgcgtgtgtggatgtgggtatggatgtatggatatgtgtgtgtgtatggatgtgcacatgcctgtcacttagcccaggcttaaggacaagaataactagcatttcttaagaggcagctctgcagtaagctcttgacttgtgatctcattgaatgtcctcatctagcccatgaatctgaccacttagggacaaatgtcaacagtagaccctaggataaatcaaattatctaaaggatacagaaggacctgagtgttgttaggacatagatcagggattctgtgacattttccaggggagggacccccttccaggcccccagatgtcttgctggaatggagtcctacagacagtattggatggtgatgacgctccccaaccaggctcagccttgtatggtgtgtagcttgcccagtggtgcacctgcctcatcaatctcagagatagacggtggacactaaggcaaccaggacaaaggacacagtatgctcagatctgcacaaagtcctcatccatcatcctcagccctccaggccaacaggctttgagccaaggccctgcttgaattcactttcttggctgttcctcagagatggtttttcccgaagctgtggggcttatcctgtgagtgtgtcctgttcttatctccattttggatgggaagtaatgggaggttacaaaatttgcctgatgctgcattagctaataagtagccaagctaggatgcagtctgactccagaatgtttattaagtgaatcagggaaggagggaagggagtgggagagaagggagggggagagggaggggagaggcggacaggggaagggagggaagggaggaaagaaaaggaggaaggaaggaagctttgagtataaactaccaagataattccttcaagtttataaactccatgagggcagagaccttatccaatttcctcacaacgtcttcccagcatttggaacaatgcctggcactgagtgtcatgaatatttgtcaaatgtgcaataaattattctttctcactccatccttaccccaacaatcctcttacacacacacacacacacacacacacacacacacgtgagacactcttggcacagagtaggagagaaaaaaatttcagaccctactgatcattttcaggctcaggcgaggaagctttaagtgacaggaatgtgacagccctgggctgaaagactcccggtggccgtagtgtaatagccgcggtgagatttgttttgtcacacctgctgcgaagtaatcaccttaatgcccatcagctgctgcagagaccatgtgagtcagcccctatttcatggttgagaatgtgtctcacttccaatgcttctcgcagcattaactcttttatttttatttcttgtgacagagtctcgctctgtcgcccaggctggagtgcagtggtgcgatctcggctcactgcaacctccgtctcctgggttcaagcgattcttgtgcctcggccttccaagtagctgagactacaggtgcccaccaccatgcccagctaatttttgtatttttagtagagacaaggtttcaccatgttggccaggctggtcttgaactcctggcctcaagtgatctgccctccttggcctccttgggattacaggtgtgagccactgcacccagcctgcattgactcttttaagcatgagtccgggggggactgcctgccccagccccaaagctctggcaccctcacatttagattatttcatgggcttcctttttctcagctgatttaacttgtcctttcccccaagatccacagcccctgcctgttcttcctcttttcctgccacgacagtgaggaagaagaggagggagatttccctactcccagggaatggtgagaactcgggagatgtgggatcagaggtcatcatcctggctctctgacgtccttggtctgtgaccttggacacatgagggagcacacagagttgctgtttcccgcgggcactgatatgccaccctgagtgctacgtcccctgcatgcattcaccccttaattttagcttcttgagtcctcgcaagaaccccaatagagtaagttctatctcttttattttatgaatgaggaaattgaggtcggagaggcaaagtgacttgttcgaggtcaccagctaggataaagtagtaccaggatttgaacccaaggtgtctgtctcgtgggggcagagcccttaaccttaagctgttctgttatctttattctcaatgccaggaccccttttctctttgccttactcttttacaacgcaaggacaaacccccgattagatgcccccagtcccacacttggtcttgtcttgttctgcaatgttgaattgtgtgtggtggaacttggacagattttactaagtcaggctttggacttttctgtaccattgaaactgacccaatagtcccatcatagatgttctttttttttttttttttttttgagacaagagtctcgatctgccacccaggctggagtgcagtggggcacgatctggactcactacaagctccacctcccgggttcacgccattctcctgcctcagcctcccgagtagctgggactacaggcgcccgccaccacgcctggctaacttttttttgtattttttagtagagacggggtttcaccgtgttagccaggatggtctcgatctcctgacctcgtgatcctcccgccttggcctcccaaagtgctgggattacaggcatgagccactgcacccggcccatagatactcttttggataaatacagaagttgacctttctgatcttaaagcttgaagccctcatttgtcttatctgagttatttcctcaggaagggacccccaggcctctcaaaaaatatcaaagaactgaaactcaccagattaccacatccagagatgagataccagacccctcattcatcatgattgcttccttgctcctcccgagttcctgttttcttcatgattgcttccttgctcctcccgagttcctgttttcttatacattgttacatttcttccctgctatgtaaactcctagttttagttggtcagggagatggatttgagactgagctcccatctccttggctgcagcacgcaattaaaatcttccttggcaatactcatcttgtcagtgatgggctttctatgcggcgagcagcaggacctagaccaaacccctggtgtttcagtatcaccatttctctgcacataaactgtttatttcagagaccaaaatgatgagctccaatgcagacagtcaaagtttgtgaagtcagtctgctgggaatgtgctgtagaaaaagaacccggttcccgtaataactcttaaggcccacaacagttggcatttacagaccccttattgtggacctaggcttgtgctaagccctttacacacatgctcacataacccacatcaaatgcttactaacagaaagatgcatcaggaaccaccccaacccaggacacccacttgccctgaatcaggcccaggaggtcaagttcacagaccagccataagtgagctcccagcaggcaggtgtgaactctgagtgtgctcctcactctgaatttccagtgtgtgttcccttgctgacttccctttgcttgacccctggtttccaatgtgcaaaatggcatttagagatctctttcttgaggcttggcaattttatcaactttactggaacagggcagtaacacaaaactgcctccggaaaacaggcagcaaacatctggcagataatgcttgaaacgcctgtgttttctcacttcttgaccctatgttccacccacctcctagtacctcccactgctaccccatctccctacccatcctgcccccatcttactgcaggcaagaactctcagaggctgtcaacaacctcagactcattttctcgccttccttccagcactgaatcacatcattagtttttaataattcttcttgcagcccctctggctcgcttcagcttttccacatctagtctaccaacccgctcctgctgtttatctgggtttcagataattaagtatctttggcctccacatggggcaggggtgtggttatcttccttttacacccgcttgctggattttcataaaaagggatagcatgccctgccactcagcttgctctgggcaaaagcaggttttaatcagccagagacagaactgcagcaggcagggaaggtaggcgtgcgaaggacatatttcaagagcacagcctttgagttccaatatttccagagcctgggcttgaaatccagtaacttcgttttattaagaggtaccaagtgtggtaaagaggacaggccctgggaacctggcagagattcaaaatggggtaatagtgcatgcattgtgttgaaaaccacacacacacacacacacacacggaaagtgtgtgcattgtagatagcagttcttttaaaacattttctatgctggctagttttctagtgttttattgttttgattcatataatcctcactatcaccatccaggcagaaaatatcacatagcctttattttatagatgaggaaactgaggcactgagaggtcaagtctcttgcccatggttgtacagtttccatgaaatagcattctaagtccagatgaaatgggaaaagttcccttgtccccctcgcagggtgtgtgatgtcggagtggctcgcttcttcagtgccccgctgctcaaacctctaggggaccatagagatgggccagttgtcgggatctgatcccacggcagtgtctaggggtggatgtttacaactcctgaagcttcagtgtgtgtgtgttacatggtgctcttttagttttgctatctataggcggcttgtgttaactagctcaattagaccctctacgttgtcccaaggacagagggctttctgtatcctgggttcttgccttggtgcaccagaagaatcggatcacacctggacttggagaatgagagcaaggttttattgagtggaggtagctctcagcagatgggggaagccagaaggggatggagtgggaaggtttccccctggagtcaggccgcccagcagcctgggcactcctccgactgcccaggccaaactccactttgttccgccagtagatggcctgccagcatctgtcatgtgctcttctgccagcgtgttcctcttgacgtcttcttgacatccagacgcttgtgtcttctttgccgatctgcagctcttgacgtccagcagcttgtgtgtcacctgctagggtcttggggtttttatagatacaggatgggggcatggcaggccagggtggtcttgggaaatgcaacatttgggcaggaaaacaaaaatgcctgtcctcacctaggactgtgggcacaggcgtgggggtggagcccttaccagggaccacaccctcctctacccagcacttcccttccttccttctgtagcatttaaagcgaccatgcccttcccttcctatcacctctcttgcatatcacagagtccatggtctcagtcatcaagctgtggggtctctcaactagctttgaattctacttcttaccaactgtgtggcctggagcaaatactttgtcctgtttcagcctcggcttccccatcagtacaagggggacagtgatatctccctgcagcatcatagcaagggatgaaaacagacacaggtatgaaattgggtggcccttcctaggtagtaagcaattcaaaattcccttctttcctttcattgttaacattgtgcttcgtgggagagtagggcatcagggctgcttatggttgtctccagagaattcccagaaaatattcctctccccaagagaagatgggattcactgtggtttccttgagatcctcttgggaggtgccaactctcttgagagtggctctcaaccattaagtgcaactctaccctggggccttgattttattatgatgattatttaagatttttttataaacctgcattttttcccctttaatgagctgataattctgaagtctgttaggaagagcttcaagccaagggcaaaatgaagcatgtgcgtttatgtaacttgacacatttcagccacattcaggagctctgcgtcactttagttgcacacagggttttaaatagcatcttccaggaacaggtcaccattgccggggccactgtacatatcggatgggaagagatgcccttaattgcagaagatctaagaagcagtttgtcttggacaaaatatacaagaagttggggtgtaggggagggaaaggaaggaagaagaaacggagagactaaagggaggagagaggagggagaatttctaagctagacttctgaatggaaggaccctcctcctgaatttctaaatgtactgggaggtggggaggaaggtgggaatctgtgttgattgaatggagaaatacatgttagtctgggcgcagtggctcatacctgtaatcccagcactttgggaggctgaggcaggtggatcacctgaaatcaggagttccagaccagcctggccaacatggcaaaaccccatctctactaaaaatacaaaaaaattagctaggcatggtggtgtgcacctgaaatcccagctactcgagaggcttgaggcacaagagttgctttaacctgggaggcagaggtttccatgagccaagattgtgccactgcattccagcctgggtgacagaatgagactctgtgtcaaagaaaataaataaatcaaataaatgttctgtacttgacaagctcttgctgctacgagttgcctttcatggtcagaacaagtttcgagaaggaaaatactctctagaagttccgtcttcctagaactgtattacattctgctcagaggaccacctctgaaccacctagactccattgggttgggagggagattaccatgtaagaccctggtgattatcaattttatgcatcaacttgagtgggccacagggttcccagatgtttggccaaagattcttcgatgtatgtgtctgcaagagcattggtggatgaaattaacatttgaattggtaaactgagtaaagcagactgccctccctaatgtagaggtgggtgggccccgtccaatcagttgaaggcctgactacaacagaaagggtgagtaggagggaactcctgctgcctgattgcttgggctgggacatgggtcttttccggcctttgaacgcaaactgaaacatcagctcttcttgggtcttgagcctgccagcctttggactggaacttaacaccgtcagctctcctgggtctccagctgccacctatagatcttgggacttcttggcctccaaaatcccatgagccaattccttatcataaatctttttccaggccaggtgcagtggttcacgcctgtaattccagcactttgggaggccaaggtgggcagatcatttgaggtcaggagttttgagaccagcctggccaatgtggtgaatccctgcctctactaaaaatacaaaaattagccggctgtggtggcgtgtgctttcagtcccagctactcggaaagtcgaggcaggagaatcgcttgaacttgggaggtggaggttgcagtgagccaagattatgccagtgcactccagcctgggcaacagagtgagatcccatctcagaaaaaaaaaaaagaaaaaagaaaagaataaagaaaaaacaaataaaataaatctcttcagtagtattggttctgtttctctggagaaccctgactgatagagccctttttattctcagaaattttcatttggatagtttatcaggttagcaaagacctagcaagttggataaaatgaaaatatagggaaattggccttatctctttggaaaacagttcattgttacctagtaaagatgaacaggtgattataacctgcagttttgctcctgggtctacccctggttagccagtagcttcatgtggctatttcagtttaaattaattaaaattaaatagcatgtaaaattcagtctctcggtagcctgagccatatttcaagcactcattagtaaataatggctagtggctaccctattggaaagcatacatttgtataggacatttctattgttgtagaacattctattcaccagcactgccctagagaaactacacatgagcatcaggaggcatgttccagaatgttcataactgcctcgtttgtggtctagctgtaccacagaatactatacagcagtgaaaaatgaatgagcaacaggtatgaacatgaaagcatctcaaaaacaagatgttgagcaacaggtttatataaagtgtataaaagtaaaaaatataggccgggcgtggtggctcacgcctctaatcccagcactttgggaggctgaggtgggtggatcacaagttcaggagattgagaccatcctggctaacacggcgaaaccccgtttctactaaaaatacaaaaattagctgggtgtggtggtgtatgcctgtagtcccagctagtcgggaggctgaggcaggagaatcgcttgaacccaggaggtggaggttgcagtgagctgagatcccgccactgcactccagcctgggcaacagagcgagactgcatctcaaaaaaaaaaaaaaaaaaaaactaaaaaatataattgttccgggcttcatatatgggtggtaaatgataaaaataaaaagcattaccacaagtttgtgatagtgcctacctctgagggaatgagaaaaatatgagggaatggggcacacggggccgtctaaaagtcacacacagatttttacttaagtaggatgttgggaaaataactgctttattattccataaaaataatataataataattctatgaagtatgaaataatagtaaataataataaaatataataaatcatattttattatattttattattattatagtatattttatataaattttactataaaaataaaacattttatgcacacttatatgtagtttgcacacacacttctattttttaaattgtggcaaaatatatataatatttactatctgaaaccatttctaagagtacagttctatgtcattaagaacattcatactgtgtgtaaccatcaccatccctccccagaatttttttcatcttcccaaactgaaactctgtaccattcaacactcactccccattttccctttcccctggctcctggtaaccagcattctgctttctgtctctgattttgatgactctacatacttcataaaacaggaatcaggccaggcgctgtggctcacgcctgtaatcccagcactttgggaggccaaggtgggtggatcgcctgagctcaggagttcgagaccaccctgggcaacatggtgaaactctgtctctactaaaataccaaaaattagccaggcgtggtggcgcacacctgtagtcccagctactcaggaggctgagggatgaaaatcacttgatacctggaggcagaggttgcagtgagctgaggttgtgccactgcactctagctcaggctacagagtgagaatccgtctcaaaaaataaaataaaaaaaaaagaagtggaatcacacggtatttttctttttggacacacatttctaaggggaaaatgctgagaaagacaggcaggggaaggtacagtatctgatatctccacttaaatgtctcaaagatacctgtaactcaatctgtccaagtcaaactcatgatccccccatctagtcccaatacccaccagccctagctcagcaaatggtcaagcatcaccatctatccatggaaatctcaaattccaaaattagacatcattcttgacccctcccaaccctccacctcatatattcagttcatcatcaactggtgtttgttttacctcctaaaataatgctcagctgtccatctttctccatctccatggccaccacccaggttcacatgcccatctctgtcctgcagccagagggattttctcaccatgtgaatctgattataactctcagatttaaacactgtcttagtccgttcctgttgctgtaacaaaattccttagactgggtaatttataaatagaaatttaattctcacagttctggagtctggctgggaagtccaagatgaagatgccagcagattccatacttagaagggctcattctctgcttccaagatggcgccttgcttctgtgatctccagagaggaagggcaccgtcttctcacaagcagaatggacagaagggcaaaaaggactgaacttgctctctcgagcacttttgttagtgcactgatcccacctcctaatggccctcaccccttaatactattgcattggaaattaagtttcaacatgaattttgaagagtcataaacatttacaccatagcaaacaccttccagaatttgttagcatgataaagcccatgagatcttgctggatctgctcacacctcttctccaacttcttttcttcatccattcctcacccccagctccctcccttacacacacacaccactcccttgggcctccttttagtctccacctccccaccccccgatacacacaccaggtcccctcctgccgtgggggcctttttgtttgtgatgttccctctgcctggatccctctcctcccacccccctctccttccctggtgctatgatctgaatgtttgtatcacccctaaatacatatgtcgacatctaattcccaatgtaataatatcaagaggtggggctttcaggaggtgattaggtcatgagggcagatcctcatggatgggattcgtgcccatgtaaaagaggcccagggtagcttgtttctccctttcactgtgtgaggacacagtgagaactcactatctatgaggaagaggtcctcaccagacactgaatctgctgacaccttgatcttggactttccagcctcttttaccatgaaaaataagtgtttgtttgtttgtttgtttgtttgtttgacggagtctagctctgtcgcccaggctggagtgcagtggtgcgatcttggctcactgcaagctctgcctcccaggttcacgccattctcctgcctcagcctcccgagtagctgggactacaggcgcccaccaccacgcccggctaacttttttgtatttattggtagagacagggtttcaccgtgttagccaggatggtcttgatctcctgacctcgtgatccgcctgcctcggcctcccaacgtgctgggattacaggcgtgagccaccgcgcccggcggtgtttgttgtttataagccacctaggctaagaaagggagaatggcagcccaaatggactaaggcacctgataaactctgtcccctcgaggactgagatctagggcatttctggagggacaccttcccagcacttccccagtccctgtcccattaccatccctgcaatcctttccttagaagccttttgtaaatttgtgttcattggtgtgagtgtatgttcaatatctgactctcctcctagatgctgacctccatgaggacagaggctgagctattttcactcccaaaaatgttgacggtacccagcacacagccaaactcagcgtaggcactctgagtgaagattgattgaatgaattaatgagggctcatcttcctgcttctcccacggtcacataatctcaagggttcccttccatgtggcaggtctgggtggtgagaactgcctggctctctgatggttagggtgaacagtgggtccattcataggaaggaacagagtgataatgcagctaagtgcgttattttcctgtggctactgtaacaaacagctgcaaatgtgttaaaacaacacacatttcttttatcttacagttctggaggctggaagtctgaaatcgatttcactgagctgaaatcaggtgttggcagagccgtgctttctggaggctctagaggagaagcctcttcctcattcattccagcttctagaaccgtactctttgcatttcttggcttgtgtttccctcctccatctccgaagccagcagcatggcatagtccagtccctctcgattgaggtcatcctgtcgcctttgctcttctgtgtcaaatccctctgtttttctcttaaatgtatgcctagcattccattattggaacactaagcatgtgggagttatttatatgctacttctcaaggctatcaccaggtctgatttctcaaattcaaaaaattgcaacctcaggcataaatgggtaggggcacttgtgatgacattgagggcccacctggataacccaggatgatctccccatctcaggaccccttaatttaatcacatctgcaaatttcctttttaaaaatatatatttttcagagacgaagtcttgctctgttgtccaggctggagtgcagtgacacggtcatagctcattgcttcctttaattcctgggctcaaacaatcttactgcctcagcctcccaagaagctgggaccacaggcacgtgccaccacacatagctaatttttgaattttgtagagatggtgacatagttcggctgtgtccccacccaaatcttatcctgaattgtaatcccataatccccatatgtcatgagagggacccggtggaaggtaattcaatcatgtgggtggttgcgccatgctgttatcatgatagtgagttctcatgagatctgatggttttataagcatctggcatttcccctgctggcattcattctctctcctgccgcctggtgaagaggaaccttctgccatgattgtaagtttcctgaggccttccaagctatgtggaactgtgagtcaattaaacctcttttcttctttctttttttttttttttttttttgagacggagtctcgcactgtcactgggctggattgcagtggctcaatcttggctcactacaaccaccacctcccgggttcaagcaattattcgcctcagcctcccaagtaactgggattacaggcacccgctgccatgcccagctaatttttttttgtatttttagtagagacggggtttcactgtgttggccaggctggtctcaaactcctgacctcgtgatccgcccacctcagcctcccaaagtgttgggattacaggtgtgagccatcacgcccagccttaaacctcttttctttacaagttactccttctcgggtatttcttcatagcagcatgagaatggactaatacagttgggatctcatcaccttgcccaggctggtcttgaactcctaggttcaagtgatcctcccgcctaggcctcctaaagtcctaggattagaagcatgagccaccatgcctggcccaaaatcccttttgccgtgtaaggtaacagattcataggttcattaggacatggatatcttcagggaccattcttcagtctaccatattgagtgaccacagcaattcatataagggccaagcccagagcaggagccacagtgtggcagcaacaatgacagagacggccctggtgaggctggggaaaggggaagatgacacactacatggggcaccctcatagcttcatcctgtgccgggttctcatcatttttttgaaatctcccaaaaaagaagcttcttagaaagacagggcaatagataccagtaaattgcatgtaccgtggcctggcgattaagggtttttccattccctttgcttatttctggaaagctgctgatgtgagtggcagcagagattgagaagggcttgtccctatcacgtgatggtctgaattgaataggataatgcttggctgagcctccttcccacattttccttcaaataaaataccaaccctttcttgacagttctaggacaggatgcccaaagagaaatgggagggaataaaactgcaagtgacttagcagagctgccttggtgttttgggtctacacaaccagattcccgagcacccccttaaggcaatatcctgacttacatatttcatgttatgtaattggctgctattcattgagccatcagttacttagatcttgttgtctcctggaattccagtctactgtgtctgtcctcagtcccctaaactcctcggggatctcaagttatattagatcaatccaagacattcctggttgggttctgccaaacgtggtaggatccctgttttgtttttttgttttttttgtttttttttgagacaaagtctcactctgtcacctgggctggaatgcagtggcttgatcttggctcactgcaacctctgcctcctgggttcaagcgattctcctgcctcagcctccctagtagctgggattacaggcacccgccactgctcccagctaatttgtatttttagtagagaccgggtttcaccatattggccgggctggtcttgaactcctgacctcgtgattcgcctgcctcggcctcccaaagtgctgggattacaggcttgagccactatgcccggccttttttttttctttttctttttttttttttttttttgagacggagtctcgctctgtcgcccaggctggagtgcagtggcacgatctcggctcactgcaagctctgcctcccaggttcacgccattcgcctgcctcagcctcccaagtagctgggactataggcacctgccaccatgcccggctaattttttgtattttcagtagagacagggtttcactgtgttagccaggatggtctcaatctcctgacctcgtgatctgcccgcctcggcctcccaaagtgttgggattacaggcgtgagccaccgcgcctggccagatccctgttttttcattactagatatcctggtcttggatggggttgctttctgataaatagacctcgtgcctggtaagtgtgtttacttgctccggattaaattacacctagatttacattctacctctgccatttataggctgtgcaatcttgcacaaatatcttaccttctctgagcctcggtggcctcatctgttaaatagccatgcatccagtatctcgcagggtggtcatgaggagtaaaagagatcaagcatattaagtgctcagtccagtgcctgctaccacgtaagtgctcattaaatgttactttcctttaccaccaggaagaaattgagtttggaaatggatagatacaggcataagtgtagacactggtttctttgtttggaagaggagacacaagagaagggggagattagagggtggaatgatgatcttttccatgtcaaggttgttgaaacgacgagagaagtctcaaggggcacctaagatttgtctcaaaatatctgaaggatattacgtggaagaggaagttcgtttctttctttttttttttttttcctgagatagagtctattgtgttgcccaggctggagtgcagtggttcaatcttggttcactgcaacctctgcctcccaggttcaaacaatcctcctgcgtcagccttctgagtagctgggaccaagtagcagcctcaggtgtaggggggcttgagcctctcctcactcctctctgattggtccaaatttgctcagtctgggccaatcagagtctttctcctgggatgcagagagattagcccaggtggatgatgagggagtggcaaaccgaagtctatgcataagcagagaaagccagtctttgaagggaaagaggacagagcgtctgcctcaagaataacaagagagacagtgtcctttgaaagcagagaaggaactcagccatgacattcccattgcagtccagatgaactgggtagtccataagatgttgcaccttgttcaaccctgcgcatcctttctccagacccttggagaaatacctcccaccccgtgttgccaccgcctagggaaatccaaaatccagctgtacaatgtctgtacatttccaggggcttccatcctcaagtcttctctgctcctaggcttggttccttgagtcctgtacctccatccaactgaatatgaaactcagatgcttcactggtttccataacaacagaataaaacaatgccctatcctactcccacaggtcatttgaggagcaatacaatgaggatcacaaaaagggtgtcattgatctcttcacagcagacagcttaaaaaccatgaccagtgacaatcgtctcctggctcaccatgtaactgtccctccagccccagaggactagccccagccacagccctgcaaagaccttgattttttttttaattgcaaaaaaaaaaaaaaaaaaaaaaaaaaaaagaaaaggccaggcgcggtggctcacgtctgtaatcctagcactttgggaggccaaggcgaaaccctgtctctactaagaaatacagaaattagctgggtgtggaggtacatgcctgtaatcccagctattagggaggctgaggctggagaatcccttgaacccgggaggaagacgttgcagtgagccgagattgtgccactacactccagcctgggcaagagagtgagactctgtcttaaaaaaaaagtcaatgttccagtaaagggcatcgtggtatccatatggccataactaggagaactagaaatccacatttgacattcctggttaacaagatctttttcaccaccctgtgccataaggcagtggggtggtttcctttttcttggccttttccacacacggggtccagtttcatcacctctttttctcttctcctttatctcagctccctccattccaaggaagacacttacttctcctgtcttatccacagcagctttgccctcttctaagaagccacggcaccaatttatgctgagctcttgcaagtaccaccccaggtgtttgtcaagccataattccaagcaaaaaccattatctccccaagatacatatgggtaccatctgtcaagatgctagcatttcccttcattttcttacacctttactaaactatatttttctcaagtgagcttgagtggatttctgttccttctagtctgtgctgcaatattctattaaaaatttaggctgaatgcagtggctcacacctgtaatccctgcactttgagaggcttaggtgggaggatcgcttgagcctagaagttcaagaccagcttgggcaacatagcaagaccccatctctacaaaaaaactaaataattagctgggcatagtggtgcatgcctgtagcttcagctattctagaggctgaggtgggaggattgcttgagcccaggagtctaaggctggagtgagctatgcttgtgccactgcactccagtctgggcaacagagtgagactctgtctcaaaaagaagaaagagggccaggtgcggtggctcacgcctgtaatcccagcactttgagaggccaaggtgggtggatcatgaggtcaagagatggagaccatcctggccaacatggtgaaaccccatctctactaaaaatacaaaaaaaaattaggtgactacagtggtgtgtccctgtagacccagctgctcaggaggctgaggcaggagaatcacttgaacccagaaggcggaggttgcagtgagctgagatcgtgccacagtactccagcctggcgacagagcaagactccatctcaaaaaaaaaaaaaaaggaaagaaaagaaaaaagaaagcttagctataccgagaactttatttcccatatcccattttgtattagtccattttcacactggaaaaaaaaaataccaaagattgagtaatttataaaatagagaggtttaattgactcacagtttcgcatggctggggaggcctcaggaaacttacaatcatggcagaaggggaagcaggcaccttcttcacaaggcagcaggagggaataagagccagcaggggaaatgccagacacttataaagccctcagatctcatgagaactcaccctttatcacgagaacagcatggaggaaactgccgccatgatccaatcacttccctccctcgacacgtggggattacaatttgcagtgagattttggtggggacacagagccaaaccatatccttttccctgtagggttgtgggttaaaagtaggcagaagaggatggtgcgggagatttgggaagtggaaggaaggtgacatcagtgtttactctttgaaggctgtccagatgagacaaggaggtgatctgacagaggggccacagaggttccagcttgtcctcaccctcccctgtgtcccttgcagcttgtcttcctgaccgctgggcctgctgaccaacagcagcccccccgcctctggatgcttggcagacgaggcagcagccccctagggacccctctacctgtttcccctctgccactccatcttaacagctggacgcatctgactctcatatcagctgtcggtgacttctctcatcctctccacccttcccagaccgccatctccccagctccctggacaattgtagaaggtctaattcctataacgcatcccttgccccagagcacgtagtgaccctgcttccccgattgagcactgactaatatccctcaacagcctttacagaagtagccagaagttggaggcaatgtgtccatcttgcaccaggccaacatccccccatgcttccgcgtctcagccttgactgcctattgcaatcacatggagaactttaaagaaaatgctggggcctggtcttacagccagagtcttgtctagttgttccaaggcatagcctggtcattgagagtcttagaagcaggtaggctgatgccccctcacctcccacggcacagacatcccctcacctcttcgctggctgaaatagaagaaccctagtgtccatcagctgcttatagatgactcatcttcttaatcctttcttgacgaaaacttgcttcagatgttaataaaaagtacaaaatctgccctatgttagtttgactccttggcacagcagtgggagcctctctctctcccctgtagcctaggatcgtgatcagaatcataatgaaatgtgtgtttgtggtctcccgtggcgtcagataattccgatgccatctgttgtcttcatcatcacatccgttattgaagtccgttgattatgcctttgattgaacctggggctatatttatcaagaaaattataagcacaggctttctgacagtgtccaaccaaacagaatttgtcatcattcaatgactattgctttccatttgttcctgttttggacttctaaaaaccaacacagggtctccttttatttttatttttttaaagaaatcaagtgagctggccaagagcagagcagaagatagatttttcttattcttaattttttttttttttgagacagcatctcgctctgttgcccaggctggagtgcagtggcacaatcttggctcactgcaaccttgtctcccaagttcaagcgattctcctgcctcagcctccccagtagcggggattacaggtgcccgccaccatgcctggctaatttttgtatttttagtagaggcggggtttcaccatgttggccaggctggtctcgaactcctgtcctcaaatgatccacccacctcggcctcccaaagtgctgggattacaggcatgagccaccatgcccggccgagaaatatatatgtatttttaagagacgggctttcactctgttgcccaggctggagtgcagtgatgaatcatggcttactgcagccttgaactcctgggctccagtgatcttcctgcctcagccccttgagtagtggggactataggcacatgccaccatgcctggccaattttttaatttttttgtagagatggggtcttgctgtgttgcccaggctgttatcaaactcctggcctcaagtgattctcctgcctcagtctcccaaaatgatgggattacaggcatgagccaccgtgcgtggctgaaaattcttaaatgtctgccacctatgaaagcattttggagctatagtttgacccaagacgaaaactgctcatttagataatgaagtttaatttacctttgaaagcaacactttgggaaatgcctgaataaactgacatcttgagtcgataggaggcttccccacgtggagtttggtgagctataccaggtcattaaaaagcccttagatgggccggatgcgttggctcatgcctggaatcccagccctttgggagcccaaggtgggtggatcacttaggtcaggagttccaaaccagcctggccaacatggtgaaacaccatctcttactaaaaatacaaaaattaactgggcatggtggtgtgcacctgtaatcccagctacttgggaggctgaggcaccaggatcacttgaacctgagaggcggagattgcagtgagccgagatgtgccagtgcactccagcctgggtgacagagcaagactctgtctcaaagaaaaaaaaaaaaggctcttagattggaagtcagtgctctcattcccccttgaagatggtgactgtttgctactgttccatgtcttcaatgctcatgctgctgcttagacctgttagaactgaccttgagttattccagaggaaaattccagcggatcctagaacaatcagagtattctggactgaagcatagtccagaatcgctctggtgattaaattcggaaagcttgcccagggcatcattaaccgcctggaggagtgagccctctcaccatctgttgtctgccatcactatttggtttttctctttggtctcatttagagccaagttgagaaatttccagttcctctccacttgctgcccgacacagttaaccagaaacacaatgtggtgaaggggcccatgttgtagctaaaacagccctagacttggaggcaggagcctgggttgatatcttggctgtttgactttatagcagcgatccccaacctctttggcaccaaggactggtttcatggaagacaatttttccatggaccagggatggggtgggggcatggttttgagatgattcaagtgcattacatttactgtgcactttatttctatcattattactttgtaatctataatgaaataattatacaactcaccataatgtggaatcagtgggagccctgagcttgttttcctgcaacaagatggtcccatctgtgggcgatgggagagagtggcagatcatcaggcattagattcctataaggagcgtgcaacctagatccctcacatgcacagttcacaatagggtttgcactcctatgagaatctaatgcagccgctgatctgacaggagggggagctcagccggtactgtgagcatggggagtggccgtaaatgcagatgaagcttcactcactcacccgccactcacctcctgctgtgcggcctggctcctaacaggccaaggacctgtactggtggtggctcaggggttgggaacccctgctttatcagacttagttggtccagtttttcccaaagttgggtacgctctgggatgattttaggcagcatttaggaaaacattaattaagaattttttttcggccaggcatggtagctcatgcctataatctcagcactttgggaggcctaggtgggaggatcatgaggtcaagagatcaagaccagcctagccaacatggtggaaacccagcctttactaaaaatacaaaaattagctgggcgtggtggtgcacacctgtagtcccagctacttggaaggctgaggcaggagaatctcttgaacccgggaggtggaggttgcagtgagccgagatcgtaccactgcactccagcctggtgacagagcaagattccgtctcaaaaaaaaaaaaagaaaaagaaaaagaatttattttcaggcaaggcctagtggctcatgcttgtaatcctagcattttggaaggccaaagtggaggatcacttgagcctaggagtttgagtccagcctgggcaacatgacgaaactccgtctttacaaaaaattagcccagtgtgctggagtgcacctgtagtacccccagctacccaggaggctgaggcgggaggattgctggaacccaggctgcagtgagctgatatcacgccactgcactccaacttggacgacagagtgagaccctgctgaaaaaaatatatataattttcatgtcttttaggaacaatattaggtttgcatttatggtgatgtaaaaaagagaatcaacataaagaaaagtattaaatagacaataaaagagaacacgcctgtaatcccagcactttgggaggctgaggtggggagatcacttgaggccaggagttcaagaccagcctgtctaacatggcaaaaccccgtctctactaaaaatacaaaaattagcggctctcggtggcatgcacctataatccaagctactcaggaggctgaagcatgagaatcacttgaacctgagaggtggaggttgcagtgagctgagattgtgccactgcactccagcctgggtgacagagtgagaccctgtctcaaataataataataatagagagggcttgaggcatagcaactgttgccatggtaacgtgcaagtgactgatgttcaggaaacactggctttgctaccctgagccacacttttccttcttgcctgcaaggcgataaggatgttgcacctggtggctggtgtgaggaggtcaggcgcagcaagaggcagcacacgtagcagttacagtcacagactttgcctgcgccagggtctgtgtcccagcggagatgcttaccggctgtgtggtcttgagcaaattgctcgacttctctgttactctgtgtggtgttttctgacgccacttctgacaccaaatgtgttttttctgataccaaatacgtgccatttttctacactaagtctctgattcttggatgccaactgggtgcccaagcaattcaattcagctatcacactatgtcctggagttagcatcaggtcctgcaagttaaaagaccccatcccaccagactgcccctatctcagatgccagtcgcaagtccggagccacccacccttctgcctggccaattacaaacttgggggttcccacgaccacctcctcgggtttgatagtttgctggaatgactcacagagctcaggaaagcccttcacttatgtttactggtttattacaaaggacagaactcaggaatagccaaatggaagagagatgcattgggcaaggtgtggagagggagccgtgcagagcttccatgatgccctctctgggtgcactgccctcccagcacaccagtgtgtccaccaacctagaggctccctggatctcactgttcaagagcttttataattcagtcgccagcctcctcctcttcctggcaggtcagcgagtgggactggaagttgcccgccgaattgttttttttttttttttttttttgagacagggtctcactctgtcacccaggctggagtgcagtggtgagatcatagctcactacagccttgacctcctaggagtgagcctcctgcttcagcctcacaagtagctgagactacacaggtgggtgccaacatgcctggctaatttttaattttttttttttttttttttgagacagagtcttgctctgtcacccaggctggagtgcagtggcgcgatcttggctcactgcaagctccgcctcccaggttcatgccattctcctgcctcagcctcccgagtagctgggcctacaggcgcctgccaccatgcctggctaatttttttgtatttttggtagaggtggggtttcaccatgttagccaggatggtctcgatctcctgacctcatgatccgcccgcctcggcctcccaaagtgctgggattacaggcttgagccaccatacccggcctaaattttttttttttttttttttggtagagatggagtcttgctatgttgtgcaggctggtctcaaactcctgagctcaagtgatcctcctggctcagccacctgagtagctgggattacaggcatgagcctctgcatccggcagtgcccccgaccacctgtctttttttttttttttttgagacggagtctcactctatagcctaggctggagtgcagtggcatgattgcggctcactgcaacctccgcctcccaggttcaagcaattatcctgcctcagcctcccaagtagcttggactacaggcacgtgccatcacacccagctaatttttgtatttttagtagagacgggggtttcaccatattggccaggctggtctcgaactcctgacctcgtgatctgccggcctggacctcccaaagtgctgtgattacaggcgtgagccaccgtgccctgcccacccctctcccctgtctttatcacacatttgctcttctggtgacgaggccccaacctgaagccatctctctagggaactcagcctgagtgccctcattagcatacactcagatgtagtacaatggggattgctatggataacaaaagacagtcctatcgctcaggaaactccaggggctttaggagctctgtgctgggaaccagggatgaagaccaaatagatattttattaaccacactagtggcttaatgaattacctcctagggattttttttttttttttttttttttggtcaggagcagatgagataagatacataaaaaagatattacaatacctaaccacataataactgttcagtaaatgttagcagtgaaatgggggagctcccctgtcccctttgcaggacttgtgacaggggtgtggctcgcttacttggctgccactgcatcaaaccccttgcaggagggggagcatgcaggtgagcagattggggctggggtgagtgcttttgggctctggtcccatggcagcgtctagggatgtgttacaattaatactcttttagcagttgctgtacgcagatgactaagtgttaaccagttcagtggagattcagggtgatagccttttacaccctgccctcttggtacctgggttcttgtctggtgtccaggaagaatcaggtcacatggacttgaaggatggtgaatacaaattttttattaagtagtggaagtggctctcagtggaaggggagctggaaaggggatggagtgggaaggtaatcttcccctggagttcagccatcctcagatgatctcctctctgactgtccccagccaaactcctctcgatgttcagacacttcttctcttctctccttctctgccacgccactctggtgctattctgattgtggagcctggggtttggggttcttaagggcataggatgggggcagggtggtccagagcggttttggaaaaggcaacatttgggtgtgaaaacaggaatgcctgttctcatttagggctgcaggtccaggcttgagggtggagccctcacctgggaccctgtccttctgccgcctgtccgtatcagcaggatgctactgctgctgctgatacctggggaattgccaggtgtgaggtgggcattagaaaaatttcaggctgggcacagtggctcaatcctataatcccagcactttgggaggtcgaagcaggaggactccttgagcctaggggtttgagaccagcctgggcaacatcacaagaactcctctctacaaaaaattttgaaatgagctgggcatggtagtgtgtacccataatcccagctactcaggaggctgaggtgggaagattgcttaaacctgagaggtcaaggctgcagtgagctatgattataccactgcatgccagcctggaccacagagcaagaccctgtctctaaaacacaattaaaacaaaaatttcagttgaatatgttcctaagaagccacaaaagagtcttttgttatgattcttaaatgaaaattaactaaaaattggaaataaggaagaatgtcttttccatgtcatactgaggcactgcttaatgacctgcccacggatgattaattatcttggagagagtacatgtatctgactttgttatttattatttgattagagcactgacatagtgaaattacacgttaacttgtagatttctgtccagtagaaaaaagacgacattaaaggttatggttttattgcccttatagcatgttaaccagatttctctcgaatttagcaatcttatgctaaggttttcattaaagatgctgatgagtccactttttaaatgcccttggagcgagctttaccattttactggttccctcattaatgggttaaataaattttttgacaagtgttcattccacatttgtatgagtcacattttaaattttgaaaatatacttcagcatgatcttaataatgccaagtcccagagagttctctgtgcccataatttagttcactgggcacattcccagagcacgttcagtatgcaaagcatcatggtgggccccgcagggaagactaaaatgggtaggactggtccctatagttgcagatttagtaattacttatgggcagaaaagaagtatataaattacttcctacactgtgagaaagagaaaagctgcccctggcagccgggagctggcttgacactcacagcttggccaaagtgttctcctgttgaatgtaaacaattttgcagattgccggcatcagacaaggccatcctgagaccgtgatagatcaagacaaaataacactactcctgaaggcagataaagacatgaacattgtcccagccacaaaaatcacccaatagccccatttcctagctcatatgagtgactgctagttctccatcaatcacagtttcagtcttactctgttcttctccctttaaaggaaagaattaggaagacactctatcagagaattacctccacttcctgacaacatccaatccagagtaaatgctcacttcctttaaactgtcccccaaagcacctaacacaagcccaaattttcttttcttttctttttctttttttttgagacggagtctcgctctatcacccaggctggagtgcagtggtgcaatctcggctcactgcaacctctgccccccgggttcaagcaattctcccgcctcagcctcccgagtagctgggattataggcacccgccaccacgcctgactaacttttgtatttttagtagagacggggtttcaccatgttggccaggctggtctcgaactcctgacctcaagtgatccacctgcctcggcctcccaaagtgctaggattacaggtgtgagccaccacacctggccccaaattttctaataagtgctttctaacaccctcttactgatatctgcccacagctgattaggtgcaagctagcccagtaccaatcgatagaagacagtacagactcactaaagtgatatatgatggagaaaattgtccccatccagacttcccttagagagaagacccggtgtggttggtgggaacactctgacgcttcttttggttagggttgttggccacaagcaacagaaatcaactctgcctgactcaaccaaaaaatgggattgtagaaggctatgagtggggatgggggctcaggagtcggaaggacaggcttggaaatgagtatggatcaagaaagccccagagactggccacaggaccaatctggccaggaagccgccattgctggacagcacaagtctaatccctccatccttttatctctgtcatttgctctgtggtcaaagtcttggacatgagcttctgattggctgagtctgaggaagtgggggtgctcccttgttgaacttctctaataatgactgacacagtgaatgctttccctaaaactagggtttggaggttgagcagccaaaaattccaacttttttccattacaggagggagacacaaccccacccaagaccatgtgtaagtaacaataggtagtctgtaaacagccttccatggccaggaatggtggccaaagaaggtcttctttgacagaggtcaaagaagagggtgggggccaggcacaggggctcacgcctgtaatcccaacaatttgggaagccgagatgggaggattgctttgaggccagaagtttgagaccagactgggcaacatggtggaaccccctctctataaaaaatataaaaattagccaagcatgctagggcacgcctgtatttccagccactcaggaggctgaggcaggaggatgtcttgagcctgggagattgaggctgtggtgagccatgatcaagcaactgcactccagcctacatgacagagcaagaccctgtttccctgtcacaaacaaacaaacaacaaacaaaaacacatacacataaaccccgtcgttctaagcaaagtgagtcctgctatctgcaggattttgatttttttccaagagcattatgctgaactggtatcagaattaaattgcttggaacaattgttcctggatcaaactgagggttgggctgcttattctagtgacccaataacgagatgcaaataaactgggaaaggagggagtttctatttctgttaccagttacagggaaaaagcctggaaaataccaccagaccaactcaaaattacaaagtttcccagagcttacataccttctaaactatatgtccacgtgtaagtgtgcgttcacctaaagacctaaataatcagcttcttctagtctaactaaggtctgagtcctgaagaccttcctctgaagcctcagtaaatttacttaatctaaatgggtccagttgctggggtgattacccttatcttgtctcctgctaaatcatggaggtttggggacttccttcacactcccaataaacttgtttgtggaggcctggggagtttcttcacacccccaataaaacttgtttaatcctaaacgtgtcctgttaagaattgcctcgttatctcgtcatgtttcaaggcccaggaaaggcctgagcaaaactgttggaggatttctgttacattccagcctttgtataagggcactggctcttttagctttttttttttttttttgagacagagtctcgctctgtcgcccaggctggagtgcagtggtgcgatctctgctcactacaacctctgcctcctaggttcaagcgattctcctgcctcagcttccgagtagctgggattacaggcatgcgccaccatgcccagctaatttttgtattttttgtagagacatgatttcactatgttggccaggctggtcttaaactcctgacatcaggtgattcacccgcctctgccttctaaagtgctgggattgtacaggcatgagccaccatgcccagtaggctccttcagctttgtttttttcttcttcttttttttttttttagtgacagagttttgctcttgtcgcccaggctggagtgcaatggcaggatctcggctcactgcaacctccgcctcccaggttcaagcgattctcctgctgcagcctcccaaagtagctaggattacaggtgcctgccaccacgcccagctaattttttttgtatttttaggtgagacggggtttcaccatgttggccaggctggtcttgaactcctgaacaaggtgatgcatccgccttgggctcccaaagtgctgggattacaggcatgagtcactgcctgcccagccactttcagcttttaatgtttaacttaaccacacagtccctgctgaaatagctgtcatggaggcctgcgttagtgagacctgacctgccacacaatgaaggagatgttcttcattgagataatgtgggtgtccgaatcaggatccacaggtcagtgtcccagctccaccattgactagctgtgtgattccgatggagccacttaacctctctgagctgtgggatcttcctgtataaaagagacaaccacgtagtgcccacctcaaacagtggttatcaggattgagatgatctgtgtaaagcatttagtgcctatgaagcacttcttagtgtataaagcacttagggtgtaaaaggtgcatggtaaattctgtttgtcgcccgggctggagcgcagtggcatgatcttggttcactgcaacttctgcctcccaagttcaagtgattctcctgcctcagcctcccgagtagctgggattacagctgtgcaccaccatgcctggctaatttttgtatttttagtagagacgggatttcaccaggttggccaggctggtcttgaacccctgatctcaagtgatctgctggtcttggcctttcaaagtgctgggattacaggtgtaagccactgcacccgccctgtgcgtggtgaattccgagtaaatggtagccaaaatcattgtcatcatcatcgccacaggtaaccttttccccaaataatactcagcttctcttctaagtaaacgttgaatgaatactttagagtgttgaagaagcacccctaaatctgcccacttgttgattctagccagtgatgttaaatttttaggaatctggagaaccagttgttcaactgtgggtagctcaaaatctgcagcagtgggagtatttacaccgtggaaattggcaaatgattcacagcaaggcttctacctccctcccctgcttccagccagttaaacattccccagcacatcactcattctagtcctagcctgccctactttggggcatccaacagagattacttgcgttttctttgtggtttatcaagccccagggtctcgcttgcctacaaaggagaccactaatcactagcatgctgaataaacatgaagttgacttaaacattaatttacttattatcaaaagcttatctgcttctgctggtgcaatgactctgatgggaattgccagtggtgatggtagataggtgatggcttcagagaagtgtgctctgtgctttggcaggagcagggctaagctgagacagtggtcctagtggcccagtccatgggctaagcaggaatgggtgggaagagggcaggggaggcttccccggggcctgcagattgtgttcttaagagttttttccttcagtccttagaagctcagctgaaaggaatgactgcggccggatgtggtggttcatgcctgtaatcccagcacttagggaggccgaggtgggcagatcacctgaggtcaggagtttgagaccagcctggccaaactggtaaaaccccaactctactaaaaatacaaaaattagctgagcatggtggctggtgcctgtaatcccagctacttgggaggctgagccagaggaattgcttgaacccaggaggtggaggttgcagtaagcccagatcaagatcacaccactgcattccagcctgggcaacagagcaagcaagattctatctcaaaaaaaaaaaaaaaaaaaatggagtgattgctttaaaattcttaaacagggccgggtgcggtggctcacgcctgtaatcccagcactttgggaggcagaggcaggcggatcactaggtcaagagatggagtccatcctggccaacgtggtgaaaccctgtctctactaaaaatacaaatattagctgggcgtggtggcgggcgcctgtagtcccagctactcaggaggctgaggcaggagaattccttgaacccaggaggcggaggttgcagtgagctgagatcacgccactgcactccatcctggcgacagagtgagacattgtctaaaaaaaaaaaaaaaaattcctaaacaggaggggcttagggccagccagttggtcacatgaaacaatcaggggacttaccttagagctgccttcgcagtagggagtccatggtttttagtgagatttgtgtcgtacaaattaattaaaattgcatagtttctatcaagtttttttcttacactttccacaaaattgggaaaaatgtctatttcccatttctttatttcattttctcttattgcttctatcctacctgatatttcccatttcaaaagcacgtttttttttttgagatgcagtcttgctctgtcgcccaggctggagtgcagtggtgccatctcggctcactgcaagctccacctcccgggttcacgccatgctcctgcctcagcttcccgagtagctgggactacaagcacctaccaccattttttgtgttttttagtagagacagggtttcactgtgttagccaggatggtctctatctcctgacctcgtgatccaccccgcctcggcctcccgaagtgctgggattacaggtgtgagccaccgcgcccggcccaaaagcactttttaaatgttgaggtggtttgaaggctaatggaaattacgaggtgggactgaaaccattccctgccatccctaagaaagcccactccttggaactgccactggtgaaagtctcactctgtcacccaggccagagtgcagtggcacaatctcagctcactgcaacctctgcctcccaggttcaagcgatcctcccacctcagccccgcaagttgctgggactacaggtgcccaccaccatgcctggctaatttttttttttttttttaagtagagacggggtttcaccgtattgcccaggctgatctcaaactcctgagctcaagtgatctgcctgcctcagcctcccaaagtgctgggattacaggcatgagccaccgcgcccggcctgaaagcattttagaaggctcctgactgaaagaacgggataaagtaagggggtatgggaacagaagatgacagcctggtatatctgggtgacatgcgtaggcagtctgttgtagtggcaattgtcagggctctggagttagactgtcttctttcaaatcttgcaagctgtctgatctcgggcgatttacttaacctctctgagagttctgtaaagtggagaataagaataccaccctacagatgatgaggattcaatgagattgggctggatacaaatcagcttttgttggcatcagcttgagaggagggatggacttgggagtggagagggtggatttgggggagaggacgccacacagtggcaggaactcgcagcaggtgactgagagtggaaggcacaagagagcccagatgctgagccagctcagaatagaaacggtattgatagcagaatgcaaagcagtatcactcgaatgacggatgtttaattggatttctccagggctgactcaccgcctttgatagatgcgattgccctcgtggtgtctatcatgagacttgaaatttttccacctgcacctgcagtctttaggccttgtttcaacaaaatgcagtactgtgtgtaccctccatgcctgccagccttccttccttccttgtgtatttactgcaatgtatcagggacggggtggtgtgctagaaccatgaaggaaaaaggcaaagtcccttaaaggaggtgcagtctgttgaggcagaaacacaaatgcctagatggttctggaatgcctagatgtcaatgggataacaagggggctatggctgcaggaaggaagaggacctgatgtagctgagggcatcaggaagattccagaaggagaagggattagtgaagctgcagagcacttagtttgagacaaagatttctgagctgagggaggagttgggcaaaggcttgagtgcaggagttcaagagaactccttggggccaggctttacacagggatgcacatgggctgtgtaccagtctgttctgacactgctgtaaagatactacccgagactgggtcatttataaaggaaagaagtttaattgactcacagttctgcatggctggggaggcctcaggaaacttgcagtcatggcagacggcgaagggaaagcaagcacgtcttacgtggcggcaggagagagacagcacaagagaaaatgagtgtaggaagtgccacatttaaaaccagcagctctcttgaactcctgcactcaagcgatcctcctgcctcggcctcccttagttctgggataacaggcaggagctgctgtgcccacctggagcttaatctctgttcacatctttaattattctgggccagcttagccaaaggccttaggggtagggttagggacaccaagggccagtcttctatccacttcacagctcgctgggccctccaagggaaggactatgtgtctcattctaggcactggtaagagtctgggggaaaaaaaatcaaaaataacaagtggacgcggtggctcacacctgtaatcccagcactttgggaggccgaggtgggtggatcacttgaggtcaggagttcaagaccagcctcgtcaacatggtgaaaccccgtctctactgaaaatacaaaaattagcagggtatggtggtgtgcccctgtaatcccagctactcaggaggctgaggcacgaggattgcttgaacctgggaggcagaggttgcagtgagctgagattgcaccactgcactccggcctgggcgacagaacgagactccatctcaaaaaaaaaaagaagaagaagaagaagaaatgaactcacaacacttactgtctccttcaaaggagtgaaggatgtgcagagggctaagtgcggtcccagaaactgccaggtagcatcagtgagcaggtgcaggaaatctgttggccaaccttgcatgcactgggcacggcccagttccctgccagagcccagagaagaaaacaagctctggtctcagtcgaagcagtggggtgggaagagccctgctgtctcgccacatggccttggtagctggcctatgtctcaatgtctcttgaaagtgaaaatagatcaggagggctgacacgtagtaggcgctcaagaactgttttctggatgagtcagtgaattggtgaacagcattcacctctctgggcattgatttcttcattcatgtaaggtgagagctcttctagctgcagaaatttctttagagccaggcacagtggctcacccctgttatctcagtactttgggaggccaaggcaggagaatggcttcagcccaggagtttgagaccagcctgagcaacatagtgagacccccatctctaccagacattttttttgagatggagtctcactctgttgcccaggctggagttcagtggtacgatctcagctcactgaaacctccatctcccaggttcaagcaattctcctgcctcggcttcccgagtaactgggatcacaggcatgcaccaccatgcccggctagtttttgtatttttagtagagatggagtttcgccatgttggctaggctggtcttgaactcgtgacctgaattgatccacctgcctcggcctcccgaagtgctgtgactacaggcatgagccaccgtgcctggcccaaaacgtttttttaaaattaccaaggcgtggtggcatgcgcctgtagtcccaactacttggaaggctgaggcaggaggattgctctagccaggaggtcaaggctgcagtgagctatgattacactcctgtaagttcagcaaaatatttctgtaaagggccaagtactaaacaccttaggctctacagagtgtacagtctctgtcgtgattactcacctctgccactgtcgggaaaaacagccacagacaatgctgaaatgaatggacatgacttcgttccaatagcatgttattcacagatgctgaactttgaatttcatataattttcatttatcagaaaatgttatgattttgattttccccaagtatttaaaaatgaaaattaaactattcttagttcgtgagttgtaccaaaacaggcagtgggccagattttgactgtgggctatagtttgccaaccccagctaaagattgaggagcaaacgcatcttccaggaattccttggatcgtcttagacagaaggtcaaagggagagtgcactctctccttggtgtggaaatactgatcaccatgtcttccaaactgggtttcatagacacatctccatgccatgctctcactctagaacctaagatggctcccatgttaaggttctttacaacgcagacacatatgtccctgatatgtcctaattgggcagactcttcattgtcacctaccctggcataccacacccattcctaatatttgtctcagctcccccttctctctgagtgcctggaatcttttcctgacccctccaagttgtgccctcccctgtaagttgcatctcgatttgagcagccttctcccagactatcctgatctctgtcttccttgaactccagtcactggctggagctttcacagtcccagtcgagagcatgggctcagatcagactgcccgagttcaagttcctaccacttactctgtgacgttgaacaagttctttatcctgtctaagagataataataatagtccttacctcatagagttgctgcaagagttcactgagatgatttgtgtaaaatgcttaatccagagcctgacaccaatcatatgaaagcattcaataagtactagcaattatacttctgtattgtttgatgtttttatagtgagaccatatttatgtaatatttgtataattttttaaatagaccaagctgggtgtggtggtatatgcctgtgttcccagctacttgggaggctgaagcaggaggatcccttaagcccaggagttcaagtccagcctgggcaatatagtaagaccctgcctctaaaaaagaaaaaaaaaaggaccaagtattcttttttttttctttttttttttagatggtgtctcgctctgtcgcccatgctgcagtgcagtggcatgatctcagcgcactgcaagctccacctcccaggttcacgccattctcctgcctcagcctcccaagtagctgggactacaggtgcccgccaccacgcccggctgattttttgtattttcagtagagacagggtttcaccgtgttagccaggatggtctcgatctcctgaccttgtgatccgcccgcctcggcctcccaaagtgctgggattacagacttgagccaccgtgcccggccaggagcaagtattcttttaggtctaaaacaaaggtaactaagcaatactggtgtttgtttgttttgagacagggtctcactctgtcaaggcagacagctggaaacccacgtcaagaaaattgactattttcaaaagtcaatccttgcctcccaggttggagtacagtggtgtgatcatggctcacccaggagctcaacctcctgggctgaagtgatcctcctacctcagcctctctggtagctggaaccacaggtacacaccaccaggcatagctaatttttttattgtgtagagacagagtctcgctatgttgcctaggctaatctcgaactcctggactctatcgatcctcccatctcagcctcaaagtactgggattacaggcatgagccactgtgcctggccataatttttttatatcatacatacagaaaagagcagtattagtagttgttattgtaagaaaaatgaaaactaaggcagtctagaaagcccttggaagagagaagaataaactgcgcttgaggaagttgacatttgggaacagagtgggaacaagggtcttgaagaaggtgacatttgtttgggaacgagtgtctgactgcaatcaaaggaaaggccagtgtgacaggtggatgtaaatccacagtccattaaaatggccacagagagaaaacagacatattggccttccagggtgcaacatgagggcattcccttcctatgtacactggcaggcacctctccggtcccttggtccccagcaagatgctgagaaattgctgaggccaggggctccctggacacttatcaacacttatccttacccagggatagcgtttaagctcatgaatcctacgaaagctgaaccaatgcacatgtttatcatcttggaaccatttgatttgaggaaattgtaatagcacatgctggccaggcgcggtggctcatgcctgtaatcccagcactttgggaagctgaggcgggtggatcacctgaggtcaggagttcgagaccagcctggccaacatagtgaaatcccctctctaccaaaatacaaaaatttgctgggcatggtggcaagtgcctgttatctcagctacttgggaggctgaggcaggagaatcgcctgaacctgggaggtgaggttgcagtgagccaagatcccgccattgcactacagcctggacgacaagagcgaaactccatctcaaaaaaaaaaaaaatagcatgtgatagtgagatacacattttgcacagaaatgttggctgagatagtccaggagagtctctgtgagctgactttttacctagggtggaggagtggatggaagtggctgttcctacacacccacactgcctgtgcaaaaccgtgggctgcctgcaccacacacacaagcctgtttgattctcatacaaccccaagacaaaggtgtaatcccttttcaacagtgacagcactgaggctgagagcagcaaagtaggtcatagccagtcaatgggggtactgagatctgcattgagatctggctgtgtctaaagcgggttgtatcctctctgtgcttgcagaatggggctcgagggctcatctaaacccctcatcttatttatttatttttatttatttatttatttattgagacggagtctcgctctgttgccaggctggagtgcagtggtgcaatctcggctcactgcaacctccacctcccaggttcaagtgattctcctgcctcagcctcctgagtagctaggactacaagcacgtgccaccacgcccagctaatttttgtatttttagtagagacagggtttcaccatgttggccaggctggtctcgatttcttgacctcgtgatccgccctcctcggcctcccaaagtgctgggattacaggcgtgagccaccgcgcccggcccagacatgacatctttttctcacctgtcttaagatacctgcagcctctgtaacttatttttaaaaggagacaataaagactatttttaaaagtcaatccttgcctctgaaaacctacctctgcctttgtcgtggtctctgctgggtttccattaggctgcaactcaagctgctgatgcctccatttcatgtcgttttcacaaacattttgtaaagcagcagctctattattccagcagggcctgatcacctctccgcacccaacgctgataaaaatgacccgctttcccctatcgtcccagcgtgaaagaccaagatgctgaatgacacgggttggctttcttttccttccgaacattaatcaggttcttgaagataacatctctctctggaacgagccggcagcagcagagtttgatttccaggttcagccctaatggtacagagacctggactaatgtggcttattcaaagttccagccatgcttctaaagcatggcttattcgaacttccagctatgcttttaaagcactttgcatgaactattcacatgtcttttgaacaatatgatttaatggcattggaaaatcatcatgatgtcatgcttgcaatgagcaggacagctgtatgtcttgatccaatacacattaaaaatgcacctatccacacatatgtatctgtgaaaatgtcttcagctgcaagtaacacagcgtccgacgactagtgtcttaaatcttgggtgaccagctgtctctgtttgcctgggactgagaggtttccaaggatctggaaactgcagtgcagaaactgggacagccccaggcaaaccaagtcagttgttcacactacttaagtcataaggacatttaatatttacttgaggctggacacagtggctcacacctgtaatcccaacactttcggaggctgaggcaggtggatcacgaggtaaggagttcaagaccagcctggccaagatggtgaaactccatctctcctaaaaatacaaaaattagccaggcttggtggtggatgcctgtaatcccagctactcgggaagctgaggcagagaatggcttcaacctgtgaggcggaggttgcagtgagccgagatcatgccactgcactccagcctgggcaacagagctagactccgtctcaaaaaaaaaaattttttttgacttgataagcagtccagatgcaggtggcccgagggtcagtggggtggccccaggatgctatcaagggtctggctgtttcctttcctcccctctgccctagatagcgaacctgtccccttctgcccatgggtagtaagccaatcgctgttatgatggatttggcaaaagaaaagaatttattcacaccaacgcagccaagcaaggaggcaggagaaaaggtctcatacttgcctccctgaagatggaatttagggatctttatggaataaaggagcagggtggtctaaagtgtgggaagaggtgattggaggcaaggaaaagtgaggtcattggcaatctgcacatacatagccaagcttcctggatcttcatagggtgcatgtttagaaaatggcagcattagcatgatctcggggagttttgggccctctgacgtcaaaaggtcacttctccggcatttgcacaggttcagttgaagggtcattgatctcaacgggttcgaactggacaggagctgcccccatagtcctgaaaaacaactttaagcaaccattaccgtagtcacatatgtgtcgtagcgacatatatgtgacatatgacatatatgtaccataatgacatatagtgacatatgtaaggaagccggtgggggggttaggtatatatcatttggctgcttgacttttagctatataagttttaagaccagctagaagtaagtggttaaaagcaagcaaggcaagttaagtttggtgggcttcatcaggttagcgttcggtttcgccattctcacgtgagtggctgtaggagcttaggaccaggacaggggagaaccgaaggccctaattatccttcccagaagcctgcccaagcggagtttctcttaagggctttctctaagcccaccaaacttaacttgccttgcttgcttttaaccacttacttctagctgatcttaaaacttatatagctaaaagtcaagcagccaaatgatatttaactaaaccctccactggcttccttatatatgtcactatatgtcattatgttacatatatgtcatatgtcacctatatggcactatgacacatacgtgactatggtaatggttgcttaaagttgttctcttacatttcattggcccagagtagatgtcatagctacctccacttgcaagagagcctggaaaagtatgtgtctagccaaagcaaatgggattctgtgactggcttccatcaaggcagggcaggttgcctcctggacaaatcagagctctgggagaaagcgggaggggaaggtctacaaccagtcatgcccgctgcaactcatggagccacatggagaggagacaacacggtgaaattgtcaagagcaggagctagggctgaatctggaaggccacttaccagtgcagagctttgggtgtgttgcttaacctccatgtactcatctgtaaaatagagctaaaaacaatgtttctcttcctggactgctgtgacggtctagaagagtttatgcacagaaagtgcatttacatgtaaatgctccgtaaatgctgacttcttgtttgccttaatggcagaacccatccttccatattccagaaaaagacttgatttttagttacgtgaatggacacctaaccctgatggacagcttggggtcgggggacaagcttctttcttggaaggatgttcaaaggaccatgaagcttttggttttgccaactggggtttgtaagttgaagaacagagctgagtaattcaggacaggggtgtccaatcttttgtcttccctgggccacattggaagaattgtcttggaccacacataaaatacacttatagtaacaatagctgatgagcttaaaaaaaaaatcacacacaaaaaaaatctcatgttttaaaaaggtttacaaatttgtgttgggctgccttcaaaagccatcctgggcctaatttggacaagcttgatttaggacctgatggtcctcctttagcggaaggtgtgtggaggaggtagagagagagagagaagagatgagacatgaggaaaacagagccatctcatagggacgttgatggagtcctgcagcgtgaatcccgtcagcagttctgtagagctccacctcgcttgtcaatgggttgtgggcttggatcttttgggaggattcaatgacatgctaagggcagccttggaggtggacaaagggccagggcaaaggcccccagggcatgcccgccacccttaggttacatggaggaaaaagattgctgtgaaatacaccagaaccctcggagtagaagtggcctctgctacacgtaggtcaaggttctgcatactttcatcttccttctttgtacttgtttgtattttccaaaatttctacaatgattagggatccattctataatcagataaaattgccatttacaaacttttattggccaggcatagtggctcatgcctgtaatcccagcactttgggaggctgaggtgggtggattgcttgagtccaggagtttgagaccagcctgggcaacatggcaaaaccccttctctaccaaaaatacaaaaaattctccaggtgtggtggcgcctccctgtagtcccagctactctggaggctgaggagggaggatggcttgagcccaggaggcagagattgcagtgagctgagattgtgccactgcattccagcctgggtgacagagccagactccatctcaaaataaaataaaataaaataaataaataaaaataaaaacttttacaaagaagagtataagcactgaaagttatttttaaaaaggttttacttgttagctccattcctcagaaatagtgcttcttccacatcattttctctttccttttttctctgctgcttttttttttttttttttttttgagacggagtctcgctctgttgccaggctggagtgcagtggcacgatctcagctcaccgcaatctctgcctcctgggttcaagtattctcctgcctcagcttcctgagtagctgggattacaggcgcccactaccaaccatgcccggctaatttttgtatttttagtagagacaggatttcaccaagttggccaggatggtcttgatctcttgaccttgtgacctgcccacctcagccttccaaactgctaggattacaggtgtgagccaccacgccggccattttttttttttttttttttttttttttgggagaaggagtctcactctgttggccaggctggagtgcagtggcatgatcttgactcactgcaacctctgcctcctgggttcaagcgattctcctgcttcagcctcctgagaactggggattacaggcatgtgccaccacacctggctaatttttatatttttagtagagaaagggtctcaccacgttggccaggctggtcttgaactcctgacttcaagtgatccttccacctcggcctcccaaagtgctgggattacaggtgtgagccaccccacccagccattctctgcttctttctcacagctaatgataataatagtaaaggccaagggtggtggctcatgcctgtaatcccagtgctttgggaggctgacatgggaggatcgcttgaggctaggagttctagaccatcttggccaacatggcaagattctgtctctacaaaaaatttaaaaattagctgagtgtaggggcatatgcctaaagtcctagctacttggaaggctgaggcaggcaaatccttttacccctggcgttcgaagctgcagtgagctatgattgcactgctgaactccagcctgggtgatagagctagaccctgtctctaaaaaacataataatagtagatagcatttactgggcatttgactgtgtaggtcccaggcactgtgcttaatgcttgatgtgcataataatcccagcaaatagtactgccattattcctatttaaaacatgacggctaggtgcggtggctcacgcctatcatcccagcactttgggaagctgaggcaggtggatcacctgagatcaggtgttcgagaccagcctgatcaacatggtgaaatctcgtccaaaaaaaaaaaaattagctgggcctggtggtgcatgcctgtaatctcagctacttggaaggcttaggtaggagaatcacttgaacccgggaggcaaaggttgcaatgagccaagatcgcgccattgcactccagcctaggcaacgagagcaaaactctttttcaaaaaaaaaaaaaaaaacataaataaataattaaaaatgagttaggtgagacagaaaaggaagtcactgtaccatggccctttgagccagagttgtttggtgccaaaactctgcctcctaatcactacctgtctctccttttgtcctttctccatcttctcctctcttacctctcaaaaattatcaataatttgataattctgtggttagaatccaagattcctcaacttcagtgtgattgacatggtggctggctcactttctgttgtgggagctgttctgtgcacagtaggatgtttagcagtgtccctggtctctacccactagatgccagtagcaaccacacccctccccaacacacactcaattataataaccaaatatgtctccaggcattgccaaatgttcctggggaccaagattgccctgatgtagcctgatctctgcaaaagcgtctggagtctctccagttgaacgatcgctgatagaaactcacgggaacagtctgtgccctcccggcaagtccacgctcattcgaggcagctgtcacctgctaggacattccagggcacgacttgaaaaatgcttggcgtgcctctgacaacaagagatgcaggctgaagcaaggcattcctgcctcttgtcctgaaactgggatgctggcattagaatggacagcatgagttgttcttgagtggcaaaaggcaaggggtcctgctgtggtttgtatgtctgtctcctccaaatctcatgttgaaattagtctgttctcgcatttctataaagaactacctgaggccgggcgcagtggctcacgcctgtaatcccagcactttgggaggctgaagtgggtggattgcttgagccaaggagttggcaaccagcttgggcaacatggtgtaactctatctctattataaagaaacaaaaaaatttttttttgggacggagactcgctctgttgcccagtgcagtggcgcaatcttggcccgctgcaacctccgcctcctgggttcacacattctcctgcctcagcctcccgagtagctgggactacaggtgcctaccaccacgcccggctaatttttcgtatttttagtagagacggggtttcaccatgttagacaggatggtctcgatctcctgacctcgtgatctgcccacctcggcctcccaaagtgctgggattacaggtatgagccaccgtgcccagccagaaaaaaaaatttttaaacaggctacctcagattgggtaatttatacagaaaagaagtttaattgacttgcagttccactggctgtacaggaagcatggctggggaggcctcaggaaacttacaatcatgatggaaggcgaaggggaagtcttacgtggctggagaaggaacaagagagcaaagagggaggtgctacacacacttaaacaaccagatctcgtgagaactcactatcatgagaacagcaagggagacgtccacccccatgatccaatcacctccccccaggcccctcctccaacactggggattatgatttgacatgagatgtgggcagggacacagatccaaactacatcataggccccagtgggaggtgtttgggtcacgggggtggatcccccatgaatagattaagctcttcctgggaggtgggggtgagtgagttctcactcttttagttcctggacagctggttgttaaaaaaagcctggcacctccccctctctcttgcttccactcttgccctgtgacttctgcacacatgagctccctttcaccttctatgaatgtagccagcctgaggcccatgccaaatgtcccatcttccagccagcagaatcatgagccaaataaacctcttgtctttataaagatattatttcctcttcattaaagaacagcttttctaaatgttgggggaaatgtccatagtcattactcaatcaaaacttgtgttcccataagcctaaggaccattctagattttttacatgtttttttgtgtgtgtgtatctataaaatgcatacataaatttttttttgtttttaagcattcacccaaacaaaaaatcacaggtaaacccatatttctgagatgccattattccgagctaaataagagataatcacttcaaggtaaattgaaaattttcctgaagccatacatttcaagtgaaataagtaattctaaataggacaatttaaattggataattttaaagcgtctataattggtttatttgcaaaattcctgaaaggaaaaattttatcactgccatcacagcaggtttccacatccagatgagaaaacaagacaaatgctagtgtgttttaactagctaaacaaaactaagttaaatgaatatttaaaaatttccctagtgggccattccttaacaaaatgttgaaatccctgttgctacattgactaaaagatcatgttgaatggaatatgtaagacttggctcatagaaacctaatcagatggttagagatgctggcagtttaggacctgctgccataaatgtgtgaacaaccttttgtaatctaacctactgacctgcatgttttttctttaccccagctcattccttacatgtagcctcaatcttcagtttgctttactggttcagcaaaagccaggaagaacaactttgtagtaatcagaatgttatccaactgtatattgtttactttatcgtaaatactggtgaacagtggttaataaatagttttatattcctttatgcaaaaaaaaaaaaaagcactcagccacaggcattccttgatagcaacactcaggggactaagatagggccccatgctggtatacagatggcactgctgaaaggagtcagcagccccggcccttgatggagacgctgaggaacgaggcagaaagatcagtggactcagactccgaagggtcgatttctagttctggtcctgcccccatgagctgtgtgtactcagttgagcctctttacctgtttccgcatgagtaaaatgaaaatatgatttctgtcctctggtttttcctaggatagttgtcaggagcaaagtaagatactggctccaagctgacccactacatcccttacctgcttcagtcttctttgtaacatctgaaatattgtatttgggtttaccttctgtctctgctagcaaaatgtcatcttcctgagggcttggtcttctttgctgttgcaagcctcagagatgacaacaatgcccaacatagtagatgttcaataaagacgtgcaggccaggtacagtggctcacgcctgtaatcccagcactttggaaggccaaggcgggaggatcacttgaggccaggagttcaagaccaacctggtaaacagcaagaccccatctctatgaaaattttaaaaattaaaaaaagtatgagctgggcatgatggctgcacagctgtagtgccagctacttcagaggctgaggtgggaagatcacttgagcccaggagttcagggctgcaatgagctatgactgtgccttgggtgatacagcaggaccctgtctcaaaaaacaaaacaagaacaacaaagacaaagacacgcagagtgaatgtgaacctgtgtatcacggggaagttatttgaagatacatctcaacagctatggaaatatcaagccctttgtacacagtgattccacttctgagaatctaaaccccaaataatccaacatggagaagaagccttagaggaactgatgttcatcctgcagtggccaaaattgctcaaacctgaaaagccagccttagtaatcaagatgagggtgtaattagcacaatcccgatgaatctcatttgtgaaattgcagacagccattacaaatattgtttacagcaagatgagttaatttttgtagcacacacacaaaaccataatgtgtaatgcaaaattataatgtgtaatgcaaaactaggttgcaaaagcaacccaattactgagatgacaggagccagcacccactgtcccccatggccacactgttggtaatgtcacacatgatctctccggagggcaatttggaaattcctactacaatgtaagtgttcatgccactagacccagcaattgcatttctatgaatctatcctagaaatgtattaggaaacaacccagatgtctatgaataggggaatagttaaataaattatagttaaatagatcactgtataatcagctgagtgcagtggctcacgcctgtaatcccagctactagctactctggaggctgaagccagagaatcacttgaacctgggaggcagaggttgcggtgagccaagatcacaccactgcactccagcctgggtgatacagtgagactgtctaaaaaaaataaaaataaaaataaatttaaaaaataaaaatagatgactgtatatcaatataatggtatactatgcagccactaaatatgtggagatttgcatatactgatatggaaagatgatcaagactattaaagattattaaattgaaaaaagcaaattgcaaaaaatttttgtgcaataacaatggtgtcatatatgatattataagcatacgctttttttttaaatctggaggaggctgggtgcagtggctcatacctatatcccagcactttgagaggctgaggtgggaggattgcttgaagccaggaatccaagaccagccgggcaacataacgaggtccctctctctacaaaaaactgtttaaaaattagcctgtagtcccagctactccgtagggggctggggttgggaggggttgtgcagaggtgggaggatcccttgagcccaggagttcaagtctgcagtaagctatgatcacgccactgcactccatcctgggcaacagagcgacactctatctccaaaaataaaaaataaaaaattaaacattttcaaaataaaaatgtttttaaaaaatccagaggaatacatactaaaccgttgacaatgattctctccgaaggacagagggagactttcctctatgttgtgaatttctgcagtgtttaaaaaacgtaaactttagctgaaaaacgaaactgaatatgccatatgaacccacttatataagcaaacctaagtcaggcacatgaagactggaaggagctctatcgaggtgttattaacagtgactgatggccaggcaccgcggcttatgcctgtaatcccagcactttgggaggctgaggtgtgcagatcacttgaggccaggagtttaagaccagcctggccaccatggtgaaaccctgtctctactaaaaatactactaaaaatacaaaaaaagttagctgggcatggtggcaggcacctataatcccagttacttgggaggctgaggcaggagaatcgcttgaacccggaaggtggaggttgcggtgagccgagatcatgccactgcactccagcctgggcaacagagtgagactctgtcacaaacaaacaaacaaacaaaaaacagtgatcatttctaggtggtgggataattgagcagtgtttggctttttccttttgagggaaaacctctacaatgagcatgtatggcctcttcaaaagataacccacctttaatagcttctttgtgttaaccgggtgatgctcagggcgtaatgctctgctgatgtaacctgctgttgatggtgtcctgtttccccaggatggatgacatccagctctgcaaggacatcatggacttgaagcaggagctgcagaacttggtcgccatcccaggtaaccatttgcaacttcaccttgtgctaaacaggtgcttgggggcccccagcctggcccatctgtacgcctgggtctggaagacagagcctcattcttgcaatgcagtgctccctgactgcatgtgtcaaacacaacttcgagtcaggaagacctgggttcaagtcctagtgaattctggtcaccttcttgtccttggacaagtcactgtacttctctgagactcaatttctcctcctctgaaaattggctagtaatagtaagagggtctaattcattgagtataaatatcctaaagaggctgggcacggtggctaatgcctgtaatcccagcactttaggaggctgagatgggtggcttacttgaggtcaggagtttgaggccagcctggccaacatggcaaaaccccatctctactaaaaatacaaaaattagccaggtgtggtggcacacacctgtaatcccaggtaaccggcaggctgaggcaggagaatcacttgagcttgggaggtggaggttgcagtgagctgagattgtgccattgcactccagcctgggcaacacagcgagacactgtctcaaaaaaatatataattaaattaaattaaatatcataaaaatcgatgagatgatgcaaactaagtgcttagcttgatatttggcctcaagagtccagtaaatattagcaattatgaccattattatcctacttgggaacagatgaagtgtgtacaaactctaactttgaagtcaccccagatttggtagttaataatgcctgacttatttggcatcttctccaaaaaattttcccctgcccatcaggctgtgttagttgccctctgtggggcttacccttatcaaaatgctagtcccaggccaggcatggtggctcacgcctgtaatcccagcagtttaggaggctgagagggcagatcacttgagttcaggagtttgagaacagcctggcaaacatggtgaaaccccatctctagtaaaaatatgaaaattagccaggggtggtggcgggtgcctgtaattccagctactcaggaggctgaggtgggagaattgcttgaacccaggaggtggaggttgcagtgaggtgagatctcaccactgcacttcagcctgggtgacagagcgagactccgactcaaaaaaaagaaagagagaactgagtaatttataaagaaaataagtttaattggctcacagtcctgcaggctgtaccagaagcatgatgctggtgtctgctcagctgctggaaggcctcaggaaacttataatcatggcggaagacaagggagcagacatgtcacgtgcccagagcaggagcaagagagtgaggcgggaggtgccacacacttttaaaagaccaaatctcatgagaactcactatcacaaggacagtaccaaggaggatggggctaaaccatcatgagaaacctccatcatgatccaatcacctctcatcaggccacgcctccaacactgggtattacatttcaatatgagatttgggcggggacacacatccaaactatatcagaatggatgctgctgattggttggggatgcaatcataggtgtgtgaaaaatgattctcaggggtgctaagtccacttctgggtggcaggtccacgtggatcatcattcatcagaaatgcaaaacctaaagagatatctcaaaaggctgatcttagattctgcaatagtgatgttatctgcaggagtaattggggaagttgcaaatcttgtgacctctggaataatggcagtagtcatttatgtctacaccttagcagaattcagcctcctcccatccttctaacatgggggccttttattagctttacaaaggcagtttagttggtggaaaaggttataatcatttaaactataaactaaatgtctcccaaagctagcatggcctaaacctgggaatgattaagggcagcttggaggttaaaggcaagatgggggttggttagatcagatccctttcactgtcctaattttctcactgttatcatttttgcaaaggtgttttcaaataggccagataagcacccaccattacccttgacttgaatgtttttgccatgctgtcagttcaataactatgtcccaagaggctgttctgcagcaagctctgaacctaggagccgggcttgcagtgatgaacagagaacggttctccactctcaaggagcccccaggttagcagaaagagactgggcccagcacacagtgggtgcccataagtggcagttcttactgagctacaagtgcagcatgatgagccttaaagcagcgtttcccaaccttcaactattgacatttggggttgacaaatgtcagtatcttcctttggggttgatcattttttgttgggggtacggggctctgtgttgtgtcttgtgggatgttgagtttcatccctggcctctacccactacaggccattagcacaacgtacctctccgctacccctcaatggtgatgttacctgaaagggatcctgatccagaccccaaagttcttggaccaagagcaagaaagaatttagggcgagtccgtaaagtgaaagcaagtttattaagaaagcaaaggaataaaagaatggctactctgtaggcagggtagcagcttgggctcctcgattgattgtacttatagctatttcttgattatatgctaaacaaggggtagattattcatgagttttctgggaaaggggtgggcaattcccacaactgagggttcctcccctttttagaccatgtagggtaacttcctgatgttgccatgacatttgtaaactgtcatggcactgatgggagtacctcttagcatgctaataccttataattagcatataatgagtagtgaggacgaccagaggtcactttcatcgccatcttggctttggtgggttttggcagccttctttactaatgctgttttatcaggaaggtctttgtgacctgtatcttgtgccgacctcctatctcatcttgtgacttagaatgcctaacctcctgggcattcagcccagtaggtctcagccttattttacccagcccctattcaagatggagtcactgtagttcaaacccttctgacagtgacaaccaaaaatgtctatagatgtacagatgttgctgaatgtaccccaagcgaggtcaggggggtgtgcaacattgccctatgaaaggaaaataaagtcccaggaccccaattcactataccaaaaggaaaagttaagcttgggaactatgagtcatacaaaaacctacttttttttttttttttgagacggagtctcgctctgtcccccaggctggagtgcagtggcgcgatctctgctcacagcaagttccgcctcccgggttcatgcctcagcctcagtctcccgagtagctgggagcctgtaggcacctgccaccacgcccggctaattttttgtatttttagtagaggtggggtttcaccgtgttagccaggatggtctcgatctcctgacctcatgatccacccacctcaagcctcccaaagtgctaggattacaggtgtgagccaccacacccagccaaaactgcctttctttttttcctaaacagatagctgcaagatagaaaggccacctatcttcccaggggcctccctcaccctgtcaatgtaaattaacagcttatcctaacaggtaggggactaagacaagactataaatcatcgtccctccgcccacccggagacaaatgcacatttgacttcctcctctactccgcgtttcctttatcctatgtaaaatgcaaattcactgagggccagagaatgcaatcctccccttcctgccctctctttcccctttaaatattgaagtccttaagatcctctgcagaaaaaagcacaggccggggatcctattgctgcctgtgtctctttttcccaggtgcctcctcgactttggcaaaataaacctccagattgattgagaccttctcagacactttgcagcttacagctcccacataagaactactactttagtaattagagtgcagcaatctgggtttgaattcagccttagcaggcaggtgaacttcgtgaaagttcgcgacttaatttctctgagccttgaattccttgttgggaaaatgaggccaataatactaccccccgcatggttgttgtgaatatcccataaataacaaaggcaaggtgtaggagtcttccacacagtcttgttgtaagggtagtgtgcgcaatgacagtagaactgaatcctctagctttcgtgagcatttactaggtgcccagcactgtgtaggccctaaggataaacgagtgaatagactttcctagttgaaagagagcgacagctagtgggtatggggtttcttctgggggtgattaaaatgttctaaaatggattgtggtgatggttgcacaactctgcaaatacacttggaacagatgaactgcatggtatgtgaatcatattgcaataaagctgttaccaaaaaaagttaaatgtcaaacataaaacaacgaaggaatgagggaaaagtaccaaagtctattctccacccactagaaaccccaatgcaattgatctggcattgttggctttggactctggcattgtaatagaactcaacttgtgatatggtttggctgtgttcccacccaaatctcatcttgaattgtagctcctataatccccgtgtgttgtgggagggacccagtaggagatgattgaatcatgggggacagtttcccccatactattctcatggtagtgaagaagtctcatgagagctgatggttttataaggggtttcccctttcgcttgattctcattttctgtgctgcctgctgccaagtaagacgtgccttttgccttctgccgtgattgtgaggcctccccagccacgtggaactgtgagtccattaaacctctttttctttataaattacccagttgcgggtatgtttttatcagcagcgtgaaaatggactaatacaactagggtctgctttcctggcacagtaagaccagctgtctccccagagtttttgcagtggtaaaaaggaaacagtttatttgcaaggctccaagccaggaggactgggcagctaatgcttcaagcctgacctcctcaatggcttataggtaatgttctgtccaacaggttcaccttgccctctgcctagacaaacctgacttatcaagactggggaattacaatagagaaagagtaattcatgcatagccggctgagggagactggagttttattattcctcaaatcagtgcccctgagcattccaggatcagagtttttaaagacgatttggtggatgggggtgggggtgcagtgagaatggagtgctgattggttgggtcggagatgaaatcacagggagccgaagctgtcctcttgcactgagtcagttcctgggttggggccacaaggtcagatgagccactttatctgggtggtacccactgacccatcaagtgcacggtctgcaaaatacctcaagcattgatcttggtttttacaatagtggtgttatcttcaggagtaatctggggagggtcagcatcttgtagcctccagctgcatgattcctaaaccataattcctaatcttgtgcttaatttgttaagtccattttcacactgctgtcaagaactgcccaagactgggtataacggaaagaggtttcattgactcacagttcggcatagctggggaagcctcaggaaacttacaatcatggtggaaggtcaaggagaagcaaggcactctcttcacaaggtgacaggaaggagaatgaacgcaggaggaactgcccaacccttataaaaccatcagatctcatggaactcactcactatcataattcctaatcttctggttaatttgttaagtccattttcacactgctgtcaagaactgcccaagactgggtataaaggaaagaggtttcattgactcacagttcggcatagctggggaagcctcaggaaacttacaatcatggtggaaggtgaaggagaagcaaggcactctcttcacaaggtgacaggaaggagaatgaacgcaggaggaactgcccaacccttataaaaccatcagatctcatgggaactcgctcactatcacgagaacagcatggggaaactgcctgcgtgattcagtcacctccacctggtctctcctttgacacgtggggatgatggggattataattcaagatgagttttgggtggcgacacaaagcctaaccgtatcacctacaaatgcagtctagttcccaggcaagaagggagtttgttttgggaaaaggctgttatcgtctttgttttaaatgataaagtaagttcctcccatagttagttcagcctatgcccagtaatgaacaaggacagcttggaggttagaagcaagatggagttgattaggtcagatctctttcactgtctcttataattttgcaatggcgatttcagtgcaggtttttaaaggcaggggtaaatttcagtcaagcagaagttacaggcaaaattgtaaatcaatacattgagattacatatcaattttggcctaaaagggctgcatacgttgaagctggggctcacaggtcataggtagattgaaagattttctaatttgcaattggttaaggaagagaagctttgtttaaaaatcgggggtcaaggccaggtgcagtggctcacgcgtataatcccagcaccctgggaggccgaagtgggcagattgcttgaggccaagagttggagaccagcctggccaacatggcgagacccccgtctctactaaaattacaaaaattagccgcgtgtggtggcgcctgcctgtacttccagctactcgggagactgaggcaggagaattgcttgaactcgggagaggggggttgcagtgagccaagattgtgccactgcactccagcctgggcgacaaagcaagactctgcctcaaataaataaataaataaaaataataaaaatcgggggtcagcagaaaagaatggcatccctggcccatgggtgtgactccctccaggcctctctggaagacacttagaacaaggaaagatggtcagaattcagtccttagtcttcctttatctgacgtctatatgccagtggatccatttggtagggtcctgggtttctgaaaaacaactcagacatatatgctaagatgtttatcttcagtttctatagaaaacaaaacatctccagattctaacttccttggctattgttttaggctactattaccttcttactgataagttgcttattgacttttcaaggctagctaggtgcctagaatttcctttgagggaactcaagattttcctttatttccatgcttggggtgggggtctcccacagaccccaaaagggagtccctgtgttactggtggaaggtgtccaggttcttggtgttttgaacaaagaattggacaaaatgcacacacaaacaaaataagcgaggaaagaatgaagcaacaaaagcagaaatttattgaaaatgaaagtacactccatagggtgggagtgtgcctgagcataggggctcaggagccccaatacagaattttctgaggtttaaataccctctagaggtttcccgttggctacttggtgtacaccctatgtaaatgaagtagtggcccacaattagtctgattggtcgcagaaagcttttgcagttgctttctgcgaccaatcagatatactttcaatttctcatgtgacacacagaaaaggaggagggtttgcaaagggagtagcctccagtccttttgttacttatgtgtggaaagttggggtttttcttttgatttagttctaggaagttggccctaggttccctgcctccagaccatattctcctgcctcacctgatccatctcagcattagtaatttttttttttttttttttgagacagagtcttgctctgtcacccaggctggagtgcagtggcgagatctgggttcactgcagtctccgcctccggggttcaagtgaagtgattctcctgcctcagcctcctgagtagctgggactacaggcgcccgccaccatgcccggcaaattttgtttttgtatttttagtagagactgggtttcactgtgttagccaggatggtctcaacctcctgatctcgtgatctgcccgcctcggcctaccaaagtgctggaattacaggtgtgagccaccgcgcctagccgagcattggcaatttttaaagctttgcacctgattgtgataagcagggacggttaggaaccgccaggcctgttcccctctctcatttcacaattctccaaggattagtctggctgaaaggtacagaaacccatccaagcttatgtaagcacaaaacaaacaattactggaaggacagtggagtctcctgaagccctagggcattacattcatttcccagagctgcctaacaaattggtgcaaactggatggcttaagcaacagaaatgtattctctctcggttctggatgtattctctttcggttctggaggccagacatccaaaatcgaggtgtcaacagggccttgttccctgctaaggctctagaggagactcctttgcctcttagcttctggtagtgttagtgaagtagtgttgttgactggggtaaatacccaaggttcgttgtctctctccaagcagattaaggacacagacactgacatacagaggagtgagtttaggagtggaggtttaataggcaaaagaaagagaaaagggaacagctctctcggtctctctcgagaagtccctgaatgggaattccggcctgtggcagactgcaccaaattttatagacaagcttgaggaggtggtgtctgatttacatagggcccacagattggttggagcaggtgtgacgtttgcatagtgcatgggaaggctggccaccccaccctaatcttatcatgcaaatgaactttccacttgggcggcgccatgttgtcttctccttactgtacacatggctggcaaagagaagggagcgtggagccgccattttgaacatacctagaccaggtggccttttcctatgggcacagctgccagcattcacccgtgtaagcttccagctcccttgactatgtctacagctcgattttactggctgctccttgttagaaaagaaaatgatttgggggttgcttttcattaaaaggaaaaccttaccgaggacttccttaccctatctgcctaaataatttcttcttcactcctgtatcattagcagtagcaaatccatacgagtctgaagcaacttgatacttgcctcctcagaggaaataattccaccagcgggcataaggcagagtgagagaccgaggcaagttttagagaaggagcaaaagtttattaacaagttttagagcaggaatgaaaggcagtaaaggacacttggaagacggccaagtgggtgatttgagagatccaagtgcaccgcttgacctttgatttggggttttatatgttggcatgttccggggttttatatgttggcatattccagggttttatgtctctcctcccttcattttccctcagggcaggttgtgcgcatgcgcagtggcctgccagcgcttgggagaggctgcaaacacagtgtatttacagaagtcatgggcctgattatttgagatgtttttccctcaccagttgagtgttcctagaggaaggtcatataccagttagactccgccattttgcctcttaatgtgcatgcttgagcccagttgcccaactcctgagatctcatcgggaaaccgctgataacttcaggtgttttctgtctgttgggagatggcctttccctggcaccagctgtgaccaattattattttagagagacaattttaacaactgcctgacatcacctgatggttgcctggcattccttgggggggaaatcccctctcctttcttgctcatggctgcctggctacctactctaacagtaacacacacaattcttggcattgcttgccttctggttgcaccacttcaatctctgcctccatcttcacgtgaccctgtgtgtgtctgtgtgtcttctcttctcctctttttttttttttttttctaaaagacagggtctggctgtgttgcccaggctggtctagaactcccaggcttaagtgatcctcctgcttcagcctcccaagtagctgggattacaggttcaggccaccatgcttgggtctctttcctcttctcataaggacacaagtcattgggtttagggtccatgctaataagtatgacctcattttagcttaactattataattacatgtgcaaagcaacttacaaattactttggaaatagagtatttccaaatagaagagatataaactggggaaaactatttccaaatagggcacacatgaactttgggggtgccttagtctctgtggcttgctctagaccgggggcttgtaaacaacatttattacagttctggaggctgggaggtgcaagatcaaggtgttggcagatacagtgcctggtgacggcctgttccttatagatggtaccttctcactgtgcctttgtgtggtggaaggggcaaacaagctcccttgggtctcttttataagggcactaattccattcatgagggttctaccttcataatctactcacttcccaaaggcctcatttcttaatactatgaccatggaggttaggatttcagtgggtggcacctgtaggcaagtggaagatgatgggaaaggtatgtggcacacacgcacgtgagcagcattggccaatgacttggagacttgggctagtcataggtctgtgagctgacgcaggccacttgtgtgagtaggtggtttctcctgggagttgctgcagctgaggctggggaatgcctctattggtgagtgacagaacacatggatgaatggcttggagacagaggtttgcagatgttgggggcccagccagttgttgggtgattctggctaagatctagagagcagtggagggcacttgggaatgtcagagtgctgtcaatggttatttggagagtaaagtcacaccacgagctcctgagtgagcaggggtcctggtgagtcgatgggtgttggtgcgtgcttggagagggcagggagcggctctgcggtgctgacgagtgatttggggaatcagacccaacccacaagatttaccacggcaggagcagtgacaccatcatccaatgcaccaatggctgggaatggggagcggctggcaagcctattgcccttcttcgtgcagtggtggactcctggttaatgagagaaaccaactttctgtcctatccaaatattatgttctccttacccctggttctgcttccagatccagaaaaaatgatcaacgtcagtcgtgggcaggcagacaagctgtcccacattttttattctgaagggatttgagcagaaagagcccaagtgggtttaagtttttgcctcttaattttctcaaacctcatcttcagccctctctcttttttttattttttctctttggcatcctagcacttggtgtttgggacagggttagtgtcattggcatggatgattttcttctgataaattggtttaccttcaccaaagggaaaaaaacaactagttccctcccagcacccctatctgagcctctcctcaccccctgcctttgcagaagaccctggctttgtcatgaccatttactgaaggctctcagccaaggccaagcactccactaagccatttactaacactactgcatttcaaaattgtatgcaatttagtatgcaggatgtgcaggtttattacataggtaaacgtgggccatggtggcttgctgcacctgtcagcccgacacataggtattaagcccagcatgcattagctatttttcctgatgctctccctccccacactcaccctgccctctcaatttttttttttttttttaagagacagggtctttctctgttacccaggctggagtgcaatggtgcaatcataactcactgcagcctagaactcctgggctcaagagatccacccacctcagcctcccaagtagctgagactacaggaacactccatcacatgtggctaatttacagagaaaatttttgtagacataggagggtctcactatgttgcccaggctggtcttgaactcctggcctcaagtgatcctcctgccttggtctcccaaagtgctgggattacaggtggcaggcactatgcccagcccattactcccattttaagcctcactgtgtattttacagatgagaaaactgaagcttgaagaggtcaagttgcttctccaagttcatccagagggtggaagggcagagtcaggtctccaatcaatcctggccgctcagctcaagtgcttttttttttttttttgagacagagtctcgctctatcacccaggctagagtgcagtggtgcgatctcagctcactgcaagctccacctcccgggttcatgtcattctcctgcctcagcctcccgagtagctgggactacaggcacccgccaccacacccggcgaattttttgtatttagtagagacggggttccaccctgttagccaggatggtctcgatctcctgacctcgtgatccgcccaccttggcctcccaaagtgctgggattacaggtgtgagccaccgcacccggccagctcaagtgcttttagtggtcaccctctcatctgtctctctgtaattttttgttttttttttctttcttgaaatgaagtctcattctgttgcccaggctggagtgcagtggcgcagtctcagctcactgcaacctccgcctcccaggttcaagcaattctcccgcctcccgaggtggtggctgacagcctcccgagtagctggaattccaggtgtgtgccaccacgcctggctaatttttgtatttttggtagagatggggttgtttcaccatgttgaccaggctggtctgaaactcctgacctcaagtgatccgcccacctcagcctcccaaaatgctcatctgtctccttgttgatgtcttctttccagaaaaagaaaaaaccaaactgcagaagcagagagaggatgagctaatccagaagatccacaaactggtgcagaagagagacttcctggtggacgatgcggaggtcgagcggttaaggtgagtgcactgcgggtacccgatcactgggctgcaggacagcaaccttctgcttccttccagaacccatcttctgctcctgggactcacagccttgcctaacaggcatggccttgatccacagtctctggacactgaatcccaaggaaccccagccttctggcttgagaattcattttgtatataagagaatttcaaatctgtgcctcttgagggaatgttgttccaggaagtgaccagggaggagtcacatcccataatacatggcagagcttccttcacatcctgtcactcctgaaggcaatgtcttgaaacttctgctatcagtttctaccgaaactctgccacctgaactgacttgctcccaacctctgtcctcccaacctcccagctttgttctcccctttcccttccccttagtggcgccaatgcccttttctaagtatcagggtcttctctttgcatctgctgccttgacctcgacaaccacagccctggagctgcagtgtaaaaacatgttgtaaatgttgaaaatgtggaaagctgtacatgttggttcttgatttttgtttccttacaccagagcaaagcttttagggcctttcacaaggaaaaaggcccttccaacccagagggcaacttgctctttattgtctgtgttctcagagacctttcttcaagggtcctgggactagcagttccactgcccttcttcatgctgcaatggacttctggttaatgagagaaaccaacttttccctcctatccaaatattatattctatggtcgggtacagtggctgacgcctgtaatcccagcgcttctgggaggccaaggtgggtggatcacctgaggtcaggagttcaagaccagcctgggcaacatggtgaaaccccgtctctactaaaactacagaaattagccgggcgtggtggtgcatgcctgtaatcccagctacttgggaggctgaggcaggaaacaatcatttgaacccaggaggcagaggttgcagtgagccaagattgcaccaatgcactctagcctgggtgacagagtgagattccatctcaaaaacaaaacaaaacaaaaaatacagaaaactacaacaaatattatattctccttacctccggttctgcttccagatctagaagaaattatcaatgccagtcttgggcaggcagacaagctgccccaacatagtgagacccccctatctctacaatttttttttttaattaactaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctcttcaaggcagttcagcaagtctgcacccacctactttatcttggtgatccttggaagagctggggtgactcgctctctgagacctgcctcatactttgtgggagcacaggtgaatagggtggcttcaaaatacaaggtcaggagaggtgctgcctcactcactgaccccccagcagggtcctgtaatgtccctgcctctgccctggggtcacatacctacctctgggtaagcatttaccccatcattgatatgtgtctctggttcagagcaggttcaccagatacaacatatacatactgtacacgcataacacgtgacaacatacatgccccatccacaaagcctgttgcttaacctattggtttatttcattggttccttgatgctttccttgcttgctgtgtatcttcttttcttttacccatctactttcacagggagcaagaagaagacaaggaaatggctgatttcctgagaatcaagttaaaacctctagacaaagtaaccaaatctccagccagtgagtatatacattattcattcccctcccccacaaaagagaaaagtatatttcaggccaggcccacagtggatcacgcctgtaatcccagcactatgagaggccaaggtgggtggatcacctgaggtcaggagttcgagaccagcctggtcaacatggtgaaaccccgtatctaccaaaaatataaaaattagctgggcacggtggcacacacctgaaatcccagctactcgagaggctgaggcaggagaattgcttgaacccgggaggtgggggttgcagtgagctgagattgggccactgcactccagcctgggtgacagggtaagactttgtctcaaaaaaaaaaaaaaaaaaaaaggccatttcagagaagtctgggagccataaggggcgcaacaaaatgctttctagagatcagatctagagatcagatttcagcatgggatgacagcaggcaggaccagcctcacgggcctgcaggcagttgcctggggcctcatgcctgaccagcctcatgggcctgtaggcagttgcctggggcctcatgcctagaagggtgccatgcttggtttaatgttctcctgttgctgtctagaaattgttaatacgtttggaacatggggccctacattttcatattggattgaactctgcaaactacgtacctggtcctggtagttgttcctccctaattgcaaagtttggtgcatttcatagaaagaattgggtagctactgaggctcagggagctctggcctctcttaggtctggaatctctggagaagccagaagcatatgtctcagaatattaacctcatcagatcctcagagcaaagagggttttatatgaaataagtttgagaaatgctgtttacttgaccctgtatttggagagtcccagtgtccattaggatattaaagtgatgatggatcctgctgtcaagaaactgtcttttctttgttgacccagcgtttctcaaatgtgtttaactgctgtattagtgaggcctctttcagttagaagaaatggatgcctggctgggcgcggtggctcacgcctgtaatgccagcactttgggaggccgaggcgggcggatcacaggtcaggagatcgacaccatcctggctaacacggtgaagccccgtctctactaaaaatacaaaaaattagccgggcttggtggtgggcgcctgtattcccagctactcgggaagctgaggcaggagaatggcgtgaactggggaggcggagcttgcagtgagccgagatcacaccactacactccagcctgggtgacacagcaagactccatctcaaaaaaaaaaaaaagaaagaaagaaaagaaatggatgcccaattcaaactggtctaagcaaaaaaaggaatttgttggagaaagagcaacaagaactagagcctcaaggactgaacactattacctcccctccttttcttctttttctcatctctgcctctctttgcatgtaagcatcattttttcctacaacacaggccttctccatgggaccagaaccctagaaccatagcttagcaactctgaagcaataccacaggttcttttccctggtatcgaaatacataagtctcagggaaatattctcacccgcccttctgggattatgttcccacctcttagatccattaccatcaccaagaggctgggggtactgggattggccaggaatgtataacatgcccactcctgcagccacagggacatgagctgttagaggaagagggacttgaaatcttgctgggaagacaaaaaccaaaagctgccactgtctataaaactacaaacccagttttcattaacatcctgtgaaagatggttggagggagtaaggaaagagaagggcaatgatctcttctgctggctcctataaccacaaggcacgtgatcactgccgaaggccagcatcctcagtggaccctttcatgaaaggcaaggtagaaaaactccacttagcagcatggaggaggagcaaggaaacttgccttctctattggattatgggtggaaaaaagaaatgattctggcgagaaatcaaaacaccaagcatgcaccacatgcaaggggccaactttacactactcatctggtactggaattccaagttgaaaaataaaaactattgtaaaaccagtgaaatctctgggatcctagcagatttagcaaatgcaaaactgctcagtagggattcttctggatcccatggtatacagtattctcacagaaaaaagcaacccccttgaagatgagccctcaataaaaatgaaaaacccggccgggcacagtggcttatgtctgtaatcccagcactttgggaggccaaggtgggcagatcatgaggtcaggagctcgagaccagcctgaccaatatggtgaaaccttgtctctgctaaaagtacaaaaattagccaggcatggtggcgcacacctgtaatcccagctactcaggaggctgagcaggagaatcgcttgaacccaggatgcggaggttgcagtgagccaagatcacaccactgcactccagcctgggtgacagagcgagactccatctcaagaaaagaaaagaaaagaaaaacccatgaagaactgaatcaccatgaggagaatcagtagatgcaccaaagagaatgtcctcccaagaaccaaaaatatagaactatttaaaaaggaaaataaactaagtacttttaaatgatcaaagagctaagagaaggaataaaacccaaaatgaaatagtaagatgctatgaaaaaagaataagtagacatgcaaaaaactggccttctgaaatttttttttatcaataaagtaaaaactcaatggattaaatacagagacacagctgaagggagaatttatacattggaagacagccctgagaaagttacacagaatgcagcacaaagagaaaaagagatgagaaatatgaaagagaagttataaaaccgagaggatagagtgagaaggtccaacttacatgtgataggcattctaggagataaaacagagaatgggaggtggaggtatctgaaaagacaatgtatgagcattttcaaaaattgaaaaatatgagccctcagattgaagtgacttgaacaaaatttcccatttatctatttaccaaatacttcttggatgtcaggccctgtgctaggcttggcaggtacaatgatgataacagctgactaggagaagggctgaaagttagggttggaagctgagcattgaggaccatataaaatgaggactataaaatgaggaccagctgaggatcatatgaaatgtgcatcagctctccataccacctgaacaaggcctggaacaagacctggccaggggttgcagtggggctgggctgcagatggtcagggctctgctcacctcacctctctctctctgttcctttctccccctctccctgtgcccacatcttgctgcaggctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtctt

SEQ ID NO: 37778 - DNA, 503221 bp, Homo sapiens
  misc_feature (106498)..(106499): n is a, c, g, or t
ccaccaccctatctccaggaaggcctcctgaatgctccccacactgaccccttcttcccaccaccctatctccgggaaggcctcctgaatgctccccacactgaccccttcttcccaccaccctatctccgggaaggcctcctgaatgctccccacactgaccccttcttcccaccaccctacctccgggaagccctcctgaatgctcccggcgctgaccccttcttcccaccaccctatctccgggaaggcctcctgaatgctcccggcgctgaccccttcttcccaccaccctacctccgggaaggcctcctgaatgctccccgcgctgaccccttcttcccaccaccctacctccaggaagccctcctgaatgctccccgcgctgaccccttcttcccaccaccctatctccgggaagccctcctgaatgctccccacgctggccccttcttcccaccaccctacctccgggaaggcctcctgaatgctccccacgctggccccttcttcccaccaccctacctccgggaagccctcctgaatgctccccacgctggccccttcttcccaccaccctatctccgggaagccctcctgaatgctccccgcgctgaccccttcttcccaccaccctatctccgggaagccctcctgaatgctcccccggcgagcatctaagctccagtgcccctcctccccagcccgtgatactgaccatggcctttggcaccacagggcttcgtgggctgaggtgaaggtagcctggctgtccagctgacctatctggcctaaaaacgagaggtgcaggggatgtggttggtccccagtgctctgctgttaactctggggctccgagcagtgacacaactgttggccgttaccaggaccatggtccaggctggggcaccgtggggcagctgggcctactgctcagaaagccggagggtgggagctgagtatgagggtcccttgtggccacctcagcagcccaggtttaggggacttcacgggctctgggattgcccaggtagctggtgtggggacatccttggggtcctgtgccttccgtgatgcctggcctcgtgctaaatgctgatggttttctcaagggcacttgggaaaggaggaatctggggaatggagggtcctgctgagaggacttgacctgcaaggtgaatccatgactgccggttcccagcccagcctggctgtggcctgaggtatcttcggcctgcggtctggttgtctagcagggctggaggagacaactggtgccctcaatagccacattcagcctcagcaggagcaagagaagaggcaggatggagacggggcaaggtccctggctagacctgggcggctgacacaccctgagctggggagatgaggtccaggctgggcactgttagggtgagtggacccccatcccttcccgccctgagcagaaactgactgcccacaggtcctagtccggcgacttcctaatggcacagaactccgaggccgcatcgtggagaccgaggcatacctggggccagaggatgaagccgcccactcaaggggtggccggcagaccccccgcaaccgaggcatgttcatgaagccggggaccctgtacgtgtacatcatttacggcatgtacttctgcatgaacatctccagccagggtgagcagtgctggggcacggggggttggagggccggcagagccctgtccgctagcagccaggggaccactaggaggactgaggtggggccagcatttgagcgaggaggtgccacttccaggccaggccagggtttcgggagctctggctacgctgacggggcagggctggttaggttaaaggggtagaaagggccgggtggggccgggcgcggtggctcacgcctgtcatcccagcacttcgggaggccgaggcgggcggatcacctgaggtcaggagttcgacaccagcctggccaacacggtgaaactctgtctctaccaaaaatacaaaaattagctgggtgtggtagtgggctcctgtaatcccagctactagggaggcggaggcaggagaatcgcttgaacccgggaggcggaggttgcagggagccaagatcgcgccattgcactccagcctgggtgacagagcgagactccatctcaaaaaaaaaaaaaaaggaaaggaaaagaaagggttggttggagtggaggcagaaagaaggccgaggacacagtgtcgcctgcccttgacggaggcagcacatgaggatgagaagctgattggagaagaggatgactgcagtgctaagagcagcgtggtcaggttgccaaggatggagcagtgggcacagcagggggacttagggtcggcggaggagtcggtgaggaaagggaggtttggcaggaagtgatcaaaggggtcatgtttttgtcaggatgtgggacttggatgtgttctgtgtgaaggagccagggcacggggctgtggtgatgagggcggccaggctttgactcatttgcaggcggctctgtgggggctcagtgagacaacgaggggcgtgtgccctgcacccacagggatgtagagggtcctgctcctccctactgaggtgggtcagggtgggcagcaggcaccccacctggtgagctggaagcagcgtgggaatcacagaatggacgggaacttaaaggctttgcttggcctggattttatcttgaaatacttttgacagctggctggttgagggtatctgctcacaggaacgccgcatttgctggctttgtccactagtgctcgcccctggctgctgatgcggagcctcacgtggccgcagcccaagagtagggactggcttggccacctccaggctaagcttcggactcccaggtggctgggagggccaggggtgcacaggtgcatcagagcaggtgctgccttgctggagggccagggctcttctggccagggtccaggtcatcattgtccccagccaggaatccaaggggcctttccaaacctgcagggcagagggaattcgggtatctgtgcttgagtgagcccctgggcccaggagccttcgcttgctgtctctgtttctcaaggggcctggcctggtgagggagggggctaggctggaggagggatcccaagggaggtgagggggctttgtcagcctcctcctgccctgcctgtgcagggtgttgcagtcagtccttccactgagtcattgcatgggctctcccaacatccggtgcacactggcagctgctctaagccaactcctagcccccaccacttgaccaacacaaacactgagtgggtgaggcagaaggggagcgctggggcctggctaggccaaggcttcctgcttcctggctgaatgatcgcacccgaggactggctctctggagcttcctttgctggctttatagctgctgccagtcacaagaccaggggaagccaggtggaaaggaactgatacccagcatttgtcatgtgtttttaacagtctggctttgtgggggcggccacagtgggggaggccctgcctggtggtggaagccagaggtgcccacaggaggcacacctcatggtgcaggcttggaggatggcaaggtaggcagaggggtctggacacagtgaggtgcagccccctcccaccaggtcagacccaggagatggtgcaggtgcacagagcaggtccctggcccaggcaggaaggcagctgcaccctccctgcagcacaggatgtctggatgtgtactagggcagagaggacaggagcctagggaggctccacttccaaactgtccgtcccacaggggacggggcttgcgtcttgctgcgagcactggagcccctggaaggtctggagaccatgcgtcagcttcgcagcaccctccggaaaggcaccgccagccgtgtcctcaaggaccgcgagctctgcagtggcccctccaagctgtgccaggccctggccatcaacaagagctttgaccagagggacctggcacaggatgaagctgtatggctggagcgtggtcccctggagcccagtgagccggctgtagtggcagcagcccgggtgggcgtcggccatgcaggggagtgggcccggaaacccctccgcttctatgtccggggcagcccctgggtcagtgtggtcgacagagtggctgagcaggacacacaggcctgagcaaagggcctgcccagacaagattttttaattgtttaaaaaccgaataaatgttttatttctagaaaactgtgccttagccagagctcctctaggtgatcaacccatgtctggagctagctcttcctccaggacacgagagctgggggcctgagtacgtagcgccaggcccggtgtggatgctggggagaatcatcagtgtgggagccgaaagcccccgagggtggggtcctgcacagtgggccatgcctccaccagcaagatgtgcacaggtgacagggcttctccagcctagcagggccagcccaggccctcgtgccccagatggtcaggaccaggtcacagcttggctatgagcctgtttgcggcttctgtggactgtggtgaggactgggccaggaaaggctcagggtagcctgggaggaagaagcgcatggcagacagaggtgctggggagggggccacagggcacttcacaaatagaaggctgtcagagagacagggacaggccacacaagtgtttctgcacattcttcagggtggccacagactggggggtccaaggagcaggtgtagggacagaaggagggtctgagaaacgcacagcccacatgggccttgaaggatgcggcctcacccagagacaggagtcctggcaggcccccctccagcgtggagatgcctacgcgtgcggcaaggactggagggaagcgtaggaacacagagggcagcagccccacagcggaaccaccaggggcaaggacagcggggctctgcaggcttcactgggccacggccagcccgcatccacccaatgccaggcctcagggccaagagggctcagcctcagcacggggggagccctggggtggggagacgcgagcgcccacctgcgcaccccagcagccttccgccctccgcctgggctcaggggagcagagcctggaagacggcaatgacagggtcctcgtgggtggtcaccaccagcacgctgcggaacttgtcaaacagcatgagcagctgggagcgccgcgtgttctcgttgtacataatctcctccaggtggtggcggccgcggaagtagtgaaggagcctggaagggatgggtgggtgtgagcccaacctgacaccagcccccagaggcctctgctgaagagccactgctgggaatcagctctgagctgcccacaggcctgaacagagctggtggtgaaggccagggaggcagccaccacagccccccaacaagggtgggcaggcctcctggaccccatgcccaccacggtcccgctgaccaccaggtgggcggagtgggttcaggacggcagacggctgttcaaacccagaggtgcccaagcctgcgtcctgatgttgggaccagggttctgctggtggcttctttttcgtgctacagtgagtcccacgtagctctggagccaaatggtcactgcttttttttttcctttttttgagagacggagtctcactcagtcacccaggctagattgcagtggctcgatctcagctcactgcaacctcccgcctcccagattcaagcgattctcctgcgtcagcttcccaggtaagctgggactacaggagtgcgctaccacacctggctaatttctctcttttttagtagagacagggtttcattatatgttggccaggctggtctcgaactcctgaactcaggtgatccacccacctcagcctcccaaagtgctgagattataaccgtgagccactgtgcccagcctgcttttttttttttgagacggagtctcgctctgctgcccaggctggaggtgcagtggcgcgatctgggctcactgcaactcccgccttcccgccattctcctcctcccgccaagctccgcctcccgccttcaggccattctcctgcctcagcctccccagtagctgggactacaggcgcccgccaccacacccagctaattttttgtattttttagtagagacggggtttcaccatgttagccaggatgatctcgatctcctgacctcgtgatccacccacctcagcctcccaaagtgctgggattacaggcatgagccaccgcgcctgactttttttttttttttttttaatgtcaccatcatttggaaggtcactgctttagggtgctttctgcaactcaggctggcacagaggaggctaggatgcaggtgagacctggaccagctgctcagaagagttgcaagtggttctctcgagggccgagtgtggttctcaaccggaaactcagtccctgacaacccgaccactcccgggaaactatgcccctgcactgtcccccaagtcagggtggggctgacagagaccactgagccacatcacctttaacatgggggaccctggatgcccgcagggcttacagtcctgggcaaacccctgccaagtcccatgagggtgagaacttggcacttaaattagccgggcgtggtggcgggcgcctgtagtcccagctactcaggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaagaacttggcactgcctctcaagggaaaaggaacatctaagaagtactggagagagaagagtccgaaaaataggcatgccaggcccatggcccggcgtcttggtgacaagccgaaccctcaggcctgggcagtggcacctgcccctacacacctgaatgcagagactccatctcgaacagggccccatctgttctcagtggatttggtggttctgttgcgtacgtccctatccactttctgccctgaccctgcaactggccccagtcccaacgggtcaacctacacccacctggcaaacatgcggaggtcctcagggttctgggctgcgggtacactgaggatggctgcgcgttcatgctccgacagctggccagcaggttctccgtcatcctctggttcagtggcgagtccccgctgggaagtagctctgcgctggagttgtccatgctggggctggtgagggtcatgtcatcgctgctggctgtgggggacatgggtcagggtgaccaagtggaattccaggacacccaggggaacagcgagggcagagccagcagccagcctccaatgacacccctaactcctacaagggttagggtacatctgcctgcaagcattcgctgctgccccacctcctgggtgtgacacgcccctcatacggctgacttgggaaacgggtagcctcccctctgggggcaacctcaagggacctgaacagaggtgcgatgtgtgccccacaaacaccccaaggtgggcctgggcatcctgtccctcacccaggatggaggacaaagcaccctgggcaggtggggtcctcacatgaagcatgaagcctacagccagacctcagccaaggggggactttcaaagtcttccacccccttccttccccaagcctggggaccggggacctgggacctggcaacaggctgctgccctcaagccacactggccatgacggctcttctggggcgcagaggtgtcagctgtcctggtagtggtatgagatcctgctctgctcccaggctggggcagagattccagcactgatttgctgggctgggagctgcccctaattctagcaagcctgctgaagagcccggagacagagctgccacctcagagtcacggtggtgctaggagacaggagaggtgtctccacgggggacacgaggcacgtgcatgtgcgtgtgcagctgtgtggaggcccctcatcactcacagcaccacccacgttgagcctcctggatgccacccccaagcgtctcccctgactaccacagcggtgccctgggggtcctacttggggagccaaagctgagggcgttgggcgtgctgaggctgcgaccgccgacccgggcagtgaaggggacgtcgtcctctcgcggacggggctcctcctcgctgggtgaggccatcaggcagacataggtgtgcagctggatgagaagccggcgctgcagcatccacaccaccatctggatgagctgggtctgcgggtggcagcaggtgaggctggtccccctccccactccaacttcctcctgggtgatcagggagccatggccctagacatggccacagcacgctccctgtgctgacgcacaggcagaaaggccctcttctcagaaagggagcccccagctgccagccagctctgcaaggcccgctcaccctcctgggaagggagaggggccaggggaacatctggatcacacctgcacaggctcccaccacacaccggggccacccagcatctggctgaggagcaggacctgagacgtggaggcccctgtgactgcttcgctgagcaaaccccccaccctgtgctgctgcagctgcccctctgcctcctctcttctttggcccactggccctggagttggacccagccagcaagtccacctccacacaagcccagacactgtttaaaaagaggctgtgggcaggtaccctgagagcagaaagtcctctccttggatctacctgaaagtccaccctgagcacaagagtggatccacaagaaagctgaggccagtgaccctgggcttgggggtggagcaccccacccccacccccaccgtgagaaggcacgtcctggccaggccctccaatgtctctgggttagcaggtggggctggcagtgaggagcagtgaggagccttgtgccaggtagagtccagtccccatgagaaagtactgcccagactcaggcgttgaacagtaaggagtgtgagacacatcagtgtcctcagatacacatctgtctactcatctctgggagggtcaacaaggagctgctggccagggtcacctcctgggagggggctggggaactggggatgggaatgggggatatatcccaggcaagtaagaagacttggtcaaaaggactgcaagatatccagacttcacatgaatttaagaaataaaacagacgcgggtggatcacttgagctcaggagttcgagaccagccttgccaacacagtgaaacctcatctctactaaagatacaaaaattagccgggtgtggtggcacacacctgtaatcccagctacttgggaggctgaggcaggagaatcacttgaacctgggaggcggaggttgcagtgagccaagatcacgccactgtacttcagcctggacaacaaagcaagtttctatatcaaaacaataaaaaaaaagctgggcgtagtggctcatgcctgtaatcccagcactttgagaggatgaggtgggtggatcacctgaggtcaggagttagagaccaccctggtcaacacggtgaaaccccgtctctactaaaaatacaaaaaattagccaggcgtggtggcgggcacctgtaaacccagctactcgggagggtgaggcaggagattgcttgaacccgggaggcaaaggttgcagtgagccgagatcatgccattgcactccagcctgacgtgcaatcaaaattaaataaaatcaataaaccaaaaataaaacagaggggcttcccagcactggagcccaggcagaacctggctgacctaggccccttgacaaggcctggagcaaccactcagtcatggcctggaaaagccactccgttatctagaccacaggaggcctctgagaagggagcaccagcagctcctccctaagcactgccccaagagcaggggtgcagagagtgccttttattcagctggtacaacctggctcagctcccagaaaccaagggctctgtgaaagaccgcactgagagctctgtcaggtttagcgtctaacggagctgaaaagccagaatcgttctcattcgtaatttgagaacggaaagggtttaactttaaggactggttttgcctaatagatctggcacttactcagatacttctggagacaaagacttgagaacacccagctcgtctgtctccaacaccgtatcctatctggccctgctctgagtctctgcccagaactcagtggaggggaggatggcaaagccacctcagcacaaggctatgacacctgcagcccacaggggaagccactggccctgccacagatgcaggtgcaccagttcatcccacagacctgcaggaggcctcctatcccccagccactcctagctcccaacctgcctgcccgttgccctgatccaggcccactagggtcctctctaggctctcttgaatgaggagattctggggaccagtgaccccagaactcatacccacagaccctgtggccacctgaaccatggcagggagtgaagacagaagcagaactctcagagggtcaggcctggcccagtgagaacaaaactgcctttgcaccctcatctgtaggcagtccccagtcccaaaggggtacaaggcaggtctgtaggcccagaaaaggtaagcactctcctgcttaactcggttctaacactaaaaactgcctgccacagccagggtgggctctatggggagggaacaactgctcaagtgttgggtcactggccaagcatctgcaggtggcccggcagctgacttttgggtcctgctgggcacgtagcacttgcacggcaagcccccaaaaccaaggagaagcaggtggcagtgctgagggctctcagatcagaaccaacagccaggcaggtagtgcctatccactacacacctgccactctgggctccttgagcttctgtgactcacctcctgcacagcgggggccaggggattcctaaattctgacaaggagaccggcaaggagaacttggcaagaacggacggcaggtcatgagatgggaactggtgggagaactgctcggccagcggggagtacctgcaggcaggtgagcatgccagtgagtgcagcagacccccccaccgtgttctcaacactggcctcagtgggcagcagagaagcaaagtgtggcaggtgggtcaggacagtgcgatgagggcagaacggtatgaggccaggcaggcctccaggtggacagagcctgggcacttccccttgagcagcagcaggagccatgggcacagttcatcctgcatctcacctctgatccctcaaggtggattagaagagccagcctggaggagggggccaggcatatgggggacacaggagagccacagagcacagagccagaccagaattgggacctgggtatgctagtggccaggagttaggctgaagtgagagcctggccttggggcttccacagcctttggtgcctggccaacacagagaacagcatctggagggccctgccagcctcaccccttcccactcggggctccaggctctggcagccagcagcactcacagacatacgctggcattgggagacagcatgtagacgttgttctcacacagcgggtagatgatgatggccttgccccagtacaccagatgagctgcaagctggaaaacctgcaggcaaaagggaagctgcaaggaccatgcctgaggctggcccaccgggagctgtcagcagctctcagcctgggtggccatggcctaccagcctggagaagctggccccagcctcatgcagaacacacctggtggctatggcccgagacttcctccctaacgtggaatagcaccttcgcaacctctcactaggatgtggggcacagccagcacacagcactttctgtgagcaatggtttttttttttttttttttggagacagtcttgctctgtcgcccaggctggagtgcagtggcacaatctcagctcactgcaacctcttgcctcccaggttcaagcgattctcctgcctcagcctcctgagtagctgggattacaggcacatgccaccacgcccagctaatttttgtatttttagtagagacagggtttcaccatgttggccaggatggtctcgatctgacctcgtgatccacccaccttggccttccaaagtgctgggattacaggcatgagccaccgcacccggccacaatggcctttttgtcactgctccctgtgctgtttggtggcactgttttcccatcctatgctgtcttgactcccactgaagaatggtggtctcaggccacaagcatgggaatgtctggggtgctgggaacacagtgctggcccagctgggcagggggcttagctggatgtcctggcaggggcacagccctcttataccccctaaaactccagcatggccttgcccgatgatgggtgtggagtcactcagcatgccacccctacatacccaaaggccccaggtctgccccatgtgccccgactcccacagagacccccctcccagctttgctcttgtggacccttgaacatcaggaaacacaaacacaacccaaaccccttccagaggaaagctcaggcctgaggtctgagagcacagcaccccagcacttcacgaaaaggtgtgtgaaatcctaagctctcgcacttctgcctctgcatcagcccaggacaccactccaccctcttggcgggtaggcctctgtggaggtgagtcacccctgcctggacaccgtgctgccctgctgctgaggacacttatacctcagctcagaaaacagggcctccagactgagtgagtggctcatgcctgtagtcccagcattttgggagggcaaggcaggaggatcgcctgaacctcggagttcgagaccaacctgggcaatatagtgagaccctcatctctgccaaaaatttttatttaattagccaggcactgcggcacatgcctgtagtcccagctacttggaggctgagacaggaggattgcttgcacctgggaggtgggggttgcagtgagccaagattgtgcgagtagtgcccccaatggctccgccaaccccgacatggcaggtttcagctccatcaccgccctgttccctcaccccacgtgccactcgcatgtctctctcaaaaagacacccccactttcccccagctctgctcagcatagtggtctccacctcctgcctctccctgcagcagcctctccaagatgctgtccattctggaaattgaaaatccaaaatcagtacttaagggcaagcataaggtgccagcaggaccaggctccctctggaagctccagaagagaattcgtcctgcctcttcaacggccagtgtctcttggcttgcggtcacgtcactccactctgtctctgtggccacatcgctgcctctttttatcagatcttcctctgcctccctctgataagggccttagagattacatttagagctcaacaggatgatcttcccatctcaagatcttctacttagtaacatctccaaagtcccacatgagttcacattcatagattttggggattaggatgtgtatatctgtgggggccattattcagccaatcacaacgaatatacagcacgatcctaattttcataatacaaaataaaatgtttgtgtgtgtatatatatatatatatatatatatacacacacacacacacacacacacacacacacacaataaaatgtatatatacagataaaaaacctggagggatctaggttacctgtgggatatgggactgtgggaactttctgtgtctataatttgtgtagtgtttgaagtcttgtaacatactaattttatcatgacacacccaaaatttacttgtagattctctctggattgatataaacatgaagaattttattttattttattttttgagactgggtcttgctctgttgcccagactgcagtgtgtaaaatcacaattcactgcagcctcgaacaccagggctcaagtgatcctcccacctcagcctcctgagtagctgggaccatgggcacacaccaccatgcccagctaattatttaattttctgtaaagacagggtcttcctatgttgcctaggctggtcgtgacctcctgggcttaggcaatcctcctgcctcatcctcccaaagtgctgggattacaggcatgagccactgcacccagccacatgagggactttaaactatctggtgacattcacacctgaggcaggtgctccccagggggctatctccggaaacagagtgacccaccagggctgggccccaggggcttccgcaccgccacaccagcagcaacgccctgctgacctgcagcagggacagcagggaaggggtacagacagaagaaaacaatgacaaacagccttccctctccccagtcaaggccacggcagggaagtgaaggggacatcaaaaggagaccaaagctttgtccaaggagactctgagagcaagggtgagaggcacactgtccacacaaactcctgccagacaacctcagaagagggcatcaaagctttgtccaaggagactctgacagcaaggatgagaggcacagtgtccagcacaaactcctgccagacagcctcaggaaagccaggcccagctcctttcaaaagctcaacacaggaccagtgaacagccacaggcatttaccatgtggtcggtgctcatcaggacacggagggtcactgcctccctcactctgcagggttgtatggagtggtgagttcttttaaaattctctgtctcctgaatgctatgaaggtgggcaggacatggtgtttactgagtcctgtccagcccatgaagtccaaaggcacagctgggcatggtggctcatgcctgtaataccagccctttaggaggccaaggtgcgatgatcacttgagcccaggagtatgaggccagccagggcaacatagggaaaccccgtctctaccaaaaaaaaaaaaaaaaaaaaaatattagccaggcgcacacctgtagtcccagctacttgggaggatgcttgagcctgggtggatcatgatggcaccaccacatgccagcctgggagacagagcaagaacctgtctcagaaaagaaaaaagaaatacaagggcacaatttggtaagtgctctcacagaggatagataaagggtcctgagatacagaggcgggagacttactctcaaagacagaatccaaaaaggctgctttcggggaaaagtggcctgagagtcaggccttgttggacaagttcccctaacgtgctaagcagagacctgtttcacaggccaaaagagcatggaagctcagccagagggacccaggcgggcccacctcacgcctgtgttcctcggcagcctctgctgccccctggtggccatgctgtgcacaccgccaccagacgagggcgccacccacaggcaccacctgctcccaccctcaggcagtatttcaatggtcccgtggctctgggccacgcccacatgactagcagccacagctgatcccatggcctgttggccaccccatcagcagcccctgcttctgatttctccccgtgctttttttttttttggaaacagagtcgcccaggctggagtacagtggcacaatctcagctaactgcaacctctgcctcccaggctcaattgatcctcacacctcatacccccaagtagctgggactacaggtgcacgccaccacacccagctattttttttttttttttttttgtattttttgtagagacggggttttgccatgttgctcaggctggtctcaaagtcctgggctaggatgacaggcatgagccaccgtgcccagccttgcctgcgcttttcctcccacactccaaccagatccgcagacgaggctgaggggccctccatctaatcagaaagggcagccctctgcatggacaggcccataagcatgtggctcagcaaggacgtggcatcttgtacagagtgcacaggccaacacatgtgcacacacaggggcgtaaggccaccaggttaggtctctgttctgcacatgggagggccccgcatccaagcttcctgcccttagttcccgtatgttgttcatgcaccactgtgagacccccatggccctgcccgctgctgccctgcccaccccctagctctggtgcctcaacctccaggactgcaagcaccccagtcctttctctcacagactcgccttacctctctgagacagaagaacaagtcagtcccgtggctcactcacaaagccagccctgaacccaggtctgactcagatgccaaaacctccagccatcccagggactggccccaccccatggtgggctgtgccgcggctctcagctggacacagcccctgtggatgtactgtggcaggcggcctgcctttcctgatgccccagcaccgccacatgccacccatctgggcctccagagctatacctgcagcaaggccaggtccgcatcttgggctagctgctgcaggttcttcacagcagatgtggtcttgatcacccgcactagggcaggggagcagtcaataggaagctcacccagcaaggacttctcatcactgagcagcagcagggcatggtaggggctgcaaaacaatcacctgtcacggaacacacgaagtgcaggaaccctgcaccgggtatgcaccaggtcctgcaccaggtatgcaccgggtatgcaccaggtcctgcaccaggtatgcaccgggtatgcaccaggtatgcacctgggactcaaacacacggaacatacgaagtgcagggaaccctgcaccaggtatgcaccaggtcctgcacgaggtcctgcaccgggtgtgcatcaggtatgcacctgggacacaaacaggcagctggagcctcctggcccttaactgcggagagaagggccaagagcgggatttgagaaaagggcagtggtctgtttggaggccttcacaaaatctgccaaggactggctcatgcctataatcccggcactctgggaggccaaggcaggcaggtcacgtgaggtcaggagttcgaggccagcctggccaacatggtgaaaccccatctctactaaaaataaaaaaattatccgggtgtggttgcacccacctggggtcccagctactcggcaggctgaggcaggagaatcacttgagcctgggaggcggagcttgcagtgagccgagattgcgccattgcactccagcctggcgacagagtgagactctgtctcaaaaacaacaaaaacaaaacctgcaaggattatgtcaccctcggaaaaaaacacgacaaaagtggggaaggctcgaagactggactctgtatcccacctcagagacgcccagcaaacatctgttgattgaagacatgaatgaatctttcctaaggaaattgtcccaaatatgggaaaagcaaaatcctcctcacagactagggaccaaagtacattaaaatatgcttagctaggattgaaagcaaagagcacggactggggagggtggaactaggcagcgctttgctttctgtcatttccaaattttcagcaatgtgcccagatatatttttataattaaaaaatgttcaaggtattgggggacttgggaacaggtggtgccagaagactgggctcagttctttccttgcagaaaatcaattaaattgccagggcatggtggctaacacctgtaacccagcactttggcaggccgaggcgggtggatcacgaggtcaggagttcaagacgagcctggccaacatggtgaaaccccatctctactaaaaatacaaaaattagccaggtgtagtggtgtgcacccataatcccagctactcagggggctgaggcaggagaatcgcttgaacccgggagacagaggcttcactgagtggagactgtgccactgcacttgagccccgagcaagactacatctcaaaaaaaaaaaaaaaaaagtcaattaaattaagaaagtatattttgggaggctgagatgagcgatgagtggatcacctgaggtcaggagttcgagaccagtctggccaacatggtgaaaccctgtctctactaaaagtaccaaaaaaattagccaggcatggcagtgggcgcctgtaatcccaactactcgggagcctgaggcaggagaatcacttgaacttgggaggtggacgtagtggtgagccgggatcgcactactgaaatccagcctgggcgataagatcaaaactctgtctctctctcacacacacacacacccccgcaaaaaaaaaaaaaaaaaagaaaaagaaaaaaaaaagaaaaagaaaataactgagatcccatgagtgctgactgaaatgcaaaagactggggtagggcaacaccattaagatgaagtccctccagccctccggcctccccaaggacactcagccccacatccaggctgccctgcccaagcctaaggtggtgccagaagggcccaggagaaacctgggattggtcatttctggacacaactggatacaaaattatgtgttttaacttctataaacggcagagccccacctgcaagcttccgcagtgggaagaagaaaaagagaaattttggaacaaagtaagtggtaaaatctcaggcagaagctaaagggaagggccctggcagggagtgagcacgtggggctgggcacttaccggatggctttcaggctccgttcgatggcctctggggggatcagactggaggccgcatagtggatcttgtggggcaggcagaagctcacctccagccagctgttgatgtgaagccgaactacgcccgacgtgcacaggctgcagagagtgggcgctgttacccgttcacataaactttctaaccatgcacacagatcagaaaacaccctgctcaatggtgctgattcccctgctgcttaggggaaactgcaggtggagacccgggcaggagagcatctcttaagatcacattatgtttaagaaaagaaaatatgggggccgggcacggtggctcatgcctgtaatcccagcactttgggaggccaaggtgggcggatcacgaggtcagcagttcgagaccagcctggctaataacacggtgaaaccccgtctctactaaaaatacaaaaattagccaggtgtggtggcgggcgcctgtagtcccagctactcgggaggctgaggcaggagaatcacttgaacccaggaggtggaggttgcagtgagctaacatcacgccactgcactccagcctgggcaacaaggcaagactctgtctcaaaaaaaaaaaaaaaaaaaaggaagaagaagaagaaagaaaaagagaaacatatttctggctagccctggaatctgtagtccaaccagactgccagggcttgagagaagccgtaccctgtcctggggactcagtgcactagaggcactctaactcaggcccctgcccgtccagacccctggcagacacccaacacccagagtacatcctccctgtgaatgggcctgccctgcacacctcatgaagacccatcacaggtgcacgtccaggcagaacagtggctgtctcagagggcgaggagggcagggaaggaatgccaagtcccccagagtgttccagtggtgagaagcacacagtgcccacctccctgcagtctgcagatgcccacagcacctcagttgcagtgcatgtggataccaagtggtcaccacaagccagccgtgctagccagccccaacacttcactacgacggaaaacctttcactccacattctatcagtaagggtaacttggttctttcgggtcccaaagcttgctcaggccaaacatagcaacaccatcccagtttccttatttctttcacagtccactttaaaccatcagcaaatcccatctgctccacctgcagggatgtccaaaatccaggccttttcagcatcaccaggcccaagccacccagagcactggcccctctgactaccgctccccacactcccacctgggcagtcccagccatgggcctgcaacacccacgttcctgtggcctcactccctgtgcccagtcactcaggtcccgctgtgctcagggccctggcatttgcccttgcccacaaactctctgcagacgccccaaggctcctttactccatcggtctccactcaagtgtcacattctcagtgaagcacccctgaccccagccccattgacactccaacccctgacccgctgcctaatgctgtctccccaaccagaactcactcctgaggaggggggcttgtgggtttcattctctgctctctacacattgtaaaacgtgtcaggcacataggcacggagctgcatttcctgaatgaagccaaggaacacaccgccctccctgcatgcactgtctttcctaggaagccctgccccaagaacaggctccacagtggggatgcagcccacgtcatcccctcggggaaccacacaaaacaaggaaggagttgttttcaccaggagcttctaaaactccctgatggagaagccagggcgccacccaactccaccgctcaccacaaagcgcccttgccttaagtaagagccaacagcacttgttctatgacacagaggagatgcaactgctcaagcaaagctgtctgcagctggccttcaccgcatccccggaggctccaggcaacaggggggatctccacctactcttgtcaaggcctggctactcaaagtggccggcaccttccttgtgtcctgcacagggaacgcagcctgtgaagcctcacaatgacaccagttctaaaataggagcaaaacacacacaagttcttctccaaactgcccatttctacagcacctccccgcatcatgtttcctctgttcactgccccactgcccaggagagcagccaactagtgcttttcccatcaccccctgaccctattctgctattctcagctcccagttggcgggacaggccaacacacccacatccggctaagtccgggagacttggccagacttctggctgccccaggccagaaggtacaaacggcccctcggacgtctcttaggacacgtcaatacggggtgctcagagaacaccatggccccaaggtcccagaggagggcagcagtctcagcttcttccagaactgcatgctaaccaagtatgtcggggcagacagaggctcccagaaccttacctctctttggtcagggtctttgcagggtgaaaaactcgtatcaaaccctgagaaatgtcccagccgctaaggaattaaagatcacaccaggagagatttgtccaggggatccaggttactcaacttgagtaagcaatagttaggatcttggcatccgtatgcgacagggaagaaagggcaagcgagaggtggccccatgcactgtgctgtcaccatctgggtcagaaaggagggccactggaaataaaaggtctattttttttttcttttttctgagacaaggtctcactgttgctcaggctggagtgcagtggcgccatctccgctcactgcagccttgatctcccaggctcaagacaacctcccaagtaactgggactacagacgtgcaacatcacgcctggggtgatttttttttttttttttttttttttttttgtagagacagggtctatgttgcctaggctggtctcaaactcctgggctcaagcgatcctcccaccttggcttttcaaagtgctaggattacaggcgtgagccaccgcacccacccaaggcctttctgtttctgtcctatttaggatgcagctcaaagtggctgttgggacaccacagaatcagaatacggaggctcctattgtttcaaatgtagctgtctttgctccatctaggagcacagtgaggccttatgacatgtgctgtggctcccagcaccagtttaggtacttggagtgcagcagggaagaaaataacttggctgctctgcacgctgggggcttcactcagcggcatctagacagacacataattggccgggcgtggcggctcacgcctgtaatcccaaaacctgggaggccgaggcaggccgatcacttgaggtcaggagttcgagaccagcctggccaacatggtgaaaccctgtctctactaaaaatacaaatattaggccgggtgccgtggctcacacctgtaatcccagcactttgggaggctgagatgggcagatcacctgaggtcagaagtttgagaccagactgaccaacagggagaaaccccgtctctattaaaagtacaaaattagctgggcgtggtggtgcatgcctgtaatcccagctacttggaaggctgaggcaggaaaatcacttgaacctgggaggtagaggcggaggcggaggttgcactgagctgagatcgtgccattgcactccagcctgggcaacaaaagtgaaactccatctcaaaaaaaaaaaaaaaaattagccaggtgtggtggcaggtgcctgtaatcccagctacttggtaggctgaggcaggagaatcacttgaacccaggaggcggaggttgcagtgagccgagatcgcgccattgcactccagcctgggtgacagagcaagaccctgtctcaaaaaaaattgaaattaacgtttaaaaaaaaagacacctaattgtaatcaaattgtatggagcattagaaactggagagagttatagggaaaggaacaggggcttggaacacacctcatggaaagccaggaacaagttccagctatgggtatggagaaatgagggcaggagggtcacatgaaggttcttctagtgacttcccagcttggtcatctctgctgccctcaccgtgtcagctgtccttggagccgcagtcatgtggtctggtttgtacactggcatggggccctctcctctggcagagacacgccatgttggttcctctaacttccacgtggactttactccattttcccaagcatcagctcacccacctgctgctttctccctcagagcactctgcactgaggctggtgcttctttatgaactaacccagctccctagagcggtgacaagtgctgccaccaggagtgccccaaaggccatggcagacctgggcaaattccctgaacatgtcagagggatgactgctctggaaaggtgccggcccaacctccagcctgtaaatcccccacagtaagagggtaagccaggagctgcactgaggtctgttaacaaggggaaagagaaaggtttgtcactgtttttaagtctgcagctttaagacaagagcccttagcacaagcagggtttgggccctgaaaggtttcctgccgagcttgcacttctatttgcaaggtgtttaatggtttggtctgaaaacactctggaggaaaacactgtcctcctcaagacttatccagcccctcacacagctctgggccagccaagagggcccagcccagtctgtgacaggagataggtgccccagccaaagccctgcatcctgacaatgactatgcaaaagggaatggctggcttcaaacacactctcgccgttcatctccaagacagaaatgtgcacaagcttagtctagtcccctcagcttttagcatctgagaaagcatccattcctaaccttagaactagacaggacctgtgaagctatcctgcaaacctctgcatcctctggtcccacggatgggcctggcttcctaccataagtagtgggatgctgcataacccaaaagatctatgtgggttccaaacagcctaccttgaaatttcaaacgaaagtttatatataggtgcatttttatggaaatgggtactacaactcaggatattcacagagggtccatgggaccaaccctgctctcgacagtttgcagtgcaaggctccgcaccaagtaccacctacccagccagaccctggacatcactccccaccacaggtcctgttaactcggagaaccattcagcaaatcacttcttcacactccatggaatctacactgctgttattcccacccacacattccgtcgacccctagcggatgagctgtgctcctccacaggctgagtgtaggggctgtgttgcagaaagtgaagagacatccctgccctcctgggagacacaattcaatggtcatatgaatgagtgacatgctgtcactgagggccactgggatccacagggagacacaagtgctaggtatggcacaagtgttggggtggcctcctgagcgattcacattcccagcctatattcacagatgttaggtcctgcaggacagggccaccaggctattcagccacaccataaccctagctttaattaaaatagcaactggggaccggacgtggtggctcacgcctgtagtcctagcactttgggaggtcgaggttggcagatcacgaggtcaggagttcaagaccaggctggccaacatggtgaaactccatctctactaaaaatacaaaaattagccaggcctggtggcaggcgccgtaatcccagctgctcaggaggctgaggcaggagaatcacttaagcccgggagacggaggttgcagtgaactgagattgtgccattgcactccagcctgggtgacgaagcaagactccgtctcaaacaaacaaataaataaataaataaataaaatagcaactgggggcagggcatggtggctcacgcctataatcccagcactttgggaggctaaggtgggtagattgcttgagtccaggaattcaagatcagccagggtaacatggcaaaatcccatttccacaaaaaaatacaaaaactattcaggcgtgggggcgggtgcctatagtcccagctactcgggaggccgagatggaaggatcacctgagcctgggagacagatgttgcagtgagccaagattgcgctccagcctggcaatagagtgagaccctgccttaaattaaaaaaaaaaaaaaaaaaaaaaaaaaaaagaaccaggaacaattcctttgaaaaatcccaccccaatctccaacctcattaatctcacagcttctggtctttcagttctgttctgagattcccccagatctggcagtcagtcaccatcaggagaaaggcgctctgtcctaggtcacctgatcagtaatggaaactcagtctcctcctctcagtgcagaagagtgagcagcagcagaccagacccttgaggccaaccatggacctgatgggatgaggacagacgagaggccacagcccagaggggctcctgggtggctgcagagccatgccagtgccagacaaggatgggtacagggagggtactactgcctggactcctgccagagaaacatagctgccagcatccctggggcaagctccaggacccaagactgttagggtgggagtttggatggaggaaatgtgatcctgggcactaacaaacagaatgcgtaggtcaggaaagaatgctacatgctgaacaacagcttaggagcctttttcagcaaaactcagattcctgtcctcctttaatatccactaggtggcgctgggttgcctcaagttctgagctcctccgcagcctgcagatcacacaacaggcagtccaaggttttgtctcctttcaactttccagcacgattcaaacctaagaaatcatagtccattcttcctttagaaatataaagtcaacgagccgggcacggtgctcacgcctgtcatcccagcattttgggaggccgagccgggcggatctacaaggtcaggagttcgagaccagcctggccaatatggtgaaaccccatctctactaaaaatacaaaaattagccaggcatggtgatgtgcacctgtagtcccagctactcgggaggctgaggcagaagaatgcactccagcctgggcaacagaaggatattccatctcaaaaaaaaaaaaaaaaaagaagaagaaaaagaaatataaagtcaatggtttggtttttatttaaacaaatttttaagagacagggtctcaccatgttgctggggctggagtacagtggctactcagacaccagcatagagcactacaagctcgaactcctgggctcaagtgatcccccaaccttggcctcgcctgtgagatgggactacaggagcacaccaccgcaccagcttggtttttattttaattccaagttagcctgatttttgtttgtaatctaatccgagttgaggcatacactcagaataagggaacaatgtccaaggaagagactggataccaggcaattcaaagccagagggtagtaattctctcaacacagagaaaacattagtgtgataacaatgaatcaaagacagggtcagactacatgaccacaaaggtcccattctgcaacacagaaggggccagaaaacaaagcaatcacctggcaagggctgatgttctctcacacctggggaggctcagtccccagggtcaccaagagacaaacaaatgctagttgcaacttatatcacaaaagacaaatcactctcccatgtttaaggacttatatctcccgatagaagaatgaacaagggatctgagcagcgagctcacagaaaagacaggtggttcaaacatgtgaagagatgcatcagtgcatcacaataaagctacacagagatcccattccccacttgttatactggttaagatccacaatttcacgagactcgatgttggcaaagctcgggggaagaggcatctcgtgtgttgctggtgggacagaggtacaaacccctgagaaggaaacacaacattacaaatgccattttccctattagtaatgcctttaggaatttatcttatagatacagaggcgcacatacaaaataacacaggtaaatggttagcactggaaggctggaacaaactcaatggtgggggcagttgcggctcactaggcagccaaaaaaagaattaaaaagtattttttaaattttatttattttttattttacttttgttttttaatttttattattatttttgagatgacatctagttctgtcacccaggctggagtgcagtggcgccatctcagctcactgcaacctctgcctcctagatttaagtgattcttctgcctcagcctcctgagtagctgggactacaggcatgcaccaccacgcccggctaattttttgtatttttagtagacagcgggtttcaccatgttagccaggctggtctcgaactcctgacctcgtgctccacccgcctcagcctggcaaagtgttgggatcacaggtgtgagccaccgcgcccggccttttttttttcatttttgatacgcggtctggctctgttgctggggccagagtacaatggtacaaccatggctcaccataatcttgatttcctaggcttaagtgaccctcccacctcagcctcctgagtagctgagactacacttgtgccaccacactcagatattttttaaaaattttttgtagaaatgcgatctcacattgttgttcaggctgatcttgcacttctgacctcaagaaatccgcccctcagcctcccaaagtgctgggattacaggcgtgagtcaccacgcccggcctgcttgtccacatttaataaaggtgatgctcagccaatacaatcagaacaactgtgaggttttcatggtatcctcaaggcttgctgccctcacacagtcagtgtcgcaaaccccaactctctcagactgagaggagacagctggccccagcctcacccactgagcctcaatttcctcttgagtgactggagtcagtgacacccacctagtgaaggtggcccagcacttggtgttgcgtcatgctcagtaaaatggcattttgcatctgtttgatttaaaaacactttcggactctcatgtataacttcgggctcgttttctgttttaagaggagtctggaggtggtggttccagcagagtgcatgctactcagcaaaggggtttaaaaaagcaaaggtactcaggggtttgtacctctgtcccaccagcaacacacgagatgcctcttcccccgagctttgccaacatcgagtctcgtgaaattgtggatcttaaccagtataacaggtggggaatgggatctctgtgtagctttattgtgatgcactgatgcatctcttcacatgtttgaaccacctgtcttttctgtgagctcactgctcagatcccttgttcattcttctattgggaaatataagtccttaaacataggagagtgatttgtcttttgtgatgtaagttccagcagagtgcaccctactcagcaaaccatttaaaaaacagccactggccgggcgcggtgctcacgccagtaatcccaacactttgggaggccgaggcgggtggatcacctgaagtcgggagaccaccctgaccaacatgcagaaaccccgtctctactaaaaatacacaactagccgggtgtggtggcgcatgcctgtaatcccagctactcgggaggctgaggcaggagaatctcttaaacccaggaggcagaggttgctgtgagccgagatcgtgccgctgcactctagcctgggcaacaaaagcaaaactccatctcaaaaaaaagaaataaatagaaatagaaataaaaaataaacaaaaaaaaacggccaccaaggtcacttctttcaagagcagccacatgaccatcccttcccagtcctctccggccctaacctcagggaaccctgatgctcacaccccaggagaacagtggtcagtaccggggagccctacctgttgacgctgctcctcaggcccaggcaggctggcccataagaaggaggttaataagcacacccacctgtcttacctgtcataagcttccttgaggtccctggccagcttgcacttgggcaggatgtgatggaatggggactgaggaccttcatttcctacaagaatcacaacacaagatttacagctcccgggttcaagcgattctcctgcctcagccttccaagtagctgggattacaggcgcccgccaccatgtctggctaatttttttgtatttttggtagagacaggtattcaccatgttggccaggctggtctcgaactcctgtcctcaagtgatccatccaccttggcctcccaaactgctgggattataagcatgagccaccacgcctggcctagacctgctaattttaaaattttttgtctgggattacaggtgtgagctaccacatccagccaaaaagtcttttattcatcctttttcataaatttctaaaaatatatacatagacttaaaataaaatttctttttacttcctgtgataaagtcacagactctaaaaagataacgtttaaaaaaacaaaacttttggattgttattatcacaattataattagtatataattggccaaaacagaaacatattataaattttgacaggtaaccgggcgcggtggctcacacctgtaatcccagcactttgggaggccgaggcaggcggatcacaaggtcaggagatcaagaccatcctggctaacacggtgaaaaccccgtccctactaaaaatacaaaaaattagccgggcgtggtggcgggcgcctgtagtcccagctactcgggaggctgaggcagaagaatggcgtgaacccaggagatggagcttgcagtgagcagagatcacaccactgcactccagcctgggtgacagaggaaaaaacaaaagaaaaactttatatatttgacaattacctgtcaaaatttattttatttttatttatttattttttttttgagacagggtctcactctgtcacccttgctggagtgcagtggtgcaatctcagctcaccccaacctccacctcccaaggctcaggtgattctcccacctcagcatcccgagtagctggaactacgggcacatatgaccatgcccggctaatttttgggtttttttcggtagaggcaggatttcaccatgttgcccacactgatcctgaattcccgagctcaagcaatctacctgcctcagcctccctaagtgctgggattacaggcatgagccaccgcagccagccacaggtaaatttgtactgaaaatgcacctgagtcagagaggctgttcctttattattgttcattcatgtcaataactaattttacttattgctacaacaactaggtctgactttagttttgttcctaattctctcttttgttatagaggtgctggccaaagaaaatggagatggagagtttgttacaggtgtctctttatgttttgaaatctttacagtaggccaaaaaacactcaatgttctgtctgcaaaaattatttttaataattggttagttgataacccaattaggtcctccttcaatctggctgaaagcaaagaactggaaactgtccacctcaccagctggatatttccaacgccctctcctgccccagggagtaatagtttcttcaacatctccaacaggaccagggctaggcagagctgcctcacctatgtgaacggtgatcatgcagcagtgtgtgggaagaaagaacatttctggtcgggaaatctatttcaacacatccagccaggaaaattcatctacaaatgtgccccttgggagtcttcctgtgccccccaggcacaatcagccccgtgtgaagatcatgtaacttctctgagccttagtttccacatctgcaaaatggggatgatcatggacactgcctagcgaagctgttgtgaggacttcattttcaatgcacagctcaccaaaagccgatgcttgcaagctcctgactgctctgctggtgttggggtgggtgaggccccgccaacatctgtatcattaacactgaatgacagcccctccacagaggtctgcgctgcagagaggccaccagccagcccagacccatgcccatcacgccctgctgcactcaccatcagccatggcggacacctcatcctggagcgccaggatcagcttggcctcccgggtgaggtactggcagcggcgctcctcgtgctgcagcacggtggcgatacgacgggacaggttatgcagacagtttatcactgacgggtctgcgttggcctgcaggagagagaccatacacagactcaaacgtgtgcacagggacacagctggacacagtttaaatggagctaacacaggtacacagcaaaaactcaaaccatgaaagaaagcgtctctactcctttcccccaggctcctttgcagaggccactgctgctcatttcctgagtcccctccagggcccatccatagacatgtgggctgtcagcccccatgctctgttcttgggagtggctgcctgaatagtaacagagatggctctggaaatgcctgggtgccctaaggaggcactgttgttcttaaggaagaacaacaatggtgcctccctcaccaaggactgaatggaagaaattagcgagccatgtaacaaactaagaacagaacctgccctgagcaaagaccctgctagtgtctgtggtcaccactgtactgctgactactggtaggcagaaccagtctacaatttgtaagaattcagtcacgacaggccacgttactacagggatgcacggtacaaaaagagaggcaccaggccaattgttcactgaatacttttggtcctgaaggatgagaagctcttcccagcagaagtcacactggttaacaagaaaaccagcaggctccaggcccatatctctgcccaagagctccttctgcaaccatgatgactgggtcaaaggacagtgcaggaggctctcaggaacaagaggggccctcgaccctctggaacctatcagggaccacagtcagccaggcaagcacatctgcccaagccaagggtggaggcatgcagctgtgggggtctgtgaaaacacttgagggagcagataactgggccaaccatgactcagtgcttctggaggccaacaggactgctgagtcatcctgtgggggtggaggtgggacaagggaaaggggtgaatggtactgctgattacaacctctggtgctgcctccccctcctgtttatctgagagggaaggccatgcccaaagtgttcacagccaggcttcaggggcaaagcctgacccagacagtaaatacgttcttcatctggagctgaagaaattctctatattctcatcagatcccatgttcacaaacagaactcacacctggatggacttacaacaaggcagcatcccttgccagagaaaggactgttgctcccatgctgtgcccaccactgggcagcagacctgctcctccatgtcaagggcattgcctcaacagtgtccttgggaccagagggctgacatatggggtgtatacaattgcctcaaaacaaaatacccacctagaagaagaatctgtgtacaaatacttccacgagcaaagcaaggaggaggacaatgatcctggatatgtgattattcagctgaggcacaacagtgtccatgagttggatgtccagggcccatatgcttgacctttccagacatacaaagtggtgcagtccccagtgacgctcagtgacctgcactcatggggtgtcccagcatgtccggtttgcaaaggcctgacatggagtgagggacatgctgagaaagctaacacctagggtgtgccagcactaatgggaacttttagaaacaccatattttcaccatacacgacataaagtggcaggaagtttaaggcatcacgcatgagactttctcatccccaaaacttgtacccaaatagaaccaagccttcagagttaacttgtagtttgaaggaaacacagggacagagagcaagtctgactgcacaatgagattaatccaaatgtggaacatttgatggaacaaagggaggggagacctctggattggcagagacataaagacaccacatgcactagctgggctgggtttgcatcctggttcagacagtccagctgtgaaaaggctttagcaatcaggagaagcttcaatggaccaggtactaggtgatgccaacttattacagcaaattttttcagatgtacaaagggtatcatggccgaaaattaagtgcccatattttatacagatatcttctgaagtatgtagggatgaacagacataaggtctgggacttgccttgaaatagagagagggaaggaaatatatggagccagggtttaaaggcacctgagacaggcatataaggtttgtcagtctgctctctctatttcagggtttaaaatttttcagagtaaaaaaaaaaaagtgtatttctttttttttttaagatagggtctcactctcttgcccaagctggagtgcagcagatgatcactgctcactgccaccttgaccttccaggctcaggtgatcctcccacctcagcctcccaggtagctgggactacaggcgcacatcatcatgcctggctaatttttgtattttttgtagagatggggtttcgctatgttgcccaggctggtgtcaaactcctgggctcaagtgatccacccaccttggcctcccgaagtgctaggaatacaggagtgagccactgtgcctggacaaaagtgtatattttaaaaagaaagaatatatatttaaaatgacaaaagtgtatattttaaaaagaaagaatatatatttaaaatgacaaaagtatatattttaaaaagaaagacttgtccacccaaaaaatacaaactctttacattatcaaaatttctcctactcgtcaatatcacggccagctgaagtcctagactatcttgtttcctgttgcttttttttttttgagctggagtttcgctcttgttgcccagattggagtgcaatggtgcgatctctgctcactgcaacctccgcctcccggattcaaccgattctactgcctcagcctcctgagtagctggaattacaggtgtccaccaccacacctggctaattttgtattttttagtagagacggggtatctccatgctggtcagcctgctctcaaactcctgatctcaggtgatccgcccgcttcagcctcccaaagtgctggtattacaggcgtaagcatttgtgctcggctccggttgcttttacctgtccgtaatcaatctatacttctccaggttctggtctgatctccatttctcacccttgatggcaagaggatgggccagtgtataataatcaccacattgtttaatcactccccaactactacacactatgattatctccagtttaattattgttataaaaatctttattcttgctgagaacaagcctgggggaaatctttacgcagttgtaaaagttgcttgtttttcttgataatactcctaacagtgggactgctagatctaagggcatcatatgctatgctgtcaaacactactccccgaggtgagggcctgcctacagcatcctggaaacactattccccgaggtgagggcctgcttacagcatcctgcaaacactgttccccgaggtgagggcctgcctacagcatcctgggtggggctgtggctgcgtttcatcaactgtcccacaggggttatcggtgttgacaggtggacaacattcgtcatggattttgtttactcctttgcttgtttttttacttaattcatttttctttgtggcgctttatattatgtaattatgtaagaaatacaaagatgctatgaaaatgcaaatactacaaaagtgtatcaagcagaaagtgaagaacttctcccagaaccctgtaccccaggagccattaacaaatcattttgttttaatttgtagttccttatttatcaacaaggcaggcctgtcttaaaaattaagctccagctgggcatagtggctcacacctggaatcccagcactttgggtggccaaggagggaagaccatttgagaccaggagttcaagatcagccagggcaataaggtgaaaactcatctctacaaaaaatacaaaaattagcaggggcagggcacagtggctcacgcctgtaatcccagcagtctgggaggccaaggtgggtggatcacctaaggtcacgagttcaagaccagcatggccaacatggcgagaccccccccccccaccgatctctactaaaaatacaaaaattagctgggcgtggtggcgcacacctgtaatcccagctactcgggaggctgaggcaggagactcacttgagcttgggaggcaggggttgcattgagccaagattgcgctactacactccagcctgggtgacacagcgagattctgtctcaaaaaaaaaaaagagaataactgctaatgggtatggggtttccttctggggtggtgaaagtgttctggatctagatagtggtgatggttatacaacatgaatgtaccagatgccactgaagcatagacttcaaaatgacaaatagtgttatgtgtattttaccaaaacaaaaaggggtaaacaatgaagtgcagtctgcctgcaccccaggaggggccagcccgctgcagtccaagctccgagtcaatgacacgctcgttggaaaaaaagagctgcttctccactggccccactccctgatcttaaccatttatataaacactcaccctcagtgcaaacaccacattaaaaagaatcatagtaggtgcttccctcttcggggaaggatctgttttggagatctgtaaaagatgcataattctaattaattgagacgactttctaaggaaagctgtttagagctattctacttcaggcatggcaaaagtccccagaatacagcaccaaggtcttggaaaagcaatgaatgcctttgctctggaggcgtgcctactgcatgggcaaagtcacaactatgacaagagtgggaaggtcagtgctctgaccccctcgcccccccgctaacagaagtgagctgacaatgcccacaggggacgagatggagaggggcataaatgggtggaggacccagacccacacccccactgccttcccgtgcccgcctgcatccaccaggctgtatctgctaagtatgacgcatactcagaacaattgagggacaggacgatgttcagggacagccaagccctgagcagggcccaggtgaggcaggccagcaagtcctaatttctgtgctcccggttctggcatccagccagcttcacaaggaccagggcgctcaagggaagcattccaaggggcacgggggaactcttcaaagccaactacaagttctgccaccagggggagttggggccccaggctgccctggcacccatcccctacccctgactgccactcctgtctacagggtgtgaccgcgggcaggctgccaactctccccttcattgcctacaggtaggggactgtgccccagctgtggaggctgtgatgagaagggagggtgcggtacaggggaccaggctcatcaaccgcctcagaaactccttccatggaggttcacgaataacaccacagaacctcccagaattgctggatctgtataaatgtagctaaatcctacgttactgtgttcgacccttcagaatcttagtaatgccatcactgatcctgcctgtatgcagagagctgactggcaggctctggtgtacaagttcccttcatcctgctaacaagatgagttcctcagtgctatgacacctattcatcaagagaacatatagagagggtttagcagaaaaataagtgctaaataatactaatattagctactagagtgtcttgtaataaataagaggaaatgcttgcaccacactgtagaaaattcaagggtttcacgatgctagttaactcactatcttggcctcccctggaaacagacatcctacatatgaaggggagggccacagtcagtagagacctagaatgcagactgtaaaagctagggacagggactgaagcacctgtcttcaggggcaagaacacctgtctctttttctactggactctctgggtttatgaagatgcacagttcataccaagtgtctaatcaggtctcctgcccagtaccttcaccagagctggtgtcagcctcagttctgagccccccagagccagaatggaccaggcctgccggcccagggagagccacatctgcccagagggtctgtgcatgcccagggagaaccccacctgcccaaggacagacgcatctgcccaggggaagccacacctgcccagggggagccacaccttcccagagggtctgtacctgcccaggggaagccacatctgcccaggggaagccaaatctacccagggggagccccacctgcccaaggagagccacacctgcccaggggaagccacacctgcccaaggagagccacacctgcccaaggagagccacacctgcccaaggagagccacatctgcccagggagagccccacctgcccagggagagccatacctgccccagagcatgctgtagcagtgttgggtgcccaacaaatcgcacattatcaatcttcagttcaaatttttggccacacatttcagacttggttgccaaaattgttgccagaataacatctgaaaaccttaaaatttaagagaggtagaataaaaataagttaacaaaataccacagcaccatgccctgctggccccagagcggaagggtctcagtaaactgcaccttcatggagttgctctgccccgactgctggtggaagctactaacagttgcccttctgtagcaatcccagaggttatggatgtaagatcaccagaattacaaggtaaaaggcatgagaagcacagactgaaggcacatgctgtcattttttggcatgctctattaaattcaggagagaaacagttgcagtttgctttcaaagggaggatcagctggagccggcactgccctgcggagctgctctttaaagttcacaggcagaggggcctctcccagttacactcaggtttgctgtgctgcaccttcaactcccaggacccaggcccttcacccacagagcggcccttcacccaaagagccgcgtggagggcaaggggacagtgcacagggatgcgtgcagagcgctgacttccttcctcatagcatggctgcccatccgttcccttatcccaaacacttaaactttccggtttttatcagggaagaagctttgtgcaagatgtgcaagcccactgtgatcacagctatttccaaatggcagaaataccaggttgcacacaactgggtgccacggagaagtgggtgcagctgtggtgtgggagggagggcatcccttttccccttttcaaggtcatctgtgcccttctgtctccttactggcaatgctgatgcctcctgcctggggagatctggataagggagtgtcacctgcaggggtgctgtgggtggtgctgactcttatctcagagtccagggctctgagggcctccgctctagaaacacaaatgtactacctctgatctggacccagaagagagagaagtcccatacatatctctccacccaggaaaaatatatctaatatctaggtcaggagggtgcactctcttggggaagctctagcctccgcagggccatactctgcccctgggcagggagacccctaaggtcctagaagagaccactgaggacagacattctagggtgcaaacctggtcatgcttcttccccagaggccctcttggtgaagggatgggagagactgacataactcctccatgttgtgatgaaaaaggaaggcctgctttgaactgcactgtagctcagctctgtaatagcaaatggcaagtagctacatgattctttccaagtctatcatgggctgtggggctcagactgttttccagccttcctcctgaactggcacgaccctctaaccatccgaagtcaccctaggctcacaaacaaaccacatacgagggtttggtcaaacctatttgtgccatttggaaatagcctctcaacccagtcaggttgcagttggaccttctgaaatcaatcttgttagagttatcctgggaaacgcaggacccacagccaagtcctcagcagcccactgcaggtctctcctgcagagatggaggattcaagtgccttacaccacaggcataatatgctttcttcaaaaaccctaaatggctcactctgttctataactcccatctgtgggacatggtaatgttgaaggagggtttgaggtattaaaacgccaccaaacacttctgctctagcaactgacccagggccaacgcctcacatcctatctaaacagtgcccctccactctgccacccagtgactcaggggacacagaggtaacagaaaaataaccaccaccactccagaaaggtcccttgctctgacagcccaaaatctccactaaaaactgctgctctgtcataaagagtcacagccatgtctcagcctcagccctcaggcaccagtccagggaccaaatttagtttggctgtgagatggtccctgggattctcagaggcaagcagtggtagcccagttcgcgtttataaatacctaaacttcaaggcgccctcacaacagccaaataaaaggctctttccctgctagaggccagggtctgcagagacggccaactggaaatctgtgagctgaagtaaaaaggcacactgggccaggcgtggtggctcacacctgtcatcccagcactttgggaggctgaagtgggtggatcacccgaggtcaggagttcgagaccagcatggccaacataatgaaacccccgtctctactaaaaatacaaaaattagccgggcgcagtgaagcctgtagtcccagctagtcgggaggctgaggcaggagaatcgcttgaacctgggcggcagaggttgcagtgagcggagatcgtgccactgcactccagcctgggtgacagagcgaaactccgtctcaaaaaaaaaaacagtcacattgacttagtggctgttcatggagccctctgaggcagccagcagggtggtagttagccattgtttatctgagcaaatctggcccacagagaaatctactccccacaccttaatattacaaacatataatgacaaaacgcttttttttctttttgagacgaagtcttgctcttgtcccccaggctggagtgcaatgacgtaatctcggctcactgcaacctccgcctcccgagttcaagcaattctcctgcctcagcctcccgagtagctgcgattagaggcacccgccaccacgcccagctaatttttgtatttttagtagagacggggtttcaccatgttggtcaggctggtctcgaactcctgacctcaggtgatccgcccgcctcggcctcccaaagtgctgggatgacaggcgtgagccaccacgcccggccccatgacaaaacaattgagcggctttttcttttcccccttgagatggagtcttgctctgtcgcccaggctggagtgtaatggcgcaatctcggctcactgaaacctccgcctcttgggttcaagcgattctactgcctcagcctcccaaatatctgggattacaggcgcgtgccaccaagcccggctaatttttcatattttttagtagagacaaggtttcaccacgttggccaggctggtctcgacctcctgacctcatgatctgcccacctcggcctcccaaagtgctgggatgacaggcatgagccactgcacccatctggctttatactttatatagtctgtctggtaatgtaatacacataaagacagagttatattcatgagattgggggtggggcaaaacttataaacagcaaactgaaccataaacaagtgttgttttgttttattggcttccaacatttatgaaaatccttttccctcattttgatggtgaaaggcctaataaatgtactgcagcacaataaaacatctgttacaaaaactgaagattcctggaataacttggaaattcaagaaaaacacatttaggaagatgaaccagcccagccagaaaacaggccaggaccttctatcactgccgagctattctggagtagggtttgctctctagcttggacaaaaaaagggatggaaagacatcctggaagggagctcagttctgctccccccacccacctaaagggatggaaagacatcctggaggggagctcaactctgctcgccccacccacctccttgctggaagctcacagacactgtgtgtacctccaaggcccagaggagatgcactgtcaaggggaatggaagagtcgcccgtcatccgtgccctcctggacaagcaccatatcaattccatgagaacatttctgcctctattaagcacactcaatagcatctaggcctgagcatcacacttaatgcccaacccttgggagaggcccccacaaaacccctcaaaaaataaaaacaaggagcaacagtcacaggtctctctagggcggcagtggactagggagatgacagagtccactcctgcttgcccgccaccctcacaggactacttgtgcctacctggaggaagaggaggtttgtgtgacatgcctggtcccagaagtctcccgggtgccagccagccatgccttggcctctcaggtaatgtgaaatagctaaatgactgggtagagaaaaagccggggtggtgggaagtctgggcattcatgggggaactggggcagtgaggtccacgcctgtgtgcctcatcagtcactcttcaacatggagggaaatcaggaattaagcacaattacaagaagagaaggcagccggaatcaagacagaaagacggtggagaggtctcggtcttaccctgcaaccaattgctcatcggttggaggacatggctcgctgaaatgggaacaggaccatcaagaccaaacaaaaacatatcacttttttaaaaaccatgaaaagttacaaggctattttataaaaactgcacaaaagtctagcagaagtgccaccattaagcattaactgttgaccatcacgactaagcaacttaccagacaagaaacaggatcacacactccccacgctgagaaacagggtcacacactccccacgctgagaaacagggtcacacactccccacgctgagaaacaggatcacacactccccacgctgagaaacaggatcacacactccccacgctgagaaagagggtcacacactccccacgctgagaaacagggtcacacactccccacgctgagaaacagggtcacacactccccacgttgagaaacaggatcacacactccccaccgctgagaaacaggatcacacactccccacgctgagaaacagggtcacaccctccccacgctgagaaacagatcacacactccccacgctgagaaacaggatcacacactccccacgctgagaaacagatcacacactcccaacatgtgagaaacagggtcacacactccccacgctgagaaacagggtcacacgctccccacgctcaacgcttaccatggggttttctcactaaaagtcaaattctcacacagaagtacaggctgggcaggaacaaaagtcatttttcagaagtaagcacaaggctggcagagctgggtcagacccagcaccatatgtattagccggatgcctgtgcagaagtatctcatcttttcttttctttttttttttccttttttcttttttttcttcaaaagagacagggtctcacaatgctactcaagctggtctcatactcctggggtcaagcaatcctcctgcctcggcctcccaaagtactgggattacaggcgtgagccactgcacccagcctaaaactaatctttgtggtaaaagttttctcatctgcatgacaagaaatcgcctaccgaggatcacataagactcccagaggcaaaagccttctgaaaactatagcgtgtcatatgaatttcaccagctccaattcttgagatactgtgactgccagcacacctgacttccctaagcctctgcctggagcaataaagtggtcatggtggatccatatatatttgtcagaaaacatctgggcttttgcactacctgagttgagatttttagaaacagtttaggagtttactttctggctaggcacgatggctcacgcctgtaatcctagcactttgggaggccgaggtgggtggatcgcttgaggtcaggagttcgagaccagcctggccaacatggcgaaaccctgtctctacttaaaaagaaaaaattagctcaccttggtggtggatgcctgtaatcccagctactcgggaggctgaggcaggagaatcgcttgaaccctagaggtgaggttgcagcaagccgagatcacaccactgcactccagccttgggcgacagagtgaaactttgtctcaaaaaaaaaaaaaaaaaaaaacctttattttcctctgcagatatttgagttctgggacacactgctttccatgtattctggaaagagaaaggagacctgaatccaggagtggaaacattgtgggagctctgccaaagatccacagaagggatctctttcctcagcagctgccaagctcctcaggttgtacagtatgaaagcattaagatgtttcatggattttcccaagatcacccaagaagtcagaatcctcgaagctgaagcctgactgtaagctctgcctcctacaactagacaagtcacaatgcaacccctttgctccagaggaaaaggagtaagcacagagggcttctgagtccggcaatgctccatttcctgacaggagcattttacagacttgcgtctgcccctctgagggaggcagggccatcagctaacactcagagacaaggatggtcctacaacatcctgatctgggaggaagaggtgaaggcaactcaccaccctcaggcatcttaacagaaaacagtggaactaaggctcattctaaagaatgtgcccaagatcacacaccgaaggctgcaaagcgagagtcaaacttggaaccctgaacctgcacttgtccctttacactgccctgcagcatggatgcgatggctgggcagagggaagtgcccaagcctggggacaaaaatgcctacctgctttcttgtgtgtcaacctcagctacagaaaggagagggcatctttctaacacatcagtgtagggctctaaaaacacaagctaatagaggcaaacctaacaagagaggccctggcagagcctcatgtgtgcctggtgggaggacctgtatgttgtgagctagagagtgcctgcctggccaaggaccccatctggcctaggcccaagtgcagccacaagttgggtacactgctacaaaagtggccaagcctgaggacagtagcagtgccacctgattccccaagatgtcacctgagaattaaaggcagagctggtagctgggtgagggggctcatgcgtgtaatcccagaacattgggaggccaaggtgggaggatcacttaagcccaggagttcaatcacctgaggtcagggttctccatgttgaccaagctgagttcgagaccagcctggccaacatggagaaaccctctgttaaaaaaaaaaaaaaaattaggccgggtgcagtggttcacgcctgtaatcccagcactttgggaggctgaggcaggagaattgcttgaacctgggaggcagaggttgcagtgagccgagattgcgccattgcaccccagcctgggcaacaagaatgaaactacgtctcaaaataataataataataataataattaataataataataataatatgatttcagagcattttgaaaatgaaagaaatcagttcttctctaaacctctagctccccattctctgaggtagtggcctaagcactgctcgcagtttcaaagaagggagcaggaagacggtgtccacacagagagggacatgcccacaccagcctttctgagggacaccaggctatctctcagacctggcttgatggcttctgcccctaccagtggtggggacacacggtacatttaaacatgagcaccatggcccctaatacccagggaacactacatcttttctgaccttggtttcaagtcttagagacactggacaatatccattttcttttctcataattgaattatagaaaaggattataaaaaataagtaagagttaatctctataacctgaatcatatcttaaattgtttctgagaggggggtctcactctgtcacccaagttggagtgcagcaatgtgatcttggcttgtggcaatctctgcctcccaggctcaagcaatcctctcacctcagcctcctgagtagcagagaccacaggcgtgtgccaccatgccaggctaattttttgtatttttggtagagacaggacttcgtcatattacccatgctggtctcgaactccggagctcaagcgatctgcctacctcagtctcccaaagtgctgggattacaggcatgggccaatgcgcccagccctgaaccatatcttgatgatgcacctcaaaaaactagccccctctctaagacagcactgtccaatttttttttttttttttttttttttgagacagggtctcactctgtcactcaaggctcaggctggagtacagcggcatgatctcggctcactgcaagctccatgtcctgggctccctcagcctccgcagtggctgggactaagggcgcaggtcaccaacccagctaatttttgtattttttgtagagatggggtttcgtcatgctgtccagactgttctcaaacatctggcctcaagtgatccccccgccttggacacccaaagtggtgggattacaggcatgagctaccgctcccggccccaaaagaactttctactgtgatgggaatattccaaatctgaaccatttaatatggtagacactatttccatatagacattgagcacctgaaatgtgaccagtgcaactgagcaagtgaattttttttttttttttttgagacggagtctcactctgttgcccaggctggagtgcagtggcacaatcttggctcactgcaagctccgcctcccgggttcacgccattctcctgcctcagcctcccaagtagctgggactacaggcgcccgccaccatgcccggataactttttgtatttttagtagagatggggtttcaccgtgttagccaggatgagtctcgatctcctgacctcatgatccgcccgccttggcctcccaaagggctgggattacaggcttgagccactgcgcccggccgcaagtgaattttttatttcagttaatttccatcttcttctttttttttttttttgagacagactctcgttctgttgcccaaactggagtgcagtggcgtgatctcagctcactgcaacctccgcctcccaagttcaagtgattctcctgccttagcctccggagtagctaggattacaggcatgtgctcccatgcccgacaaatttttgtatttttagtagaggtagggttttgccatgttggccaggctgtctcctgacctcaggtgatccatctgcctgggactcccaaagtgcttggattacaggcataagccacgacatctggcctatttcagttaacttcaatttaaatggccacactggccagtgtttgtaatagtgagcagcacggctgtgtcctcacttttctaaggcaggccacgaccactcacaagtcactgtgtagcctgttaatactgtttcagtctggtaaactgaagctctggtttcagaaagaaaagcacttttgggaacaacagtcaaagacacgggccgggcgcggtggctcacgcctgtaatcccagcactttgggaggccgaggctggtggatcacaaggtcaggagatcgagaccgtcctggctaacacggtgaaaccccatctctactaaaaatagaaaaaattagccgggcgtggtggcagtcgcctgtagtcccagctactccggaggctgaggcaggagaatggtgtgaacccgggaggcggagcctgcagtgagctgagatcgcgccactgcactccagcctgggtgacagagcgagactccgtctcaaaaaaaaaaaaatcaaagacacagagagtggatttgatgcactttcactgccttgctccaggaacatgctctgagctatgacaaggcagagcaggggcttgcgggcctacgtgacaaaataaaccaggaggggaactgagcccctaagggtatgaaccctgtatctggaaaacatgggtggcaccagtgagatttacagatatatgatgtgctaaaattactgaatgaagcaattcttcaataaaagattctagagagaagcatgcccctcccacagttttacctcttcattacgttaaatattaaattaattccctagaaaatatcctcatggtcatgtcattataagtctgaaaattaactgcaggaattaggtactgccagccttccttctgagtcttcagcagcctgggcctcacatccactgcagcttggagtaaggctaatgtggggggtggccagcagccagccctgctctaagctgatctgtggcacaggtggagggagaacaggaaatacctacccactgtgcaggggcaaaagcattctatatgcctgtgacaaaccagagtttgttccaccaccacatttaaagggcaagacaaccacaggcctctacatcaaaatgacggtccaatggggtgtccagcaagccccatcgcccttccaaagcccactccactcagagacagtcatcagtcatgccagaggccccaacatcctcccaaatgatgataaaaatcacactcttggaaccacaaattgtggtcaggcatggtggcttatgtacgtaatcccaaaaatttgggaggccaaggaaggaaaatcacttgaggccaggagctcaggaccagcctgggcaacaaagcaagaccccatctctacaatcaatcaataaaatttttttaaaaagacttgcaaattgccatggcaggtgtggtgctgccttgtcagagaactgcagagaaacagcactacctcactgcacagcaaaggcccagcatagggatcttagctattttttcccgggacagtggaagccaagtcctttactccacacaggccttgtctgtgtttaagggaacccagggcaggtaactcacaatcttccctccctcacctgggcctatgttaccatttactatgcttcaaaatgaacagaaggcagaagtggtcatttctaaagtttctaccctggtagtgcctcccagagagagcaggggcacaaacacaggaaggaaccggatccacctttcatctgtgcctaaaagaacatcaaagaacatcaaggttcacaccatcccagctctaagccccactgcccatatcaccacctgagcctggacaccaagaagggacttgaccaggctgtgctaaacccaagcacctgcatttgacctctgggtacatgctcaaggaattagatccaaagacaacaacataggggtctgctttcctctatgtttctttcataggagataaacatctcacgtggacatggcctcatctgtgctctgacctgcttcacccaccagacaagcctgaagctggaacaggtgcccaaattattcagcaagccccagactgtctacgcagtcctccactctacactacctgagagcacccactaaacggaaaaaaacaaacaccagacttctcagggagaaaacatctgggtgaataggagggtggggctttgcccaggcctgggaccaggacacgccccgccctgaagtggccgcagagcctttacctggaatcgccgtcctgctcatcagcatggtcgcccgtgttgctggcagcgtatctgctacgcggcttacctgagtcggggcgaaaagaggggaagggctaagaaaacagggtccttccacacacaggagggttatggaaccgttaacagccatgttttccaaaacatgctctgtccataccatggaatattactcagacataaaaaggaatgaacatgggtgaaccttgacaacatcatgctgaataagccagagacaaaagaacaaatggtgcacttacagtatatgaaatgtctagaacaggcaaatgcatcaagacagaaagtagattagaggttagcacaggctgggagcaggggaaatgaagagttattggtcagtggttacagagtttcagtttacgtgctgaaaaagctttagaaacagatagcggtaatggctgcacactataatgaatgtaattaatgccacttaattatacacttacaaatcattaaaatgacaaatcttatgttatcttcaaaaacagtgataaggcacggtggcccgtgcctgtaatcccaaccctttaggaggccaaggtgggtggatcacctgaggtcaggagttcgaaaccagcctggccaacatggcgaaaccccgtctctactaaaaatacaaaaattagccgggcatggctgagcgcggtggttcacgcctgtaatcccagcactttgggaggccgaggcgggtggatcacgaaatcaggagatcaagaccatcctggctaacacggtgaaaccccgtctctactaaaaatacaaaaaattagccgggcgtggtggtgggtgcctgtagtcccagctactctggagggtgaggcaagagaatggtgtgaacccgggaagcagagcttgcagtgagccaagatcgcgccactgtactccagcctgggagacacggcaagactccgtctcaaaaaaaaaaaaaaaaattagccgggcatggtggtgggcacctgtaatcccagctactcaggaggatgaggattgtgctactgcacttgagcctgggtgacagagtgagactcagtctcaaaaaaaaaaaaaaaaaaaaaacgctaacaatcagctcagccttcagcaaaacaatcgttttgctggagaaaggtattgcctcaatgttgatggctgttgactgattagagtggtacttgctgaaggctggggtgctgtagcaatttcttaaaataagacaacaatgacctctgctacatctatcaatttactcttcctttcatgaaagatttctctgtcgtacgggacgttgacagcactttatccaccacagaacttctttcagaattggaagcaatgctctcaaactgtaccactgctttatcaactaagtttatataatattcgaaatctctgttgtcattttaacaatgtttacaacatctttaccaggaatacattccatttccagaagctactttctttctttctttttttttttttttgagacagggtatcactctgtcatccagactggagtgcggtggtgtgatcaccgttcactacagtcttgacctcccaaggctcaggtgatcctcctacctcagtcccctgagtagctgggactacaggcatatgacacccatgtccggctagtttttgtatttttaatagagatgaatttttgtcatgttgcacaggttggtctcgaactcccgggctcaagtgatccacctgcctcagcctcccaagtgttgggattacaggcgtgagtcaccacactcagcccagaaactgctttctttgcccatccataacaatcaagtcctcatccgttcaagttttatcgtgagactgcagcatttcagtcacatctttaggccctacttctaattctagatctcttgctatttccaccatatctgcagttacttcctccactgaagtttcgactccttcaaagtcatccatgagagctggaatcaactttttccaaactcctgttactgttgatattttgacatgatcaccaatgttcttaatggcatctataatggcacatgctttccagaaggttttcaatttattttgccctgatctgtccaaggaatcactatctatggcagctatagccttacaaattgtatttctttttttttttttttttttgagacggagtctcgctctgtcgcccaggctggagtgcagtggcgggatctcggctcactgcaagctccgcctcccggattcacgccattctcctgcctcagcctcccaagtagctgggactacaggcgcccgccactatgcccggctaattttttgtatttttagtagacatggggtttcactgtgttagccaggatggtcttgatctcctgacctcgtgatccgcccacctcggcctcccaaagtgctaggattacaggcgtgagccaccgcacccggcccaccttgcacttttacgttatagagatggtttctttccttaaatctcatgaactaacttctgctagcttccaacttttcttctgcagcttccttacctctctcagccttctcagaattaaagagagttagagcctttttctggattaggctttggtttaagagaatattgtggctggcctgatctatccagaccactaaaactttccataccagcaacaaacaaagctatttacctttttatcatgcattcactgttctgttttgctttgttttgagacagagtctccctcttgttgcccaggctggagtgcaatgtcggatctcagctcactgcaacctctgcctcccaggctcaagcaattctcccgtctcagcctcccgagtagctggggattacaggcatgggccaacacgcccagctaatttttgtatttttttttttagcagagatggggtttcaccatgttgtccaggctggtctcgaacttctgacctcgtgatccgcccgcctcggcttcccaaagtgctaggattacaggcatgagccactgtgcctagcgttgtttgtttgtttgtttgttttaagagtcagggtctccctatgttgcccaggctagatttaaactcctgggctcaagcaattttcctgcctacagttcccaggtagctgggagtacaggtgcaggcctggcttggagtaacacttcccatttccttcaagagcttttcctttgcatttaccatttggctgttttgtgcaagcagactagcttttggcctagttcagctttcaacatgccttcctcaagaagcctaatcatttctagcttttgatttaatgtgagaaacatgtgattctttatttcacttgaacccttagaggccactgtagataaccagcttaatttcaatattgttgtgtctaagggaacagggtggtccaaggagatggaaacagatgggcgaacagccagaatacacacaattattgatgaaacttgctatcttatgtggacatggttcttggtaccccaaaacaatcacaatagtaacataaagatcatgtatcaccgtaacagatacaataataatgaaaaagtttgaaatactgcaagaattaccaaaacaccacccagagacacaaagtgagtatatactgttggaaaaatggtgctgacagacttgctggacacaggtttgccatgaactttcaatttgtagaaaacacaataaagtgaggtaggcccctatgcacatgtacacacacacacacaccccctcacagtgtgggatgacaattaggttggaaaaagcataggcaaaataaaaaaaatttaaatgtacatacaccaagagccttcatatacacaaacaataatactttcccggagtaaaaaaatttaaaaacctagtgatgaatctaagaagagtgcaaaaggcccatgaaaacaatggaaaagctaataagggagaaaaaaatgaattgaagacatatcattttcctgaacgggaagattcaacataaagatgctttttcttcccagttaatcaacagattcaaagctacctacaccaagagcttgggagtgggacctaatgcacttgatgcgaaagtttacagggaaaaataataaagcacagccaggataacgctgaaaaagaaaagtaacgacaagtgactaaccttacggatagtataacataaagtcacagtaattattattatttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccaagtcacagtaattattatggaacctacacatagatcattggaggagataagaaagacaaaaaatagatccaagtaaacgtgagaatttagcacgataaagagagcagaatcaattagtggaaataaggtgaattattcaataaaattatgttgggaccagatagccatatggaaaagaaaattatgttggcccaatcaatcatcatttggccacgttgtggcctgttataactccagttccacagggctccaaaggcaaccatgcagttcatctgcaactcttcacaagagcccagaaaatatcagctcttaggattagccttcaccttatgccaagacaaacacatttaaaaacaagacatactttgggatgccgaggaaggcagatcacgaggtcaggagttcaagaccagcctggctgatatggtgaaaccccatctctactaaaaatacaaaaattagccaggcgtggtggcacgcacctgtaaacccagctactcgggaggctgggacaggagaatcgcttgaacccgggaagcagaggttgcagtgagccaagatcaggccattgcactccagcctgggcaacagagtgagactctgtctcaaaaaaaaaaaaaaaaaaaaaagacataaacagtctggaggaaaataagggagttttttattgttgttgttaataattttggagagcaaaacgcctttccatttaaaacaaaactcagaaaccacaagagattagactgaaaactccacaaaaatcaaaactctggcaagaactacacagaagcaaacagggtgactatagctttgtcccaagacctatttttacattaaatatataaagaactccttcaaatctataaggaaaaaaaatcaaacaacccaagagaacattaggcaaaggttataaataagtcattcactgaaaaggaaatccaaatggctccaaaaacaggaaaatatgctttctatctcaattaaaaggcaaataaacattaaaattactaccagatataatttttcacctaccagattaacaaagattgaaaaatctaacctattaaaaataaatatgctctttatcccttagacccaaccatgctactttggggatttaatattacaagaattctgcaaaatgacaatacctggaaagaacgtttgaacttttcgtattagcaaaagattgaaaacaattttgcgtccatcaaccaaaaggacacgataaacaaatcacaatatgttcatctcatggaattcaccgtggccggtaagaaggacaagggtgctcgacaggttctgatctacatcaaagatgcagacatgaagtgaaaacgaaaacaggggcagaacagtgtgtatggtgtgactttgcttgtgcttagaaaaaaaacacaagtgcaggctgggcgcggtggctcacgcctgtaatcccagcactttgggaggccaaggcgggcggatcacaaggtcaggagttggagaccagcctggccaacatggtgaaaccccatctctactaaaaataaaaaaaaaaattagctgggcatggtggcgcatgcctgtagtcccagctactcgggaggctgaggcaggagaattgcttgacagggggtcggaggttgcggtgagccgagatcacgccactgcactccagcctggcaagactgcaagactcgtctcaaaaaaaaaaaaaaagaaaaaagaaatacatacgcctgtattgacacagaaggtcctggaaagacacagaaaaatgggaacagtagttacccctatgatggaaactgagggctgggggccaatagtaggaaagaactttcttttcataatctaaactcctttgtatctttaaaactttctgccatatcaacaagtttaaaaataattttaaaacaaaatacaaaataaaaactgaacagtccgggtgcggtggctcacacctgtaatcccagtactttgggaggccgaggcaggtagatcatttgaggccaggagttcgagatcagcctggccaacatggcaaaaccccatctctactaaaaaaaaaaaaaaaaaaaaaaaaaattgcagggtgtggtgcacatgccctgtagccccagctacttgggaggctgaggcaggagaatcccttgagcccgggaggtggaggctgcagtgagccgagatcacgccactcaactccagcctgggcgacagagtgagactccgtctcaaaaaataaataaaataaaaacaaaaactgaacattcatgatgatgaaaaatcaaaagtaacctacatgccgtccacaggggaaggcagcagcctgcagccaagggtgaggttgatccctgcttgcaaaggcagacggagctccaaggccgactatgggaaaagggcgccacagaacaattcgtgcgatgaaaaacctcacgcgacgttcccttttcctgtggatagatctgcatctatgcacagggcagacaactcccaacacggccaggggtgatccctgtgcttgctagaactgggggtggcaaagacaacttcagatgttcacgtaacttttttttttttttttgagacggagtcttgctctgttgcccaggctggaatccagtggcgcgatctcggttcactgaaacctccgcctcccgggttcaagcaattctcctgcctcagcctcccaagtagctaggattatgggcacgcaccaccacgctcggctaatttgtttttttttatttttattttttcagtagagacagagtttcaaccatgttggccaggctggtctcgaactcctgacctcaggtgatccacccgcctcggcctcccaaagtgctgggattaccgccaccggccttgttcgtgtaattttgtattttctcatgatgaatacatcccaaactcattttattttattttactttattttttaaaggctggagactgatgaaatgtcagcagtagttgctttggtgtggtgaacaatgcatgattttaattttttttttcctttttctacttttcaaatactctacaacgagcagatctcgaatgcccagcaaaagctaagctccgcgaggcggccctggaatgaggcgaccccggaatgaggcggcccccgcgagcgccaggcccccgcccagcgctcacttacttgtctgggacgccgggtgctcctggcttctctggaaggggtacctgaacagcagcttattgcccctgctccccgagctcaccagaatcacgctgatggggctggtgttgtcccgcatcccgccgtggggccggggccgggggcggagggggccagaggaggacggagccggaggcggagggggcctgaggaggacggagccggaggcggagggggcctgaggaggacgaggcggggacgcagggggcctgaggagggcaggggtggaggcggagggggcctgaggagggcaggggtggaggcggagggggcctgaggagggcaggggtggaggcggagggggcctgaggagggcaggggtggaggcggagggggcctgagtagggcaggggtggaggcggagggggcctgaggagggcaggggtggaggcggagggggcctgaggaggacaggggtggtggtggacgcggagcagcgccacagttaccaacccacgtgccacgctccgggctcgcgagacttcggcgacaccgtccggaggaggtgctaaggcggcggccgggagaacggcgcaggcgcaggcgcaggcgcaggcagcggaatgcgcaggcgcggggccttctggaagccaccgagttccgcggtgctgtctggagccgtacggttcgcgtttggggcacaggggcccctcttgctggtgcggatgggaaaggcgcggggtcgagtcagcgtccctctcgatgttggtttcttcgttttacaaataacacttgggcggggcgcggtggctcacgcctgtaatcccagcattttgggaggccgaggcgggcggatcacgaggtcaggagatcgagaccatcctagctaacatagtgaaaccccatctctactaaaaattagaagaaattatccgggcgtggtggcaggcgcccgtaatcctagaggagaatcgcttgaacccgggaggcggaggttgcattgagccaagatcacgccattgcactccaccctgggcgacagagcgacgagaccccgtatcaaaaaaaaaaaaaagaaagaaagaaagaaaaaagaaaaaaaaaaggccgggcgcggtggctcacgcctgtaatcccagcactttgggaggccgaggcgggtgaatcacgaggtcaggagttcgagaccatcctggccaacatggtgaaaccccgtctctacaaaaaaaaaaaaaaaaattagccgggcgtggtggcgggcgcctgtaatcccagctactcgggaggctgagacaggaaaatcgcttgaacccgggaggcggagcttgcggtgagccgagattgcgccactgcactacagcctaggcgacagagcgagactccgtctcaaaaaaaaaaaaaaaaaaaaaaaacacttggaagccgacaggagatctttgagaccttgggcgaggcagtgacactaaaggcaggagcgactacagaagaataaattaaacttcatcagattaaaaactttactgcggccgggcgcggtggctcacgcctgaaatcccagcactttgggaggccgaggtgggcagatcatgagatcaggagatctagaccatcctggccaacatggtaaaaccccgtctctctactaaaaatacaaaaattagctgggtttggcggcgcctgcttctaatcccagctactcgggaggctgaggcaggagaatcgcttgaagccgggaggcggaggttgcagtgagccgagatcgtgccactgaactctggcctggcgacagagcgagactccatctcaaaacaaaacaaaaacttcggtgctttaaaggacaccatcaagaaaattaaaagtccacccacagaacgggagaaaatatttgtaagttacatatctgataagggaattgtatctagaatggaggaaacttacaactcaacaataaaaagacaattgaaaaatgcacaaaggatatgaatatttttccagtgcattatgcaaatggccaataagcaccagaagatgctcagctcaactggtagaggcttacgcctgtgaccccagcgctgagaggccaggaactccagaccagcctgggcaaaacagaaattaaaaatgctcaacattattaggcattagggagatgcaaatcaaaactacaaatagatgccacatcacacctcctacgatggctgtaatcaaaaagacaagcgtcagcaggggtgtggagaaacgggaatctctctcctgctggtgggaatgtaagaggctacactcgctatggaaaacaggctggcagttcctgaaaggttagagttaacacaacactcggcaaatcccccttttagatatatagccaagagaaatgaaagcatatgtccacacaaaaacatgtgtgttcttagtaatattattcataatagcccaaagtggaagcaatcctagggtatatcaattgatgaatgggtgaatatggtatagtttgtttaagggaatactattcagccataaaaaggaatgaagtacggcacatgaatccatcttgaagacacactaatatatgattccatttatataagatgcccagaataggcaaatccatagagacagaatgattagtggctgcctagggcttccagggggtcaggggaaatatggagcgattcatgggttttttgaaggggagtgatgaaaatgttctaacgttgactgtggtaatggttggacagctctgagaacgcgaatacactaaaagacatggaagtgccgggcgcagtggctcatgcctgtaatcccagcgctttgggaggccaaggcaggcggatcgcgaggtcaggagatcgagaccatcctggctaagacagtgaaaccccgtgtctactaaaaatacaaaaaattagctggacatggtgcgggcgcctgtagtcccagatactcaggaggctgaggcaggagaatggtgtgaacccgggaggcggagcttgcagtgagccaagatcgcaccattgcactccagcctgggcgacagagcgagactccatctcaaaaacaaaaaaaagatatggaagtgtacacttgaagtggataagctttatggtatgcaaattggtatggtatggtaaattatatctcaatgaagttgttttttaaaaaatcaccccacctaccctatcccaggcttccccaggaggtaactaaaggtaatgagcttctttggctgcttccagaactttcccaagcacatcaaatgcatcagaacctaaccacttgactgagggatgagcattttcactgttgcaagtaaccctcttgcaccaacactgacactaatgtgtattttgcagaacaaatttgtggattggcctcaccagggtgaagggtacgtgcatttgaaatggctcaacagtaccaacaggtgcgttttcttgcacagggctgcataacattttttttttttttttgagacagagtctcgctctatcacccaggctggagggcagtggcacaatctcagttcactgcaagctccacctaccaggttcacatcattctcctgcctcagcctcccaagtagctgggactacaggtgcccgccaccacaccaggctaattttttttttttttttgagatggagtcttgctctgtcgcccaggctggagtgcagtggcacgatctcagctcactgcaagctccacctcccaggttcacaccattctcctgcctcagcctccccagtagctgagactacaggcgcccgccaccacgtccggctaatttttttgtatttttagtagagacggggtttcaccgcgttagccaggatggtctcgatctcctgacctcttgatccacccgcctcggcctctcaaagtgctgggattacaggcgtgagccaccgtgcccggcctgcataacatttttttttttcctgaaattcccagaaaggaaaatggtgtcttgttctatgttgcatttctttgattgagagggagagctgcatcacttaattatttgcagagaattgcttttcttgttttctttacaggtggtctgttcttggatggtctggctgtgttctttctgaggaatacataacctctgctacacattttgcaaggctttatccccgttgtccatgttttgattttatgtataatcaaaaggtttgtgagttctcccgcacttcccaggagtgcctctgggatggaaatgagactgcaggagcagggcttgaggctggaggggtgagatgggacagatgggggtgggggaacccagggcagtggccggtggtggtaatggaggcctcctcacagggaccctcacagcgaccatgcgaatggagcaggactgtgactcaggtctcgctcttctgacctaatcgtgctgctgccccaatgggcagaaccttggggctccagactggacatctctgggctcaaaggatcccactgttcccccggttaccctctcagggttggcctcctgccagtaaccctggcactcattgttcattcttctgactatcgtcagtcataatgagagctcgaactggtgaaagtgcagggagctcaccatgaccccagcccacagaggtcctgggtgcgtccctgccctcgaagcagcactctggatcccagcgccaccctcatgtccatgtttgcacctcattggctgtgacagaaatgagacatcattgtcacacgctggcctgagggtcagtgggccttgctttggacctcagtttccccaccagtaacagggttcagagcagatggtccctgagtgagtcccagctctaagttctcccagggtctcctggacaatgaagcaccagggccaacctccatttgctacaggggacatcctcaggctcttctctgctaagaccccacacctccaagtctcctcattttacctttaaatagctgtttcatgacctgcttttttgacggtaagtagatttttggaaactgaaacccctgacccttcctcccagcctgggcctgcccttggcaggataggaggccttatcggtcctgccacttggtctgggcctcaaagggccaccgccatctgcaggagggccgggtggggttcacagacgctatctgggacttgcctggacacctccaccttctcagctgagtgttgctgccccaccagggagaaccactcacacacagtagtaatagaaataatttaaaattcatgctgcaagttcctgagcgccctcccaacactgaggtgggggctagtctaatccccatcctagaggtgaaaacagtgaaactaggactcacaaggcaaattagcctgttcagggtcaccgagggtccactctcatgggagagtttgcagatgcccaatccggcattctgctgagtgtccagtggcttgtaagtggccagacaccctttgagctcagcctcagctgctcaggcacagaacgtgcctggagcttggaattcaggccagaaaccaccagtggacaccagcattccacactcactgcacaggctggggctcaaaccaaggcccagggacaggaagggacaagccccagccccagccggactcccagcccacacaaaccatcagggcttgtttcctgctccatggaagcctcagacatgtttcataacctcctggagcctccgtttccttatctttccaatgtaatgatgcccatgtgcagtggctcacgcctgtaatcccaagcactttaggaggccgaggtgggtggatcactggagctcaggagtttgaggccagcctgggcaacatggcaaaacgccatctctactaaaaacacaaatattacccaggcatagtggcacatgcctatagtcccagctactcaggaggctgaggtgggaggatcacctgagcttgggaagttgagcctgcagtgagccaagattgtcacactgcactctagcctggaggacagagtaagaagaccctgtaacaaaacaaaacataacaaaacaaacaaacaaaaaacccaactaatgacaataaaataaaccctccctcacagggtggttgtgaggataaagcacccagaatgaagagtgttgctgccatgtgcagaacttagaaagtgctcaacagatgccagccaaacagacatggactcccctcaacacagtcaacccaaggttgactgtcaccaaacgcaaaagaccacactgtaaagcttttagaaatgtggtctagtggccgggcactgtggctcatgcctgtaatctcagcactttggaaggctgaggcgggcggatcacagggtcaggagttcgagaccagcctgaccacctgaccaacgtggtaaaaccccgtctctactaaagattcaaaaaattagccgggtgtagtgctacgtgcctgtaatcccagctgctcgggaggctgaggcaggagaatcgcttgaacccaggaggcggaggtacagtgagctgagatcgcgccattgcactccagcctgggagacagagagagactccgtctcaaaaaaaaaaaaaaaaaaaaagttagccgggtggtagtggcatgtacctgtaatcccagctacttgggaggctgaggtaggagaatcgcttgagcctgggaggtagagggttgcggtgagccaagatggcgccactgcactccaatctgggcgagacactgagaccctgtctcaaaaaaaaaaaaaaaatgtggtctaggagactctcttcactttgagataaaatttgcatcacgtaaagataaccattttaacgagagcaagtcaacggcattcagcacattcagagtgttgtgcaacaaccacttctccctggttccaggacattttcatcgcctcagatggaaacgccctcctcacggaggcatctctcccggcctttgtcctccccggccctgacaaccactaatctactttctgctgggatttgcccattctggatgtttcctaaaaatggcttatctaagccccacagtttcatgcagcacgtagcctctggtgtgtgacgtccttcacttggtgtaatggttcgaggcttgtccatgtcgtagcctgggtcagaacttcattttcatggctgaataatatctcacggtgtggaaatatcacagtttgcttatctgttcatccagtgatggacatttgggttgtttctaccttttggctattgggaatggaagggataacattttttaattggatttttaaagtcactagtttgactgcattaaaattacaaacttttgtttaacgagaatatcactaagatacagagttggggagatctaacacataaaagtgacaaaggaattatatccagaatatttttgaaatttctacaaatcagtgactggcaacacagtgggaaagtggccaagactaaaatactttaataaagaggaaaccgaaatggccagtaaatatgggctcaacctcactaattatcaggaaaatgtaaattaagaccacaagagaaaccactacacactcaccaaaaatcacacacccaataaaaaggtaatttttttttttttttgagatgaagtctcactctattgcccaggctggagtacaatggcgcgatcttggctcactgcaacctccgcctcctgggttcaagcgattctcctgcctcagcctcctgagtacctgggattacaggcgcacaccaccacacccagctaattttgcatttttaagtagagacggggtttcaccatgtgggcaaggctagtctcgaactcctgacctcgtgatctgcccgccttggcctcccaaagtgctgagattacaggcatcagccactgtgcccggcctaaaaaaggctaaaatttaagaagaccaggagtttgactgctatggttggaatgtttgtctcctctaaaactcttgttgaaacttaatccccagtgtggcagcgttgagaggtggggcctttggggtaaggaggttggatcatgagggtcctcccccaaggaatggattaatgagttgtcatgggagtgtggctggtggctttataagaagagagacctggccgggcacggtggctgacacctgtaatcccagcactttgtgaggccgagatgggcggatcacaaggtcaggggatcgagaccatcctggctaacacagtgaaaccctgtctctactaaaaaaaaaatgcaaaaaaattagccgggcgtggtggcgggcacctgtagtcccagctactaggaaggctgaggcaggagaatggcgtgaacctgggaggcggagcttgcagtgagccgagatcgcgccactgccctccagcctgggcgacagagcaagactctgtctcaaaaaaaaaaagaagagagatctgaggtggcacacaagcatgctcagcccacacgacctgcgattaatactctgtgccactttgggactctgcacgagtccccactgggctcgaaacttctcagcctccgtaactataggaaataaattccttttaaaataaattccacagtctcaggtattctattataagcaacagaaaatggagtactacaccgatcatatcaaatgtttagaaggatttggagcaaggagaatgctcgcacaccactagggaaaacataagttggttaaccactgtgaaaaagtttggcattctttactaaagttgaaaatctatatgccctatgacccagcaactttactcctaggtatgtatgtacaaaatagaatttcaggcatgtgggtaccaggtgacatgtaaaggaatgtttattgcagcattattcataatagccaagaactaaacaacacaaagttccagccccagtacaatgaataaactgtggtatattcctacaaggaaatattaatagatacagcaatgaaaatgaacacatataacatggctggtaaatctgacatgagagagtgaaagaagatggacattcagtgtgcagacagttggattaaaaatatttttttaaaggccaggcttggtggctcacatctataatcctagcacttacagaggccaaggcgggcagatcacctgaggtcaggagttcaggaccagcctggctaacacagtgaaaccccatctctactagaaaatacaaaaattagccaggtgtggtggtgcatgcctgtagtcccaactactcgggaggctgaggcaggagaatcacttgaacctaggaggcggaggttgcagtgagccaagatcgcatcactgtactccatcctgggtgacagagcaagactgcgtctcgaaaataaatagataaataaataaataaccaacaggccgggagcagtggctcatgcctgtaatcccagcactttgggaggctgaggtgggcagatcacgaggtcaggagatcaagaccatcctggctaacacagtgaaaccctgtctctactgaaaatacaaaaaaattagccgggcatggtggcgggcgcctgtagtcccagctactcaggaggctgaggcaggagaatggcatgaacccgggaggtggagcttgcagtgagccgagatcatgccactgcactccagcctgagcgacagagcgagactccatctcaaaaaaataataattaaaaataaataaattaaataaataaataacagattgcataaagtggctcatgcctgtaatccaagcactttgggaggccaaggcagaaggatcacttgagcccaggagttcaggacaagcctgagcaacatggtgaaaccccacctctacaaaaaaaaaaaaaaaattagctgggcatggtggcatgtgcctgtgatcccagctacttgggaggctgaggcaggaggatcacttaagcctgggaggtcgaggctgcaatgagctatgatcgtaccactgcactccagcctgggcaatagagcaagaccctgtctcaaaacaaataaacaaaagccagacagacacaaatgagagcattctgtatcgtttcatttctatgaaggtgaaaagcaggcaaaaacaaccaaagtgcttgcagatgcatatctgagtagttaaaaacttactgaaaagcaggcctggctcacgcctttaatcccagcactttgggaagcgggcggatcacgaggtcaggagatcgagaccatcctggctaacacggtgaaaccccgtctctactaaaaatataaaaaattagccaggtatggtggctagtgcctgtggtcccagctactcgagaggctgaggcaggagaatggcatgaatccgggaggtggagcttgcagtgagctaagatcgtgcaactgcactccagcctgggcagcagagcgagactccctctcaaaaaaaaaaaaacttactgaaaagcaagaagtcaggtggaggttacctttggggaggattggggtgctgtccgctttctaataattcgttaaactatagtctacatcttgtgctatatttcacaatggaaaaacagaaaagagctcctgcccataacgctgctttgcaggtttggaaatttcagattcaattcctctccttgcgggggccaaggatgggaagagcaggtggttccagtagggaaagaggaggccctggggcctcaaaatggctaaggaccattcctcagcgtgggtggcacctaccctggaaacaggactctacttcctcctctgttagggggcagagcagccctgcagtgccttctgggcacaggtcctcactctgcagctggaggaattctcccaggcactgagagcccttcacggcccaaatgccccgtgcgctcggcctctggacttgccttccctgctctgtatatctccctccgcctgaccctcagcctcctccatcactcactgtcttctctgccagtctattcatctgtctctgtccctctctctgccaccttctctcctattgagaagccgaaacctcaggcacagacccacatcccctcctcatgggcccatgtgcccaaggtgcccctaggtgccaggctgagatgaaccaggagtgtccttctgaacccagcaacagcgaagggtgaccagggagggccagttcatctcggtctgaaagaagccccagatgagcaaaggatacactggcctcctgcggtcagcagcacttcccaggacagtgagcaagacaggggtaaggccagagtgggtgggcacacccatgggagagaggagccgctgtgaaatgtgcacgaggaacagaccagcaaggaggatccacgcagtgctagaagggagttcctggaagcctggtggagagcccctcccatctgctaagcccggagggcatcaaaggctgctgctgccctcaacccctgacaatctcatcatctcatatctcaggcatggaagaatgagggccattacacgagtaaaacatcaagtacactccagcctggatgacagggccaggctccatctcaaaaaaaaatgcctgtggtcaaagctctcctgacaggggaaaacaaaacaaaacaaacttctccttaaagaaaacatttgcctttgactgcatcataattccagcaggattttgtgcagataactctttggctaactctaaaattaatacagaaaggtaaagaaattagaatagccaaagaaattttgaaaaggaagaataaagcgagaggaatcacattcctcaatttttaacagctctattgagataaaattcacataccatacggttcacccatttaaagtgtataattcaggccgggcgcggtggctcacgcctgtaatcccagcactttgggaggctgaagcgggcagatcacctgaggtcgggaattcgagaccagtctgaccaacatggagaaaccccgtctctactaaaaatacaaaattagccaggcgtggtggctcatgcctgtactcccagctactcggaagactgaggcaagagaattgcttgaacccgggagacggaggttgccatgagccgagatcgcgccaccacacccagctgccattttttaattgattacttgtctatttattactgagttgtaagatattttgggccaagcacggtggctaacgcctgtaatcccagcactttaggaggctatggtgggcaaatcacttgaggtcaggagttcgagaccaggctggccaacatggcaaaacaccatctctactaaaaatacaaaaaaattagccaggtgtggccaggcgtggtgactcacgcctgtaatcccagcactttgggaggccaaggcgggtggatcacctgaggtcgggggctcaagaccagcctgaccaacatggagaaaccccgactccgctaaaaatacaaaattagccgggtgtggtggtgcatgcctgtaatcccagctactcacgaagctgaggcaggagaatggcttgagcccaggaggcagaggttgtggtgagctgagatcatgccattgtactccagcctgggcgacaagagcgaaattctgtcacaaaaaaaaaaaaaccattagccagccatggtgatgcacacccgtggtcccagctactcaggaggctgaggtatgagaattgcttgaacccaggaggcagaggttgcagcgagccaggattacgccgctgcactccagtctgggtgacagagcaagactctgtctaaaaaaaaaacaaaaacaaaaaagatattttgtatgtgtttggataacttccctatcagatatatgatttgcaaatatgtttctctcattctgtgagacatcattcaattttaagacatcacagagctatgttaatcaaggcactgtggctgtggtaaaggatagacacacagaacagaacagagagcccagaaatggacccgcaaacctatgccccattcattttttacaaataagtgcgagaagccaactgaatagaaagcgtatagctttttcaaaaaacagtgctggaacaattggacatctgtaggcaaaaaaacaaacaagcaaacagaagaatctggacctgcccttcacacctcagacaaaagtcatctcaaaatggattgtagatctcaatataaacataaactatacaactttagaagaaaatataggtgaaactctttgtgttctgtggttaggcagacagttcctaggcatggcactaagtaagattcatttaaaattttttgacaaattggactttattaaaacttttgctctacaaaagacaatattaagagaatgaactaacaagctacaaactaagagaaaacatttgcaaattgcatatctgacaagggattgcttccagacgatacacagaattctaaaaattcatccttaagagaataaaccacccaatttttaaatgggcaaaacaggccaggcgtggtggtgcacgcctgtaatcctagcactttgggaggccgaggcaggcggatcacaaggtcaggagattgagaccatcctagctaacacggtgaaaccctgtctctactaaaaatacaaaaaattagccaggcatggtggcaggtgcctgtagtcccagctactcgggaggctgaggcaggagaatggcgtgaacctgggaggcggagcttgcagtgagtggagatcgcaccactgcgctccagcctgggcaacagagcgagactccgtctcaaaaaaaagacaaaatacttgaaaagatattggctaggcgcgctggctcatgcctgtaatcccagcactttgggaggccaaggcgggtggatcacaaggtcaggagttcaagcagcctggccaagatggtgaaaccccgtctctactaaaaaaaaaaaaaaaaaaaaaaaaaaaattggccgggcacagtggctcatgcctgtaatcccagcactttgggaggctgaggcaggtggatcaggagtcaggagatcgagaccatcctggccaacatggtgaaaccccatctctatgaaaatacaaaaattagccagagatgatgccgggtgcctgtaatcccagctactcatgaggctgaggcagaagaatcacttgaaccagggagtcagaggttgcagtgagctgagatcgcaccactgcactccaccctgggcgacaaatcgagattccatctcaaaaaaagaaaaaaaaattaaaaggaatatttgcctcattatgttacaataactaatatggaaagcaatattgcaatgcctattagcacatgacattaggtgaattctcctttgtccccggacctgctgcctcctcctgcttgtcaggggacagatccagtacatctcccctcagcgctgggtggacctaacccttgctttcttggaggaaacccaggaatccagagacaaagtggaagggtactggcatgtggttgggcagggctgcctgaggtcggtgtcagccgaccgtggggcttggtcccaggaggctgcttactgggccctgctcctctggtttcccccaagtcgtgattctgaaatgaataaggacggtgcagaactggactacaaatgcaggagtgacttcctgggagggtggggcccctatctctcctagactctgtggtcagactctggccaacaccccctgtaaggccacaggagaggaacaggagtgatagcccccaaaccccagtcccaccaggccctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagctgcccaccctgccgccatgtctctgaccaagactgagaggaccatcattgtgtccatgtgggccaagatctccacgcaggccgacaccatcggcaccgagactctggagaggtgagtgtcagacgggactgccagagggactgggtgggaggccaggtatgtgagtggggacagtggggagggggcggtggggaggggacagtggggaggggaccatggagaggagacagtggggagggcactgtggggagaggacagtgaggaggggaccttggggaggggacagtgaggagggaaccgtggagaggggacagtgaggaagggacagtgaggacagatagcgttccctctcagtgaggagagcagggtaaggagggaacgattaggagttgcacaaccatctgggctcgctgagacctgggcaggcacaggcccaggttctgacaagcagagggtgaaaggtttcgttctaggcctgaagggccttacagggcagccagggcactacagcctctaaagtcccagcatctgggatcagggcactgtcccagcttcaaattcccagcatctgatcccctgggaggggccagggagcttttccttccctggaacgctgctgggaggtcatgagcctgcagaaggggtggcgggcaacccagtctggggctgggagggaggtcctgtggccagaggagacggtggaggggctgggggcaccaggcgtgctggaggcggagggcgggagatttggggaccaggctgcacagaacccgtcggaagcagggcgatcagccgggagctgcagaggcctggggggcctctagcccagggcagcctgggaggggcagctgcctgggcacccgggccccgcgaggaggggctggggcctgctgcggggtcgcagatgtgtcccggtgctcggagagggccgcagggcgcgtgggccgtggcgggaggccgcgctgctgggagctcacggcccccgccccccgtcccaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaaggtgcgcggggcgcggtgcgggcggggcgggacggggcggggcgcggtgcgggcggggcggggcggggcggggcggggaggggcggggaggggcggggtcgcggggcggatgcgggggtcgccgggcggggcccgggctaggccccgccccctcactgagccgcccccgcccccagctcctgtcccactgcctgctggtcaccctggccgcgcgcttccccgccgacttcacggccgaggcccacgccgcctgggacaagttcctatcggtcgtatcctctgtcctgaccgagaagtaccgctgagcgccgcctccgggacccccaggacaggctgcggcccctcccccgtcctggaggttccccagccccacttaccgcgtaatgcgccaataaaccaatgaacgaagcagcgtccacctggtctctgttgtccgtgggcggcgggcgcttggggaggcggagcgggaggagggcgccccggctgtctcggggccactgctgggccgcagggatccttgcaccgaccccagggtctctaagaggcagagggatgtgcagctcccggggcgggagcgggggtcactcgggacccaggcgtggtggagaaggggtgcagttaggcctttgcggaggggggagcagtgctggcgcccacccgccgcggctctccctgggacctccgtggtcttccttctttatttctcccgaatgtgtactatttcctgatttcagaacgatcaggacgaagaggggagggatgggcgtctgcgctcactcattccttcttccattcctcaatgaaacatttactgggcataagacagcctaggcatgtttctaggctatggataccgcagctgaaataaagaaagccctctgccccgtggggctgacaatctagtgggggatacagacgtgatgaagacagtcagatcacagttcacagaaatgagacaggaaaagaggctgagcctcactcataagagaaacgcaagttaaactacacaaaaataaaaaacctcactgagatccatgtctcacctccctgataggcaaaaatccaagagtttgatcagactgcaggcgcccctcctccactgggcacccctcatccagggcagagggaaccagcccggggcgcaagtccaccggggcatctcatttgctaaagacctgaaaacccaggtgtccatcatcaggactaactggaaaaaccaagggtatccgcaccatggagagctcgactgaaaaaaaaaaatgaggataattggataatttctttttttttttttttttttttcagacggagtctcgctctgtcgcccaggctggagtgcagtggtgcgatcccggctcactgcaagctccgcctcctggtttcaagcgattctcctgcctcagcctcccgagtagctgggtctacaggcgcccgccaccacggctggctaattttttgtatttttagtagagacggggtttcaccgtgttagccaggatggtctcgatctcctgacctcgtgatccacccgcctcggcctcccaaagtgctgggattacaggtgtgagccaccgcgcccgacctaaaatgaggataatttctaataatgaaaataaagaggttagaatggtgtgtatacaatggtggaacagaggagaaacacgaatatgtgtgtgcacatatatgtgagcttatgcataactatgtatgaggctgcgtgtggacatgtgtgtttgtgcacaaccatgtatgtgcccgcatgtgcttatttctgcaaaaataaaccatggcaggacaaaccggaaatgaatacaaataataaggtgggtggggatggaggggaaggtggaaggaagctcctgcaagtctgactctctacatagttttgacctttgatttgtgtaaatattttacattatcaaaaataaattcaggctgggcatggtggctcatacctgtagtcctagcactttgggagtccaaggggagaggattgcttgaggccaggagttgaaggccaccctggccaacatagagagaccctgtctttaaaaaaaattacaaaattaaggccgggcgcggtggctcacgcctgtaatcccagcactgtgggaggccgaggtgggcggatcacgaggtcaggagattgagaccgtcctggctaacacggtgaaaccccgtctctactaaaaagtagaagaaattagccgggtgtggtggcgggtgcctgtagtcccagctacttgggaggctgaggcaggagaatggtgtgaacccgggaggcggagcttgcagtgagccaggttcaagccactgcccttcagcctaggtgatagagtgagactccttctcaaaaaaaaaaaaaaaattacaaaattaataagattaaaataaaaagaggggccttgccagtggctcaagcctctaatcctaccacttgggaggccaaggctggaggatcccttgatgccaagagtcggaggccagcctaggtaacacagcaggacctcgtctcaaaaagattaaaaaattaactgggcatggtagcctccaaattgggggttagcctgggaggtttgcccaggaaggaattcaagggcaagctggtggtgttacacagcaactctgattgatatcgaagccacagcagacagcaggagcagaacactgctccttacagagcaggggtaccccataggctgtgtgcacaggagagcaactcagaggcactgctgcactcatctttatacccacttttcattatatgcaaattaagggaaagttatgcacaaatttctaggatgagtgtggtaacttctgggtggtccagtcactgccatggaaagggatggtaaactcccatggcacactggtgggtgtgtcttatggaaagctgcttctgccctacttgttttagctggtcctcagtttggtccggtgtccgagcccaacatccggagtacatgcagagtcccacctcctacgtcacacctgcagttccagctactcaggaggctgaggctggaggattgctggagcccagatgttgaaggctacagtgagctatgattgtgccaccgcacttcagcctgagcaacacagcaatactctctctctaaaaaagcaaagcacacaaacaaaaagagtgactgggtgcagtggctcacacttggaatcttagcactttgggaggccaaggtgggatggtcacttgagcctgggagttcaagaccagcctaggcaacatagcaagactttatctctactaaaatatatatatattttttaattagctggacatggtggtgcacctgcagtcccagctacttgggaggctgagttgggggtggaggggagtatcacttgagcccagaagttccaggctgtagtaagctatgattgcaccactgcactccagcctgggcaacagagagagaccttatctatatttaaaaaaaaaaaaaaaaagagagagaaaattgaaaactcctaattgaaaacccccaaattgaaaactaacttaaataaatgagccaatgtaagaatgtggtgatataataatcagaaaaaaggattgttccaggtgacctctgaacacagaacctcggctatgaccgaaagaactccaaagacactctaacactccgtggtttattgttcctcataacatatataaaataatttcataagcttttattttgaaacatattcagattatgaagaaataaaaacaccctgcaagaataagacaaagatggagaaggaaggatgactgctggtgggtttggggcttttggagggtgatggaaaccttctaaaattgattatggtgatggtcgcacaattatgtgaacacattaaaaattattgaaatgggccgggggtggtggctcacccctgtaatcccagcactttgggaggccaacgcgggcagattacctgagctcaggagttccagactaacctggccaacatggtgaaacccccgtccctactaaaaatgcaaaaattagccacgcatggtggcacatgcctgtaatcccagctactggggaggctgaggcaggagaattgcttgaacccaggagacagaggttgcagtgagccgagattgtgccactgaactccagcttggccgacagagtgagactctgtctcaaaaaaaaaaaaaattattgaaatgtacacattaagtgggtgaattttatctcaataaaactgttaaataaaataacaagaatatgaaaaactcttgaatactactcatccagactctccagctgttaacattctaccacatcggcttgctctctcttgcccccacttgctctttctctcggagcccttggagaggggtatgcaaatatccgtactctaaatatcctccatatactgtgtatttcctaaaatcaacaaggacattaggctgcacagccagagaacaaccatcaaaatcaggttaatattgatccaaatccatctatcaacagaagcaacatcaagttcaagacccttttgaaagcaatgataccagccatttactccatccctaaaggactgagggtgctgcgaatttaaccgtatcaatgcagtctttttgatgttatttactgaaggaaatggatgttctttaaaatatgtatttatttatttttcttttttgagacggaatcttgttctgtcgcccaggctggagggcagtgggacaatcttggttcactgcaacctctgcctcctgggttcaagaggttctcctgcctcagcctcccgagtagctgggattacaggcgcgaaccaccacgcccggttaattttggtatttttagtagaggcggggttttaccatgttggccaggctggtctcaaactcctgacatggtagcctgtaatcccagctactcgggaggctgaggcaggagaatcgcttgaacccaggaggtggggttgcagtgagccaagatcgtgccattgcactccagcctgggagacagagcgagactccatcaaaaaaaaaaaaaaaaaaaattcctgaagctcctcttgagcttacattctagtggactgtaaacagaaacatttttttttcctgtggataaagaaaagcagggcaagtaggggcttagacagaggaggggaggattcagattttaaatgggttggccactgtaggtctattaacgtggtgacatttgagggagtggcaatactagggaaggggcttcaggggagtggccaggagctagggatagagggagggaggacaggaggccttgtctgtcttttcctccatatgtaagtttcaggagtgagtggggggtgtcgagggtgctgtgctctccggcctgagcctcaggaaggaagggcagtagtcagggatgccagggaaggacagtggagtaggctttgtggggaacttcacggttccattgttgagatgatttgctggagacacacagatgaggacatcaaatacatccctggatcaggccctggggcctgagtccggaagagaggtctgtatggacacacccatcaatgggagcaccaggacacagatggaggctaatgtcatgttgtagacaggatgggtgctgagctgccacacccacattattagaaaataacagcacaggcttggggtggaggcgggacacaagactagccagaaggagaaagaaaggtgaaaagctgttggtgcaaggaagctcttggtatttccaatggcttgggcacaggctgtgagggtgcctgggacggcttgtggggcacaggctgcaagaggtgcccaggacggcttgtggggcacaggttgtgagaggtgccctggacggcttgtggggcacaggctgtgagaggtgcccaggacggcttgtggggcacaggctgtgagggtgcccgggacggcttgtggggcacaggttgtgagaggtgcccgggacggcttgtggggcacaggtttcagaggtgcccgggacggcttgtggggcacaggttgtgagaggtgcccgggacggcttgtgggacacaggttgtgagaggtgcctgggacggcttgtggggcacaggctgtgagggtgcctgggacggcttgtggggcacaggttgtgagaggtgcccgggtcggcttgtggggcacaggttgtgagaggtgcccgggacggcttgtggggcacaggttgtgagacgtgcccgggacggcttgtggggcacaggctgtgagggtgcccgggtcggcttgtggggcacaggctgcaagaggtgcccgggacggcttgtggggcacaggctgtgagggtgcccgggacggcttgtggggcacaggctgtgagggtgcccgggacagctcgtggggcacaggttgtgagaggtgcccgggacggcttgtggggcacaggctgtgagggtgcctgggacggcttgtggggcacaggttgtgagaggtgcccgggacggcttgtggggcacaggttgtgaggatgcccgggatggcttgtggggcacaggttgtgagaggtgcctgggacggcttgtggggcacaggctgtgagggtgcccgggacggcttgtggggcacaggctgtgagaggtgcctgggacggcttgtggggcacaggctgtgaggatgcccgggacggcttgtggggcacaggttgtgaggggtgcccaggacggcttgtggggcacaggctgcaagaggtgcccaggacggcttgtggggcacaggttgtgagaggtgcccgggacggcttgtggggcacaggctgtgagggagcccggcacggcttgcagctacagggagaaaagacttggtgctgtgggcctgccttggggctggtggtacagcccttatctgctgccctcaggatctcccggcccctctcgtccaggcccctgcaaccccatgccccagcctctgaggaccaaaggcgcccctgcttgggaagagggggctcaggggagtcgcctgacccggttccaagccaggctgatttaccgttgctaacatcctatcgcacgcatccctctgcctcatgcacccaaccccaaggcctggtacactgcaggccccaaggtcctgtgcgtcctttcaataccctcctcacctgcctcacctgccccccctaccctgactctggctggagaccccctccagggagttttcaaaacaaagggtgtcagtctcctgtgggattccctcacctctgcagcctgcggtctgaaagctgccccatggtgtgtagtgctaaacttccaacttactccaggccagcggtgacagcccgagggcaggaagggcacccacactgagcctcaaacagctaattttgcaactgtaagtccatataattgtcttgaaaagtaatttgtttcaaaaagctaaaaaacgaatactcttgagtctccttctagtaattccccttctagaggtctatcaccaggaaaagatccaaagcactgatattcttcatggagttgtttataatagaaaaaaactagagcttgttcacaaaggggagctctgcaggctgaagatgttgcacctgtcagcggggatgggggcacgcttgctgacgcagcaacggaaaagcatcagtgtgtgaagatgcattttctctctttctattattattatttttatttttattttttctgaggcagaacctcgctctgtcacccaggctggagtgcagtgatgcgacctcatcacaaccacgagccaccatgtgcggccccatgagcaagccaccacgcccagcctttttttcccttgttttaaaaaatcctctatttaaaaaagatgtgcatgggccgggcacggtggttcacgctcataatcccagctctttcagaggccgaggcaggcagatcacctgaggtcaagagttcgacaccagcctggccaacatggtgaaattccatctgtactaaaaatacaaaaattagccaggccgtggtggtgtgtgcctgtaatcccagctactcaggagactgaagcaggagaatcacttgaacccaggaggcagaggttgcagtgggtcaaaatcatgccaccacactccagtctgggagacagagcaagactccatctcagaaacaaactaacaaacaaaatttttatatctacctataattcgtataaatttaaaatacatgcataaaatcataccctttgcaagcacacgtactaactaaaaggaatatattcagcacatagaaatggttgtctaacggaggaggggggagttaataaacagagaggataaaaagaaataaatcagtagagctggaggagggtctcctccaggctgcgatgagaacatagtgagcagaattgcaggcctgcatgacctcaccttctgtgaggagtccggcctcccaagacgctttcctgcctaggtgcccggctcagagtgtcccctacaaggctactggaggagaaccccagaccgagcctcattcaggtgagggggctgcacaccggaggtgggagaggtctgtcccttcccaccctgtgacactgggtcccactttctctctagggggtctcggtttcctcatttgcaaactggagctcataaggtgggccagagaagtttcagtgaagtgaggaatggatcgtccctctgccagggcccatgtgctctaggtcaccctgtcatcacagggacagggaggtcaaggacagtcactcctgaggccagtccgggctgggctgaccacgtggactctcatgcccagattggggccccaatctccctgaagctggggctccagctgtgactcaggggtgggcagaaggggagacagaagcgataggttcctcagcccccagtcccacctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagccgcccaccctgccgccatgtctctgaccaagacttaggggaccatcattgtgtccatgtgggccaagatctccacgcaggccgacaccatcggcaccgagactctggagaggtgagtgtcagatgggactgccagagggactgggtgggaggccaggtatgtgagtggggacagtggggagcgggcagtggggaggggaccgtggggaggggacagtgagtaggagacagtggggagaggacagtggagaggggacagtgaggaggggaccatgggaaggggaccgtggagtggggacagtgaggaggggaccatagggaggggacagtggggaggggacagtgaggaggggaccgtggggaggggacagtgaggaggggaccgtggggaggagacagtgaggaggggaccgtagggaggggacagtgaggaggggaccgtggggaggggacagtgaggaggggaccgtggggaggggacagtgaggaggggaccgtgggaaggagacagtgaggaggggaccttggggaggggacagtgaggaggggaccatggggaggggacagtgaggaggggacaatggagaggggacagtgaggaggggactgtggggagaggacagtgaggaggggaccatggggagggcacagtggggaggggagagtgaggaagggacagtgaggaggggactgtggggaggggacagtggagacagatagccttccctctcagtgaggagggcagggtaaggagggaacgattaggagttgcacaaccatctgggctcgctgagacctgggcaggcacaggcccaggttctgacaagcagagggtgaaaggtttcgttctaggcctgaagggccttacagggcagccagggcactacagcctctaaagtcccagcatctgggatcagggcactgtcccagcttcaaattcccagcatctgatcccctgggaggggccagggagcttttccttccctggaacgctgctgggaggtcatgagcctgcagaaggggtggcgggcaacccagtctggggctgggagggaggtcctgtggccagaggagacggtggaggggctgggggcaccaggcgtgctggaggcggagggcgggagatttggggaccaggctgcacagaacccgtcggaagcagggcgatcagccgggagctgcagaggcctggggggcctctagcccagggcagcctgggaggggcagctgcctgggcacccgggccccgcgaggaggggctggggcctgctgcggggtcgcagatgtgtcccggtgctcggagagggccgcagggcgcgtgggccgtggcgggaggccgcgctgctgggagctcacggcccccgccccccgtcccaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaaggtgcgcggggcgcggtgcgggcggggcggggcggggccgcggggcgggcggggccgcggggcggggtcgcggggcggggcggggtggggtcgcggggcggggcggggtcgcggggcggggcggggcggggcggggcgggcggggcggccggggcccggcggggcggggcggggcggggaggggctgggcggggcggggcgcggggcggggcgggccgggccggggcggggtcgcggggcggggtcgcggggcggggcgcggggcggggcggggcggggtggggtcgcggggcggggcccgggctaggccccgcccccgcactgagccgcccccgcccccagctcctgtcccactgcctgctggtcaccctggccgcgcgcttccccgccgacttcacggccgaggcccacgccgcctgggccaagttcctatcggtcgtatcctctgtcctgaccgagaagtaccgctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagctgcggcccgggtggagcggagcagtcccgggccggcccgcggcgtctcctggggtccttgagtcggacgggcgtttgtgcgtctcccggcttcccatatcgcacaaagattgtcacttcactaagcgtattggaagcgtgtcggggctcagggaacttttccacaaagcctgacgtccgaatcccgggactctggcagctacgggggtccctgaggccggtccctccccgactcctaagagagtagggggtttcctgcccggtgttctctctccggttcctcccatgtgctccctcctggcagagcagtaactttacccgaggggagtaaacagatgcccctaaagtctgcagtaaaggtgcccacgcgcaacggcgtgggtcaatgccagaaaccctgggatcccggaggtcgaggcctccacacagacgggaacccgggctggttacgttccccggcgcaggccgagggtccccgcgttcccgccgcgctcgggccgataaggacgggcggggtgcccggaggctctataaggaggccagggcggcgggcgcggcccccagagcacgtcaggcggcgccatgctcagcgcccaggagcgcgcccaaatcgcgcaggtctgggacctgattgcgggccacgaggcgcaattcggggcggagctgctgctcaggtcggtagaggcggggtctccgggagctcagggaggtggagatgagggttttgggcgcgtgggccgccaacgccatccaaggtccttcgggtgcggatccccgggctctgggcggtgtgggcgctagtgaagccccacgcagccgccctcctccccggtcactgacctggtcctgcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccggtgaggcctttccggccggggcaatggtgcagcgcgcagccggggtgggggggctctgggggtccctagcggggcagaccccgtctcaccggccccttctcctgcagctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaaccatctgcccctgcctgtgtggtctttggggagctagcaaagcgaggtcactattgttggccagtgaagctcagggacctaaaaggagcctcctagaactctcaaatgcgccccacccccggaggtttgtcctcccatggcgaggagtgcgatggggcagagggagcactgtgatgtggcgggggtagggagggtggccttcgacttcaacccttgaatcgggcttccaaccatactgttcgcaaagcacttccccattcacgcatttattcattcattctccctccatccccacttcctgctgggacctgtagatgctaatcctggccctttttgcagagagatgcagaaactgaggtcccagagccaaatgtgcaacctaattcgttggcccagagcagagggctccgcagacctgttcctttccccttccttcccccatggacacttcctcagtggcaaacctgcgctagcctggttagccctccctgtgaccctgcagccctggggatgaggtcgggaggaagtcctcagtggccacaatttggcagacagagcaggtttagtcttccagcctgctcaatgacaagctgtgcgaccctgggcgtgtcccagagctctcaggcctttacctatcgaatagaaaaacaacgtccaactcacgagatttttgaaataatttttgaaatcataacacagggtgggtgcctgcagggtcgttgccaccccacccctccacccagccccagctgccgtgtctcaatctctgcaggtgcccaggccaaggcactcccttccccaggttccctcttctccctccccaggactgggaagggaatcttagggctccaccccaggcttttcagacaaagaataggggctgaggaaagagtgggaccttggaggtctccaaaccctgaatagggttggctctgggttggccatcctgggtctgtgtggggagcactggaccaggcctggcacccaggtctgacctggcagtcagcaacgaggtctgaagagagctgctggaagtggagccctgactgtgagtcggccaaactccccccagcagtcagtgccagtgacctgttgccctgcactgcctgggaccccagcccggtagtttggagaacttggccccacgttatctacatcccccaactgtttttttgtttttgggggttttttttttttttgctttgtttttgtttttgagataggcccttgctctgacaccccggctggagtgcagtggcacagttttggctcactgcagcctcaacctcctgggttcaagcgattctcctgcctctgtctcccgtgtagctgggattacaggcatgggccgccattcctggctaatttttgtatttttaatagagacacagtttcaccatgttgatcaggctggtctcaaactcctgacctcaagtgatctgccctcctcggtctcccaaagtgctgggatgacaggcgtgagccaccacacccagcccccgcaactgtttacatggataattaacagctttttgtcccaggcagagtttggtgtgaaagcagcttatgtttcactttggaaaaactgtgctcttctccccatccaggaagctgcctgggtctgggccatatgtggataccttatgggtataagctgctcaggaccctgtgtggaagctcaggacaatgccagcgggaaggctaccatgtggagagctggtctctgtttgggcaggactaagagacgcagggcagccttgggcaacctgtctactctcactcactcctcctcccctttcctgtgccaggcacctcctggcaacttgccagccaatgaccctgcatcccaggcataagagctcctactctcccccacctttcacttttgagcttacacagactcagaaataagctgccgtggtgctgtctcctgaggacaaggctaacaccaaggcggtctgggagaaagttggcaaccacactgctggctatgccacggaggccctggagaggcaagaaccctcctctccctgctcacaccttgggtccaacgcccactccagggctccactggccacccctaactattcttaccctggacccagcccccagcccctcactctttgcttccccctgaagcatgttcctgaccttcctctcacttggccctgagttatggctcagcccagatcaagaaacaatgcaagtaggtggccgacacgctgaccaatgccgtggtccacttagatgacatgcccaatgatgtgtctgagctgaggaagctgcatgtccacgagctgtgggtggacccaggcaacatcagggagagctttgggctgggaggaatctagggtgtgggggcagctggccttcctcataggacagaccctcccacgcgttcagggaggtggagcacaggtggcagtagtatctgcatcccctgactctctctccacagttcctgggtaaatgcctgctggtgacctaggcctgccacacccttcccagtttacccatgtggtgcctccatggacaaattatttgcttttgtgagtgctgtgttgacctaaaaacaccattaagctagagcattggtggtcatgccccctgcctgctgggcctcccaccaggccctcctcccctccctgccccagcacttcctgatctttgaatgaagtccgagtaggcagcagcctgtgtgtgcctgggttctctctgtcccggaatgtgccaacagtggaggtgtttacctgtctcagaccaaggacctctctgcagctgcatggggctggggagggagaactgcagggagtatgggaggggaagctgaggtgggcctgctcaagagaaggtgctgaaccatcccctgtcctgagaggtgccaggcctgcaggcagtggctcagaagctggggaggagagaggcatccagggttctactcagggagtcccagcatcgccaccctcctttgaaatctccctggttgaacccagttaacatacgctctccatcaaaacaaaacgaaacaaaacaaactagcaaaataggctgtccccaatgcaagtgcaggtgccagaacatttctctcattctcaccccttcctgccagagggtaggtggctggagtgagggtgctggccctactcacacttcctgtgtcatggtgaccctctgagagcagcccagtcagtggggaaggaggaaggggctgggatgctcacagccggcagcccacacctggggagactcttcagcagagcaccttgcggccttactcctgcacgtctcctgcagtttgtaaggtgcattcagaactcactgtgtgcccagccctgagctcccagctaattgccccacccagggcctctgggacctcctggtgcttctgcttcctgtgctgccagcaacttctggaaacgtccctgtccccggtgctgaagtcctggaatccatgctgggaagttgcacagcccatctggctctcagccagcctaggaacacgagcagcacttccagcccagcccctgccccacagcaagcctccccctccacactcacagtactgaattgagctttgggtagggtggagaggaccctgtcaccgcttttcttctggacatggacctctctgaattgttggggagttccctccccctctccaccacccactcttcctgtgcctcacagcccagagcattgttatttcaacagaaacactttaaaaaataaactaaaatccgacaggcacggtggctcacacctgtaatcccagtactttgggaggctgaggcgagaggatcacctgaggtcgggagtttgagaccagcctgaccaatatggagaaaccccagttatactaaaaatacaaaattagctgggtgtggtggcgcatgcctgtaatcctagctactaggaaggctgaggcaggagaatcgcttgaacccgggaggtggaggttgaggtgagctgagatcacgccattgcactccagcctgggcaacaagagcaaaactccgtctcaaaaaataaataaataaataaataaataaactaaaatctatccatgctttcacacacacacacacacacacacacacacacccttttttgtgttacttaaagtaggagagtgtctctctttcctgtctcctcacacccacccccagaagagaccaaaatgaagggtttggaactcagcccatgggccccatcccatgctgagggaacacagctacatctacaactactgccacaggctctctttttggacaaaaataccatcatactgtagatacctgtgtacaacttcctattctcagtgaagtgtctcccctgcatccctttcagccagttcattcagctctgcgccattccacagtctcactgattattactatgtttccatcatgatccccccaaaaaatcatgactttatttttttatttttattattattatttttttttttttttttgtgacggagtctcgctctgtcacccaggctggagtgcagtggcacaatctcggctcactgcaagctccacctcgcaggttcacgccattctcctccctcagcctcccgagtagctgagtagctgggactacaggcgccccccactacgcctggctaattttttctatttttaatagagacagagtttcactgcattagcgaggatggtctcgatctcctgacctcgcatctgcccgcctcagcctcccaatgtgctgggattacaggcgtgagccaccgcgcccggccttatgtatttatttttttgagacagagtctcgctgtgtcgtcaggctagagtgctgtggcacgatctcggctcactgcaacctccaactccctggttcaaaggattctccagcctccacctcccgagtagctgggattacaggcgtgcaccaccacacccagctaatttttgtatttttagtagagacggggtttctccatgttggtcagcctggtctcgaactcccgacctcagctgatccacccgccttggcctcccaaagtgctgggattacaggcgtgagccaccgagcctggccaaaccatcacttttcatgagcagggatgcacccactggcactcctgcacctcccaccctccccctcgccaagtccaccccttccttcctcaccccacatcccctcacctacattctgcaaccacaggggccttctctcccctgtcctttccctacccagagccaagtttgtttatctgtttacaaccagtatttacctagcaagtcttccatcagatagcatttggagagctgggggtgtcacagtgaaccacgacctctaggccagtgggagagtcagtcacacaaactgtgagtccatgacttggggcttagccagcacccaccaccccacgcgccaccccacaaccccgggtagaggagtctgaatctggagccgcccccagcccagccccgtgctttttgcgtcctggtgtttgttccttcccggtgcctgtcactcaagcacactagtgactatcgccagagggaaagggagctgcaggaagcgaggctggagagcaggaggggctctgcgcagaaattcttttgagttcctatgggccagggcgtccgggtgcgcgcattcctctccgccccaggattgggcgaagccctccggctcgcactcgctcgcccgtgtgttccccgatcccgctggagtcgatgcgcgtccagcgcgtgccaggccggggcgggggtgcgggctgactttctccctcgctagggacgctccggcgcccgaaaggaaagggtggcgctgcgctccggggtgcacgagccgacagcgcccgaccccaacgggccggccccgccagcgccgctaccgccctgcccccgggcgagcgggatgggcgggagtggagtggcgggtggagggtggagacgtcctggcccccgccccgcgtgcacccccaggggaggccgagcccgccgcccggccccgcgcaggccccgcccgggactcccctgcggtccaggccgcgccccgggctccgcgccagccaatgagcgccgcccggccgggcgtgcccccgcgccccaagcataaaccctggcgcgctcgcgggccggcactcttctggtccccacagactcagagagaacccaccatggtgctgtctcctgccgacaagaccaacgtcaaggccgcctggggtaaggtcggcgcgcacgctggcgagtatggtgcggaggccctggagaggtgaggctccctcccctgctccgacccgggctcctcgcccgcccggacccacaggccaccctcaaccgtcctggccccggacccaaaccccacccctcactctgcttctccccgcaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaaggtgagcggcgggccgggagcgatctgggtcgaggggcgagatggcgccttcctctcagggcagaggatcacgcgggttgcgggaggtgtagcgcaggcggcggctgcgggcctgggccgcactgaccctcttctctgcacagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcagcagcctgtgtgtgcctgggttctctctatcccggaatgtgccaacaatggaggtgtttacctgtctcagaccaaggacctctctgcagctgcatggggctggggagggagaactgcagggagtatgggaggggaagctgaggtgggcctgctcaagagaaggtgctgaaccatcccctgtcctgagaggtgccaggcctgcaggcagtggctcagaagctggggaggagagaggcatccagggttctactcagggagtcccagcatcgccaccctcctttgaaatctccctggttgaacccagttaacatacgctctccatcaaaacaaaacgaaacaaaacaaactagcaaaataggctgtccccagtgcaagtgcaggtgccagaacatttctctcattcccaccccttcctgccagagggtaggtggctggagtgagggtgctggccctactcacacttcctgtgtcacggtgaccctctgagagcagcccagtcagtggggaaggaggaaggggctgggatgctcacagccggcagcccacacctggggagactcttcagcagagcaccttgcggccttactcctgcacgtctcctgcagtttgtaaggtgcattcagaactcactgtgtgcccagccctgagctcccagctaattgccccacccagggcctctgggacctcctggtcttctgcttcctgtgctgccagcaacttctggaaacgtccctgtccccggtgctgaagtcctggaatccatgctgggaagttgcacagcccatctggctctcagccagcctaggaacatgagcagcacttccaacccagtccctgccccacagcaagcctccccctccacactcacagtactggattgagctttggggagggtggagaggaccctgtcactgctttccttctggacatggacctctctgaattgttggggagttccctcccctctccaccacccgctcttcctgcgcctcacagcccagagcattgttatttcagcagaaacactttaaaaaataaactaaaatccgacaggcacggtggctcacgcctgtaatcccagcactttgggaggccgaggtgggaggatcacctgaggtcgggagtttgagaccaccctgatcaacatgtagaaaccccatctatactaaaaatacaaaatcagccgggcatggtggcccatgcctgtaaacccacctactccggaggctgaggcaggagaatcattttaaccaaggaggcagaggttgcagtgagctaagatcacaccattgcactccagcctggaaaacaacagcgaaactccgcctcaaaaaaaaaaaagcccccacatcttatcttttttttttccttcaggctgtgggcagagtcagaagagggtggcagacagggaggggaaatgagaagatccaacgggggaagcattgctaagctggtcggagctacttccttctctgcccaaggcagcttaccctggcttgctcctggacacccagggcagggcctgagtaagggcctggggagacagggcagggagcaggctgaagggtgctgacctgatgcactcctcaaagcaagatcttctgccagacccccaggaaatgacttatcagtgatttctcaggctgttttctcctcagtaccatccccccaaaaaacatcacttttcatgcacagggatgcacccactggcactcctgcacctcccacccttccccagaagtccaccccttccttcctcaccctgcaggagctggccagcctcatcaccccaacatctccccacctccattctccaaccacagggcccttgtctcctctgtcctttcccctccccgagccaagcctcctccctcctccacctcctccacctaatacatatccttaagtctcacctcctccaggaagccctcagactaaccctggtcaccttgaatgcctcgtccacacctccagacttcctcagggcctgtgatgaggtctgcacctctgtgtgtacttgtgtgatggttagaggactgcctacctcccagaggaggttgaatgctccagccggttccagctattgctttgtttacctgtttaaccagtatttacctagcaagtcttccatcagatagcatttggagagctgggggtgtcacagtgaaccacgacctctaggccagtgggagagtcagtcacacaaactgtgagtccatgacttggggcttagccagcacccaccaccccacgcgccaccccacaaccccgggtagaggagtctgaatctggagccgcccccagcccagccccgtgctttttgcgtcctggtgtttattccttcccggtgcctgtcactcaagcacactagtgactatcgccagagggaaagggagctgcaggaagcgaggctggagagcaggaggggctctgcgcagaaattcttttgagttcctatgggccagggcgtccgggtgcgcgcattcctctccgccccaggattgggcgaagcctcccggctcgcactcgctcgcccgtgtgttccccgatcccgctggagtcgatgcgcgtccagcgcgtgccaggccggggcgggggtgcgggctgactttctccctcgctagggacgctccggcgcccgaaaggaaagggtggcgctgcgctccggggtgcacgagccgacagcgcccgaccccaacgggccggccccgccagcgccgctaccgccctgcccccgggcgagcgggatgggcgggagtggagtggcgggtggagggtggagacgtcctggcccccgccccgcgtgcacccccaggggaggccgagcccgccgcccggccccgcgcaggccccgcccgggactcccctgcggtccaggccgcgccccgggctccgcgccagccaatgagcgccgcccggccgggcgtgcccccgcgccccaagcataaaccctggcgcgctcgcggcccggcactcttctggtccccacagactcagagagaacccaccatggtgctgtctcctgccgacaagaccaacgtcaaggccgcctggggtaaggtcggcgcgcacgctggcgagtatggtgcggaggccctggagaggtgaggctccctcccctgctccgacccgggctcctcgcccgcccggacccacaggccaccctcaaccgtcctggccccggacccaaaccccacccctcactctgcttctccccgcaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaaggtgagcggcgggccgggagcgatctgggtcgaggggcgagatggcgccttcctcgcagggcagaggatcacgcgggttgcgggaggtgtagcgcaggcggcggctgcgggcctgggccctcggccccactgaccctcttctctgcacagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggcagcctgtgtgtgcctgagttttttccctcagcaaacgtgccaggcatgggcgtggacagcagctgggacacacatggctagaacctctctgcagctggatagggtaggaaaaggcaggggcgggaggaggggatggaggagggaaagtggagccaccgcgaagtccagctggaaaaacgctggaccctagagtgctttgaggatgcatttgctctttcccgagttttattcccagacttttcagattcaatgcaggtttgctgaaataatgaatttatccatctttacgtttctgggcactcttgtgccaagaactggctggctttctgcctgggacgtcactggtttcccagaggtcctcccacatatgggtggtgggtaggtcagagaagtcccactccagcatggctgcattgatcccccatcgttcccactagtctccgtaaaacctcccagatacaggcacagtctagatgaaatcaggggtgcggggtgcaactgcaggccccaggcaattcaataggggctctactttcacccccaggtcaccccagaatgctcacacaccagacactgacgccctggggctgtcaagatcaggcgtttgtctctgggcccagctcagggcccagctcagcacccactcagctcccctgaggctggggagcctgtcccattgcgactggagaggagagcggggccacagaggcctggctagaaggtcccttctccctggtgtgtgttttctctctgctgagcaggcttgcagtgcctggggtatcagagggagggttcccggagctggtagccataaagccctggccctcaactgataggaatatcttttattccctgagcccatgaatcacccttggtaaacacctatggcaggccctctgcctgcgtttgtgatgtccttcccgcagcctgtgggtacagtatcaactgtcaggaagacggtgtcttcgttatttcatcaggaagaatggaggtctgacctaaaggtagaaatatgtcaaatgtacagcagagggctggttggagtgcagcgctttttacaattaattgatcagaaccagttataaatttatcatttccttctccactcctgctgcttcagttgactaagcctaagaaaaaattataaaaattggccgggcgcggtggctcacacctgtaattgcagcactttgccaggcttaggcaggtggatcacctgaagtcaggggttcgagaccagcctagccaacatagtgaaaccctgtctctactaaaaagacaaaaattgtccaggtgtgatgactcatgcctgtaaacctggcactttgggaggcggaggttgtagtgagtcaagatcgcgccatcgcactccagcttgggcaacaagagcgaaactctgtctcaaaaaaaaatttaatctaatttaatttaatttaaaaattagcacggtggttgggcacagtggctcacgcctgtaatcccagcactttgggaagccaaggtgggcagatcacaaggtcaggaattcgagaccagcctggccaatatggggaaaccccatctctactaaaaatacaaaaaattagccgggtgtggtggcgcacgcctgtaatcccagctactcgggaggttgaggtaggagaatcacttgaacccaggaggcagaggttgcagtgacccgagatcacaccattgcactctagcctgggcaacaagagcaaaactccatctcaaaaaaaattataaaaattatacatcagtagatgaatgggtaaacaaaatgtggtggtctatacacacaatggaatattatttggccacaaaaagaaatgaagcactgataggatgtagctgcaccctgaaaatatttgacaagtaaaagaagccggacaccaaaggtcacaaactgcatgaccccatctatatgcaatatccgctacagccaaatccatagggaccaaaagcggattagtggctgccggggccagagttactgttaatgagtaccgaggtggcgtttgggatgatgaaaaagttctgacctagatagtggtgatggctgcataacactaagtgttcttaatatcaccaaattttatacctgaaaaatggctacaatggtaatttatgtctattttatcaccttttttaaaacaaaaaagatataaggggtacagcagagtgagtgctgcatatgcatttactattattcttgggttacatcccaggtactcaataaatgttcactgccctgaagaaacacctgctacgagtcaggcacctcacagttgttatccgtttaattctcacaatctgagaagaaactgtcaccctcattttatataataaatgagaaaacagactcgggcaagtgtcacaatagaatcaagaggcagaataaactgacttccaatgccaaatccatgccgaaattcagtgctataataatgtacatggccgggcgcggtggttcacgcctgtaatcccagaactttgggaggctgaggcgggaggatcacctgaggtcgggagtttgagatcagcctaacacggtgaaaccctgtctctactaaaaatacaaaattggcatggtggcatgcacctgtgatcccagttactcgggaggctgaggcaggagaatcgtttgaacccgggaggcggaggttgcagtgagccggaatggcgccactgcactcaccgcacccggccaatttttgtgtttttagtagagactaaataccatatagtgaacacctaagacggggggccttggatccagggcgattcagagggccccggtcggagctgtcggagattgagcgcgcgcggtcccgggatctccgacgaggccctggacccccgggcggcgaagctgcggcgcggcgccccctggaggccgcgggacccctggccggtccgcgcaggcgcagcggggtcgcagggcgcggcgggttccagcgcggggatggcgctgtccgcggaggaccgggcgctggtgcgcgccctgtggaagaagctgggcagcaacgtcggcgtctacacgacagaggccctggaaaggtgcggcaggctgggcgcccccgcccccaggggccctccctccccaagccccccggacgcgcctcacccacgttcctctcgcaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccaggtgagcggctgccgtgctgggcccctgtccccgggagggccccggcggggtgggtgcggggggcgtgcggggcgggtgcaggcgagtgagccttgagcgctcgccgcagctcctgggccactgcctgctggtaaccctcgcccggcactaccccggagacttcagccccgcgctgcaggcgtcgctggacaagttcctgagccacgttatctcggcgctggtttccgagtaccgctgaactgtgggtgggtggccgcgggatccccaggcgaccttccccgtgtttgagtaaagcctctcccaggagcagccttcttgccgtgctctctcgaggtcaggacgcgagaggaaggcgccgcccctccccaaggaaaggcgagggcctggggcacacccccagtgcccagatccaggcgcgcctctttccacctccagcaggtttggggcctcggccatgggggcaccgaactgcgtgcagcctgaccctcccgaatggggtggtaggtgagggccgcgggacgccccgggcggcgggctgcgaggacggccgactctgcccatcccgagggcggctggcttcgccctccccactctgcgccgagcacgcggcccggacccaccgcgagaactccgcacctgcagcgtgaacgcacgcgggcggcgttaagggcccggggctgactcggagcaggttagggaacagcgccccctcccggcgcgagccggtacctgcgcagcacccagccgccgcggctgtggcctggaatcggggacctggggtgccggggggttgtggtgaaggaggtgggaccagccccagcacctagccacgtagctggcgaggtggaccaggaaccgacccagacccctgccgtcacccgacatcactacggagagtgaagcttttttatatttgtccacataaaaccaatcatggtcattgtagaacttccgaaaacaaggcttgctgcaccttcctgtgtatcccaggtccaggaatgggtgcagcacatccttcagctgccgcttgacacgcggcaaactgtgtcatgtgtaaacaagaacaggacatggctgtcatatccaagagcacatgtgtaacacagacatgccacacacacacacacacacacacggggtagaggcaggcctcatccacacccctaacatttgatgcgtagctgttccagtcttctaggcacatgtagagatgcttttcctcagaaatggtattctcaaggtgacactgaggaaaagtggacaggccgggcgcggtggctcacgcctgtaatcccagcactccgggaggccgaggcgggcggatcacgaggtcaggagatcgagaccatcctggctaacactgtgaaaccccgtctctactaaaaatacaaaaaaatagctgggggtggtggcgggcgcctgcattcccagctactcgggaggctgcggcaggagaatggcgtgaaccccggagcggagcctgcagtgagccaagattgcgccactgcactccagcctgggcgacagagtgagactccgtctcagaaaaaataaaaataaaaataaaaattagctgggtgtggtgccgggcgcctgtaatcccaacttcaggaggctgaggcaggaggatggcttgaacccgggaggcggaggttgcggtgagccgagatcacaccattgcactccagcctgagcgacagagcgagactccgtctcaaaaaaaaaaaaaagaggagggggcggggggaagagccagagaaaatatttgctacatgtggcagataaaggttattatctctactacattagatctccgggcggggcatggtggctcacgcctgtaatcccagcactttgggaagcagaggccggtagatcacctgaggtcaggagtttaagaccagcctggccaacatggtgaaaccccgtttctactaaaaatataaaaactaactgggtgtggtggtgcatgcctgtactcccagctactcgggaggctgagacaggagaatcacttgaaccagagtcggaggttggagtgagctgagattgcaccactgcactccagctttgcgacagagcgagactgtctcaaacaaaaaaaaaaaaaaagaaaagaaaaaatctggcccctagcccacccgtgagccccctcttggatccacgttctagtttctatccttggggtagctcgagtcagtctcacctcaatcatcctgtgtgctcccagagcacaggacctgcggctgctgcaacttcgcgcacaggagcaagcacttggagcccaggaggctcaggggccctgaggaagcaccaggctctcagactcctgtaactaggtgtggacaccctcctgggattacatctggagcatcactgaaggtggaagagccagaccgcatcctccctggagatgtggaggttggagggagctggccctggctcaagggctcagcccacttggtacagaacctacccagaggtgcagatccaagggagcagggggagcagctgtgggccctccacactgttggggagactcatgcccactcaagtccaggggaatttgcactctgccttttttttttttttttttttttgagatggagtcttgctctgtcacccaggctggagtgcagtggtgcaatctcaactcgctgcaatctccacctcccgggttcaagcgaatctcctgcctcagcctcctgagtagctgggattacaggtgcctgccacgcctggctcatttttatatttttagtagagacggggtttcaccatgttggccaggatggtctcaatttcttaaccttgtgatccacctgccttggcctcccaaagtgctgggattgcagatgtaagccaccgcgcctggccatactctgccttttcaaagccactcctacacaggtggtggtgaaggctgcacaacaatgtagatacacgtcgtgccactgaactgtacactgaaaaactgttataacggcacgttttgtgtgcactttactataataaaaaatgttccatcctggctgggcgcggtggctcacgcctataatcccagcactttgggaggccgaggcgggcaaatcataaggtcacgagattgagaccatcctggctaacacagtgcaaccccgtctctactaaaaaaaacacacaaaaaattggccgggcgtgatagcgggcgcctgtagtcccagctattcgggaggctgaggcaggagaatggcgtgaaccagggaggcggagcttgcagtgagccgagtttgcgccactgcattctagcctgggtgacaaaagcgagactccgtctcaaaaaaaaaaaaaaaaaagttccatcctggccaacgtggttctggctccaggctgccacccctcccccaaaggatgccaccccagataggggtcctcggcctgctccagcacctgcctgtcccatgacggctgcacactggggtaggaaacggcctccgcatcctcctctcctccccccaggactacccttaacccactcagggcttcggtcaaggcccatgcgctccccaagcccaaggtaaccctgtgcaggaggcaaaggtggtacaaggcacagcccatccagctagtttggcgccgacagcacccaccaaacagagccatttacctttaaaaaaatcactgccagctgtggtgacacacctgtaatcctagtgctttgagaggctgaggtgggaagactgcttgagcccaggagttcccaagaatatcctgagcaacatagtgagacctgtctccacaaaaacataaaaaattagccaagtgtggtagtgcacacctatgtcccagttacttggaggctggggcaggaggatcacttaagtccaggagttcaaggctgcagtaagccatgactacaacactgcactccagcatgggtgacaaagcaagcatcgtctcaaaaaaaataaataaataattttggccaggtgccgtggcttacgcctgtgatcccagcactttgggaggtcaaggcgggtggatcacgaggtcaggagtccaagaccagcctggccaagatggtgaaacgttgtctctactaaaaatacaacaattagccgggcatggtggcgggcccctgtattcccagctagtcgggaggctgaggcagagggtgcagtgagccgagactgcatcaccgcgctctagcctaggagacagagcgagactccgtctcaaaaaaaaaaaaaaaaagtttttttttaatcgccaaatgttctggagaggcccccttctcttctgttctcctgcagtctgggctgcaggccaaggtggtccctgtgggtggagacaagggccggttccacctgacactacagaccccttcacatgggagggatacacttccagacccatatatctccgagtagccatctttggcgagatttactggtactgcagtggaaaggaaggactcgctgtactgggtgaaaaaagtgaaaacatgggactcctatcgcagactctgacagcagaacctggtgtgggttatttgggaggagggagggaggagggagaaaggaagagctgttgtgggtgctatcagcgaaactgcaccgggggcatgaagctcagtttggtcagcaccacctggcaggtgtaccaaaagcccacccgactgtccctgcacggtagagaggcaggagcgcctctccctgcacggatggtgccccggaggctaccaggggcggccgaggacactgatgctgcatcccaggaggacctgtccttcagctgtaatcagcagacacgggggacaggatggccaggggcacagcaccttttctgtaaaccccacaccctgaccccccccacccaaaaaagcaaaaaacaactatttgtctacacatacaattttatgcccagatggaaaaagatccaaatgattcacagtggtgatggctctgagggtgacgctgtctgcttaaggcccagggaaacccaggtgcaaactcacactcatcacccaggcagccacagccatgaacacaacgtgggcttgggaacagggagcccagacccaaccactccctcctagaagacgaagaggaaagcacatgtgctgaacaagtaccctgagtcccacctgcaggaaaaggtgcaggtaaggaatacggacacgggaggaatacggacacggagggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaacagcgacacggggggaataccaacacgggaggaacagcaacacgcagggaatatcgacatgggtgatgcctgcaaagcacagcatcaatcccaagtgactcctgtacagggcggccccttccaccctcctttccttggagacagttggctgggctagacctgtgtcacgggctggcagagcagcccacctacccatctgtcctcctggaggggacagcctgtggcaggagagcccagagcaaggccaccagctacactgtgataccggtggcagaaagacccagaccacagcgcccgtgtgcgcccactgagccagccagctcaagggtggcatgtgtacccctgcagaaacagagcggatgaggatggctatgtgttaacaatgtgaacctcaggaattccctccaaaaaatctcccacgaagtgaaaaagggaaggagctcccatcatctacacattagttagcagttatccttttcagaagggcttcattttgggtttttggggggttttttgagacagagtcttgctgtcgtccaggctggatgcaatctcggttcactgcaacctctggctcccgggttcaaacgattctcctgtctcagcctcccaagtagctgtgattacaggtgtccgccaccacacccagctaatttttgtatattggtagagacagggtttcaccatgttggccaggctggtctcgaactcctgacctcaggttatctgcctcccaaagtgctgggattacaagcgtgagccaccgcgtccccctttactttggtcttaaagtacctgcctgatgtacagcaggtatgttagaaagaactgaaaggtgttggccaggagcggtggnntcacgcctgtaatcctagcactttgggaggccgaggcgggcagatcccgaggtcaggagatcgagaccatcctggctaacaaggtgaaaccccgtttctactaaaaatacaaaaaattagccaggcaaggtggcaggcacctgtagtcccagctactctggaggctgaggcaggagaatggcgtgaacctgggaggcggaagttgcggtgagctgagatcacgccactgcactccagcctgggcgacagagtgagattccgtctcaaaaaaaaaaaaaaaagaacgaactgagaggtgggaaacataatcagcccacatgggacatgagtcaaaccattttttttttttttttttttttttttttttttgagatagggctttcttgtcacccaggctggagtgcagtggcggaatcaaggtttgcctcagtgtcctgtgctcaacagatcctcctgcctcagccttcttagtagtagctgggactacaggcatgtgtcaccatgcccagccccatgggtctttgttttctgctagtaacttcaaaaggggacatgcagtgtaactcacctgagtcccaagttaaggctatggtagcagctgagcagacaagacagcttttcctaaataaatgaatgcagaatggggacccctccctcctccccatgggagatgggcagctcagacactcagaaggttgtgtgggagcgagcaaacaaacacccatgcacacctgggtcccgtcagtcagatgcaggggacaggaagtgccctgccatctactggatgccagaagacaagacgtgacccacgagtaagtcacggtttctgtgaggtgctggtggcactggcacagggtcacagtgaaaagcctctacgcagaggacagcagaaaccccccgcagcctcaggaggcagcatcagatttatttattcctactcaacatgacccgggaacacaggagcaactctgtacacttctagaaactcacagctagctccaaaacaatagaaattttaaactacaaaagatgagttgtattcagcaaatataaagggtaattttagactgtgtgaacgtttatcagactatttacagcacccgggagacgggttcagatctcgccggcctccttctcttctgacctccgtgaagccatcttcccgttggagctctcaagcctccagtccgggggccctcgctcgctccgcccgctctcccaggactcctctctggatgcccgctctctggagaacctgggaaatgggaaccagaggctcagtggaggctgctgccccccttctgctggccgctcaggcactgacgatggacccgcagaccaggccaggcaaggccctacatcccctatacctggaaaccccccggaggccaaccagacttgcccaccacatatggagtgttagatagccattaaaaagtgacctttgcgaagatttttaataaggagagccttcactgtaacataaacagtgcaaaggagaatacaacactatatgcacagaacatgacactacgtaaaaacacaatggaaaaaaaaatatcaaaaacaaaaaccaaaacagaggtaagcagggcctggtcaggacacaagtctcagccactctgagcatggacgcaacagtgcacaggccccaggacgcaggcaggggacagtgcctgtgcagcccatcacctggcgccgtgcgagctcctccacagccctctcgcctcttcccacacctgagtcccgttcacgactccccagccctactcctgagggtgagcccagccccatccccaccagacacggccctcagcagaccctgggaacacagagaagggctcactcctggttgcagctaccgaaggagtcagagtagttacttgtatttcgcacttcggtcccgggaagcccgacgatgtccccggctgtggctccgggaacggctgcggtggcgccgatgtctatctcgggaccgggaccgggacaatttccgtcgctctcgggaggtagatcttgaccgcctccgacgccgatcccgggagcgtgacctgaacaatcagaaggctccaaggctgagactctataggtgccaacactatgagggccccacccctcagcagattctgcttgctgctttactgacattttctcctttactcccacaaatttaggtttaaaatatttccatcagttaatctccaatggctaggtccttccaatgaggtctcctgaaaacatgtggcctggatactcctgtcaccctgcaggccccgaccttccctctcattaacactgggaaccctccacggcaccaagcaacctcttgccctgtgcccttcacaagccagccctacctgccaggtaacatttgtaaaggcataatcattaaatattaagaaaaatgcttatggaaaaaaaaatttgagaacattttaatggacctggaaacctacctcctgcgatctctggttcttgatcccgacctaaaagggggaaaaaaagatgaacaaggccaggcatggtggctcacacctgtaatcccagcacttcggggaggcctaggcaggcaatcacctgaggtcacgagctggagaccagcctggacaacgtggtgaaaccccgtctctactgagaacacaaaacctggccaggcgtggtggcgggtgcctgtaatcccagctactcaggagactgaggcaggaaaatcactttaacctaggaggcagaggttgcagtgagctgagattgtgccactgcactccagcctgggcaacaagaataaaactttgtctcaaaaagaaaaaaaaaaagtgaatgacttcccgaaagcacccctattcctcaccctcttgggggaggactccaaatttaagaagtgaggcacctcccccaaagacctgctgttttcaagctgcctgcatgttcccagtctgaatgggaagtgccaatgctcccatccccacagccactctgtggcacactcagtgtcacctgagcctcacagacaggcccacatccgagcatcagacgcagccctgtaacattacaagggccgtgaaaagtctgtgcacactgactgtgctgcactcaagtcctacaaatgattctccagtctttacaacagacaccagcacagaatgtgcagacagcgagtggggcacaccaaaaacacagaaaaggaaaagcaaagcccgaagttccaggcacaggcttcctgtcaggtgagagtcatcagctcattctgccacacaaccaagaggctgaaaaaggcaagctatgaggcctcattctatgcccgtaagccattaaggtcaagtggccccatgtacatccgcaacacaaatggcctaaacatgacagtgcatgtaaaaatgtaaactccatgcaaaaaatggattgtgtgttttgcttaatattttcttctatactgtttaagtttctctccaatcagaatctcctgctggtaaaacaacaaacggccgggcgtggtggctcacgcttgtaatcccagcactctgggaggctgaggcaggcagatcatgaggtcaacagatcgagaccagcctggccaacatggtgaaaccctgtctctattaaaaatacaaaaattagctgggcgtgatggcacaggcctgtagtcccagctacttgggaggcagaggcaggagactcgcttgaacccagggggtggaggctgcagtgagccgatatcgcaccactgcactccagcctggtgacagagcgagaccctgtctcaaaaacaaacacaataaacattcgccctgagttatgcactgaggaattatttcaggaaaagtggtttgggaaccttcctggacaatgagctgtctccaggaggatgtggatacttctggctcctacctctttgaactccaaacagactcaacagccccacctcaagatggcctctcaagctgagtgtggccagaggcatcttctacttcccacctcctcccactccaatacaccacacccagccttccaacctcaccaagcagcaactccgggccagaaaccaggagaccagcttcatttcctcctctgcacgcttcacacactaccagcaaatcccatcagttctatcccagaactttccccgactccttgcaccccttacctggcttaaactgccacctcctccatctggattttcccacctagctccccaaggtcctgctgcttctactccagcccagcacgcttgccaaaggggagcaggcaccacccctcctgcgtaaacaggtgtccaatggccccatagcactcagtaagtaaacagcagtgcccacacacagcctccaacagcttggatcccttacctgactgccatgcacacacagtcctgcgctgggacgtgttttgttttgttttgttggactgaatatgctgtttactttttttttttttttttttggttgagatggagtctctgttgcccaggctagagtgcagtggcacgatctcggctcactgcaacctctgcctcccgggctcaagtgattctcccacctcagcctccgagtagctaggattacaggctcatgccagcacgcccagctaatttctgtatttttagtagagacaaggtttcaccatgttggccaggctggtctcgaacccctgacctcaagtgttctgcccgcctcagcctcccaaactgacaggattacaggcgtgagccgccaggcctggccttactattttcttttataacggcctattgggcaggccctgcctattccaagcaacagtggaatggaccgagcagggaatgcccgaggccaatgcaggccatccagtgccagccctcaggctcacctcctgctcagacgctcctcccgttccctctcctctctcctcctcaagcgatcctgatttctcttctcctgcttttcagcgacagttttctaaataaatgaaacaaaaaatgaggaagagcaagttacacaaaccagagtgtgaatgctacttaacaaatcacctttatatgagctcagtattggtaatttaaaaattgaagggacacttttaggaaatgggaatacttttttttttctctttgaaacggtgtctcactgtcaccaggctggagtgcagtggcgtgatctcggctcactgcaacttccacctcgagttcaacctattcttctgcctcggcctcccaagtagctgggattacaggcacatgccaccacacccaactaatttttgtatttttagtagagatggggtttcaccatgttggccaggatggtcttgatctcttgaccttgtgacccgcctgcctcagcctcccaaagtgctgggattacaggcatgagccaccgcgcccggccaacacattcatttttaaaacttcttaatgaagaagataacacatgaaaaaatgctttatcattacatttttttttcctgagacagagtccgccctgttgcccagtgcagtggcgcgatctttgctcactgaagcctctgcctcctgggttcaagcgattcttctgcctcagcctcctgagtagctgggattacaagcgtgccagcacggccggctaatttttgtatgtttagtagagacggggtttcaccatgttggtctggcttgtcgcaaactcctaaccttgtgatatgcctgcctcggcctcccaaagtgcagcaattacaggcgtgaggcactgcacccggcctcgtttacatttactttttttttttttttgagacggagtctcgctctgtcacccaggctggagtgcagtggcgcaatctcggctcgccgcaagctccgcctcccgggttcacgccattctcctgtcctggcctccggagtagctgggattacaggcgcccggcactgcgcccggctaattttttgtatttttagtagagacagagtttcaccatgttagccaggatggtctcgatctcctgacctcacgatccgcccgcctcggcctcccacagtgctgggattataggcatgagccaccgcgcttggccacttttttttttttgaaacagggtcttgctctgtccacccaggctggatggagtgcagtggcgcaatcacagctcaccggagccttgacctcccaggctcaagcaagcctctttagctccgcctcctgagtagctgggactataggcgtgtgccaccatggcagactaatctttaaacattttttatggagatggaatcttgctatgttgcccaggctgagcttgaactcctcaactcaagcaatcctcctgccttggcctcccaaagtgctggggttacaggcctgaaccacccagcctatcattagattttaacaatgtggtaacaaactgtctattctaagtggtgctatacttctaactcacagggaattgatcacattgtttcaaaccaacccagataggtaggagactgtacaaactttatggtaaaaaaggacggatgtatctcatcaaacacatcttgctactgggagcagaatccctacagccaaaaagcagcccaacctcagggtgctgggtgctacgctggctttagaacaaactgagttggaggacagcaggccaggggaggtggaccacaaatcctctgcaactggctttcaacacaggatgatgtgaatcatcaggcttgatgaagaaagcaatataaggggatgagaaacctcgccaatgaaaataccgtcaacacaagctgagtggaaaagcaccgggcaccgttctgtatacccactactcccaatatcaactctaagacatttaatgcccctcatctgtgtcaagtgaagccctgagtgggagcaagtcagagccagtaagacaaagaatcacgagtcttctccatccagagagccacgatggcataaggataatcttccatacccagtgtggatgagagcacgctccccacaagggcacggaaagtatgcagagctgggtgactggtatctccagctctaaactttcacccatgctcatcctgtgtctgaagcagggcacacatggatggacacctttaaggtgatgtttaaggatggcatttaagccaggtacggtggctcatgccatttcagcactctgggaggctgaactgggaggatcatgtgaggacaggagtttgagaccagcctgggaaacatagtaagacctcctacctaaaaaaaaaaaatgagccagatatggtggtgcatgcctgtagtctctgctactcaggagactcaggatgcagggccacttgagtccaggagttccaggttacagtgacaataagctatcagctaccatcacatcagtacactccaccctgggtgccagagggagaccctgtctctgaaaaaaaaaacgaaaaaaatcctctgttgtctaggttggagtgtagtgtcgtgatcacagttcactgcagccttgagctccaaggtccaaacaatcctcttacctcagcctcctgagtagctggacctacaggcacacaccaccatgcttggctaatttttaaatttttggtagagacagggtctccttatgttgcccacgctggtctcaaactcctggattcaatcgattctcctgccttggcctcctaaagactggaattacaggcgtgagccaccacacccagcctcaaggatggcagtttttaaaaaaattaaggattagccaggtgcagtggctcatgtgtaatcccagcactctgggaggcctaggaaggtggatacctctgggactactgtgagtgaggcctcctctaactagggcacagaactcccactctccctatcattaagaggtgcacttccaaatacattgtgcactgttactttaataattatttatcaaagtctgtaatacgagttgtgttgttttggtcaactctatgctgcaatgataaaacaagctttctaaccaagttaatgcttcttaaggtagaagggaaaaacatttcacaatattcacatttctaatgcagagatacacattaaggaaataaaagattgcagatattaaaaaaaaaatactacattagggccaagcactgtggcccacgcctgtaatcccagcactttgggaggccgagacaggtggatcacctgagctcaggagttcgagatcagcctgagcaacacggtgaaaccccatctctactaaaaacacaaaaatgagccaggcatggtggtgcacgcctatagtaccagctacttggagggctgaggcaggagtatctcttgaagctgggaggtggaggttacagtgagctgagttcgttacactgcactccagcctgggtgacagagcaagaccctgcctcaaacaaacaaacaaacaaacaaaaaaaacccaacaactacagtaggacaaaattctgagctgtgaaatgaaaatgtaatttaaaggagaaatgggaaagtaacatttccagtggctaacaaacaatttttttttctttaagacaaagtctcactctgttgcccaggctagagtgcagtggctcgatttcggctcactgcaacctctgcctcccgggttcaagcgattctcctgcctcagcctgccaagtagctgagaatacaaatgtgtaccaccatgcccagctaatttttgtgttttcagtagagacagggttttgctatgttggccaggctggtctcgaactcctgacttaagtgatccgccctcctcagcctcccaaagtgctgggattacaggtgtgagccaccatgcctggccaaaagcaaatttttaatagagtggtaaatgcatactaaattgtgatttataattctattggatacagatacttttacatctttttttttttttttttttgagacagagtctcgctctgtcgcccaggctggagtgcagtggtgcaatttcggctcagtgcaagctccgcctcccgggttgacaccattctcctgcctcggcctcccgagtagctgggactacaggtgcccaccaccatgctcggctaatttttgtatttttagtagagacggggtttcaccttgttagccaggatggtctcaatctcctgacccagtgatctgcccgcctcggcctcccaaaatgctgggattacaggaggctgagcctctgcacccagccttttttttttttttttttttttttgagacggagtcttgctctgtctcgtaggctggagtgcagtggcacaatttcagctcactgctacctctgcctcccaggtcaagcaattatcctgcctcagcctcccgagtagccaggattacaggcgcccgctgccatgcctggctaatttttgtatttttagtaaagacggggtttcactatgttggccaggctggtcttcaactcctgacctcgtgatccacctgcctcggcctcccgaagtttgggattacaggcgtgagccaccacacccagcctcacttttacatctttcatacctataaacttataaagaaaaattccaactttgacagagtacattgcttttcaaaattctctcgggaacacggaagtaaaatgtttcaagaccagtggccgagaataacctcactgctgcaccagctcccatcacagtcccaggttcacaccatcacctatgggaccctcctgaggtgcacagccctgccatatgcggcctgagtgagcagctctttcctggggcacaaaaggccctcagccgtggtcactgcagcattctgcagtcagcgacacgtctgtccctccactacatttcaggtatacagggggaggctggctaatttcccaccatcctatcctgaggtcctagtatgcggtaaggggggctccatcagtgtgaagggagacaattcaaagtagtggaaatacgtccaaccttccttcttagcattccgtacttaaagtttttaaatgtcggccgggtgcggtggctcacgcctgtggtcccagcactttgggaggctgaggcgggcggatcgcgaggtcaggagatcgagaccatcctggcaaacacgatgaagccccgtctctactaaaaatacaacaacaacaacaaaaattagccgggcgtggtggcaggcacctgtagtcccagctactgtggaggctgaggcaggaaaatggtgtgaacctgggaggcggagcttgcagtaagccgagattgggccactgcactccagcctgggcgacagagcgagactccatctcaaaaaaaaaaaaaaaaaaaaaaaaaaaagtttttaaatgtcttagagtcttgaagaaggaacagaggttttctctgggctgggatggtacaatgctaccagaaaaaccccatcttcaccccgcccttctgaggtggctcataggcaaggagccaggatgtgtgacactctgtcttgaccaaccagagattctttctcatctcctaacagaagttatttcagagatacacaacgagctgtatgtattctgggaacaggctctgccattttcttcccttaacgacagggtccaaaataaatctccaaggctcctttggactctgagctatcatgtctcttgtgtgaatccaagtgatgaaatctgcgtatttcactataaaactcaagttcttagagatcagaacataatgttttttgttttttttttgagatggagtcttactctatagcccaggctggaatgcaatggcatgatctcggctcactgcaacctctgcctcctgggtttaagcaattcttctgccccagcctcccgagtacctaagattacaggctcacaccaacacacctggctaatttttcggtagagacggggtttcaccatgttggtcaggctggtctcgaactcctgacctcaggtgattcgcccacctcggcctcccaaagtgctgggattataggcatcagccaccacgcccggccaaaacataaggtttttaaaaattaaagaaatgtgaaaacaccccaagactcctcagctttctccagaaacagatgaacataccctcaactgatcaagcttctctcggatctgaatgaaccccaagtgtaacttgccaccgaagtggtctgccaggcgacggtcattgtcatggagaccaaggtaggctgaacagacctcgcagacacgcagcttttgctgctgaaaactggatgcaggcatggaatttctgtattcttcctgaagaaggaaaatggagaaataaaagtgaggtatatagaactgccaccacaaattcaatctccaaaatgaaaatatttgataagatgacagaggtgacttttaaacaaatattaaaaaaacacaaacaaaacttcagatatttataaccaactcaattttcactgtttatttaagaaacgcggccaggcacggtcccagcactttgtgaggccaggtgggcggaccatgtggtcaagagatcaagaccaggccaggcgcggtggctcacgcctgtaatcccagcactttgggaggctgaggctggcggatcacctgaggtccggagttcaagatcagcctgaccaacatggagaaaccccatctctattaaaaatacaaaagtagccgggtgtggtggcgcatgcctgtaatcccagctattctggaggctgaggcaggagaatggcttgaactcgggaggcggaggttgctgttgagctgagatcgcacaggcaacaagagcaaaaccctgtctcaaaaaaaaaaaaaaaaaaaaaaagagagatcgagaccatcctggccaactttgtgaaaccccgtctctactaaaaatacaaaaatcagctgggtgtggtggcacatgcctgtagtcccagctactcaggaggctgaggcaggagaatcacttgaacctgggaagcggaggttgcagtgagccaaaaccgtgccactgcattccagcctggcaacagagcgagactccatcttaaaaaaaaaaggtactaacaggctgggctcagtggctcacgcctgtaatcccagcattccgaggccaaggcagacagatcacttgaggccaggagttcaagacgagcctggcaacatagcaaaaccctgtctctactaaaaatacaaaaattggccgggcgcggtggctcacgcctgtaatcccagcactttgggaggctgaggcaggcgaatcatggggtcaggagatcacgaccatcctggctaacacggtgaaaccccgtctctactaaaaaaacagaaaaaattagctgggcgtggtggcgggcgcctgtagtcccagctactcaggaggctgaggcaggagaatggcgtgaacccggcaggcggagcttgtagtgagccaagatcatgccactgggcgaaagagcgagactccgtctcaaaagaaaaaaaaaaaaaaaaagccagatggtggcaggcatctgtaattccagctactggagaggctgaggcacaaattgtttaagcccaggaggtggaggttgcagtgagctgagatcacaccactgcattccaacctggaggacagaggaaaactccaaaaaggaaaaaaaaaaaattgtattccaggcctggtgtagtgactcacacctataatctcagcactttaggagagtgaagcaagaagatcacttggccccaggagattgagatcaccctgagcaacacagcaagactcagtctctaaaaataagaaaataattagcccgctgtggtggcacgtgcctatagtcccacctactcaagagactgattcgagaggactgcttgagcccaggaggttgaaggggcagtgacctgtgactgcgccactgtacttcagcctgggtgaccctggctgacagcaggaccctctaatattaaaaaaaataggctgggcacagtggctaacacctgcaatcccagcactttgggaggccaaggcaggtggatcacaaggtcaggagtccgagaaggtgaaaccccgtctctattaaaaatacaaaaaaattagctgggcacggtggctggcacctgtaatcccagctactcgggaggctgagtctgagaattacttgaacccgggagtcagaggatgcagtgagccgagatcgcaccacagcaatccagcctgggcgacagagcgagactctgtctgagaaaaaaaaaaaaaaaaaagtagacaaggaactagcaagaacttgaatttccattatagtatgctacataactaaaaaaaaaaaaaaaaaaaaaaaacttaagcaaaaacaatattgtggtacacaaatattcataacattactctgtccccttctatagttttgaaaccttaaatgccaccttctaacatctttcaaaataaactctgattatgttgagtaaaaaaagtcagtcccaaaaggttacctactgtatgattccatttacataactttttttttttttttgagacggagtctcgctctgtcgcccagcctggaatgcagtggcacgatctcagctcactacaagctctgcctcccgggtccacaccattcacctgcctcagcctcctgagtagctgggactacaagcgcacgccgccacgcccggccaattttttgtatttttagtagagacggagtatcaccatgttagccaggatggtctcgatctcctgacctcgtgatccacccgcctcagcctcccaaagtgatgggattacaggcgtgagccaccgcaccaggcttttttttttttttttttttttttgagagagagtcttgctctgtcacccatattggagtgcaatggcacgatctctgttcgctgcaacctccgccttctgggttcaagcgattctcctacttcagcctcccaagtagctgggattacaggtgcccgccaccacacctggctaatttttatacttttagtagaaatggggtttcaccaagttggccaggctggtctcgaactcctgacctcaggtgatgcacctaccttggcctcccaaagtgctgggattacaggcatgagcaaccgtgcccggccatatttttaatttctttgtaaagatggggtatccctatgttgcccaggctggtctcaaactcctggactcaagcaatcctcctgcctcgaccttccaaagtgttgagattacaggcatgagccaccatacccaccctccataagcttttacgctgggcagaaggcagcaaaaggggagtcagcatatcacatggcaaaagaaggagtgagacagagagaaggacctaggctcctttaaacaatcagctctgaggtgaactcactatcccagggagggcaccaagccattgatgagtgaaccacccccatgacccaaacacctcccactagaccccacctccaacattggaggtcacatttcaacatgagatttggacgtgccacacatccaaaccgtatcaagtgttattttttatcttttatactgtatttttactgtaccttttctatgtttacgtacacaaatatttaggggcccactgtgttgcaactgcctatagtattcagcacagtaacatgctgtacaggtgtggagcctaggagcaatgggctctaccatacagcccacatggctataccacccaggtttgttaagcacactctataatgttctcacaatgatgaaccatggaacgcacttctcagaatatttaatccttgtcattaagaaagatatgactgtactaatatcagaaatgaaagacaggacatcattacggatccacccactttaaaggaataatacaaacaactcttaaaaacaacaactccatgcccacaaaagcgataaactagatgaaatggaccgatcccttcaaagacagccaggagcagtggctcacgcctgtaatcccagcactgtgggaggctgaggcaggtggatcacttgaggtcaggagtttgagaccagcctgaccgacatggtgaaaccccgtcttctctactaaaaatacaaaaattagctgggcatggtggcaggcacctgtaatctcagctgctcaggaggctgaggcaggataatcagttgaacccaggagttggaggttgcagcgagccatcgcaccaccgcactccagcctgggcaacagagagagactccgtgtaaaaaaaaagtataataatgttgaaagacacaatctgccaaaactcacacaagaagaaacagatgatctgaatgaatctgtatattaataaccttccaaaacagaaagcatcaggtccagatgggtttactggtgaattctaccaaagcattagggagcaaatcatgccaattctctacaatcgctttcagaaaatagaagcagagagagtatcttctaactccttctatggggacattaccataataccaaaaccagataaaggtattacaagaggccaggcatcatggtgactcatgactctaatcccagcactttgggaagcagagctaggcagatcgcttgagccaaggatttcaagaccagccttgacaacatggcgaaacccagtctctccaaaaaatacaaaaaattagctgggcttggtggcatgtgccttcagtcctagctatttgaaaggctgaggcgggagaatcaaatgagcccaggagatcaagccttcagtgagccaagatcgcgccactgcactccagcctgggtgagaaagtgagaccgtctcagggcggggggcggggtggaggtggggagggctgggcgcggtggctcacacctgtaatcccagcactttgagaggccaaggcaggcggatcatgaggtcaggagatagaggccatcctggctaacacggttaaatcatatctctactaaaaacacaaaaaattagccaggtatggtggcacacgcctatagtctcagctactcgggaggctgaggcaggagaatcgcttgagcccgggaggcggaggttgcagtgagccgagatcacgccactgcactccagcctgggcgaatgaatgagactccatctcaaaaaaacacaaaaacaaaaaccaaaaaacaaatgaccaattacaccagcacccgcaagcatgaaatatttaggtagaaatctaacaaaacatgcatgagatcttcactatgagaaaaattacaagactcataaaaggtatcaaatggcctggcgaagtggctcacgcctgtgatcccagcactttgggaggccaaggcagacggatcacctgaggtcagaagtttgagaccagcttggccaacacggtgaaaccccatccctactagaaatgaaaaaaaaaaaaaaaaattagccatgggccgagcatggtggctcactcctgtaatcccagcagtttgggagaccgaggcgggtggaccacgaggtcagattgagaccatcctggctaacacagtgaaaccccatctctactgaaagtacaaaaaaattagccgggcgtggtggtgggcgcctgtagtctcagctactctggaggctgaggcaggagaatggtgtgaaccgaggaagcggagcttgcagtgaactgagatcgcaccactgcactccagcctgggggacagagcgagactccatctcaaaaaaaaaaaaaagagagaaaattataaggaagagaaaataaaatacatttatagtactgtgctgtactgatcacttctgtacgtttacactgctcatttacaagatgaattgtccgtctgaaatggtagcaactgcagctgcagacctcaatctaatgtatacatcaagcaactcaactttttcttgtaatatcatggctgttcttgccttcttgggagcattttcagcatcactagtggcatatggatcctatggcattactcaaagtttatggtattgcactaaacacgatgaaaaacgcctaggaaccctgtgagttcactttttactgcagtaggaatgtactggagaggtgaactgctccttcggagatgatgagtgtcacgtggtgtttcaaggggatactcacgacccttgagctccacacaatggcaacaggaagtggcatgaattattacagtagtacagtacctattacagttattcttaggcagccctgatttaatactgcacctctgcactacgtttgttaacatctctctacggcgaatgctgtcatgtatggtctgtaagcgtttgcatgtagcctcttcttttttagagacagggtcttgctatgttatccaggctggactccaaaagtcctaggattaagggatcctctcatctcagcctcccgaacagctgagactaaagccaagagccaccatagctggccatatgcttaagttttgacaaatgttaccttttcataatagacttgtgtatattttatggcagtaaataaaagactagtatcctcatatattttatgtattcatgacatacctaacattttctgcagactttgggtgataatgacaagtcaacgtagacccactgactgtgggcagatgctaggaatggaggaggctgtctgaggagagggtacatggagaatctctgtactttcctctcaatttagctatgaagctaaaactgcttgcaaaaacagcgtttataaatttttttgagacagagtctcgctctgtcgcccaggctggagtgcagtggcgcaatctcagctcactgcaagctccgcctcccgggttcacgccattctccttcctcagcctccggagcagctgggactacaggtgcctggcgccatgcccggctaatttttttgtatttttagtagagacggggattcgctgtgttagccaggatggtcttatctcctgacctcgtgatccgcccgcctcggccttccaaagtgctgggatgacaggcgtgagccactgtgctgggcccaaaatgtataaattttttaaaaaatgggagcaagcatgggctcaattaattccaacggtcaacgctgccaaattactaagatttctcttgccctaaggcacttatctcaccaacctcagcttcttttttcttcgcacgaactttttccacttccataagaatcttctgggattcatccacattaccttcagcccctagctgttcggctttagcaaggagttttcctatttcttcatttaactcatgtactttttctgcctgtgaggagaaagaatgaggtaagcagacatctgaaaatgaaagtgaatgcaaaggcaacaagggtttctcctgctccatttccagtctgaaaataagtggaagagctaaagatccacacttaacaatgaaggcatccttactgccagcattgagactgtaaccataaacgagtcctatgttccaatgaaaccagtggcacctttgtcacttccgacatgcttccaaggatcatcacagattggtcattgtctaggctgtctctctttatgactttttcttctgggtatggtaataaaatgcctaggtttaaatgtacagatttaagctgtaaccaaaatacctaattactaggatttaccttctgaaacaaaatagcaccgttggtcaaattagcaattgcataaatcctaagaaatgcttttacaacactgaaaagaaaaaacaaggagaggcttagttccactgaagagaaaaacagaagagtgatgtaaatggcactcagtctaattacatataaatctacctccttttcattctatgatatggatgtaccacagtttgaccatttccttaccaattctttccagttttatgtggagatattaaagtttaaaacaacatgcagaggctgggcatgctggctcacacctgtaatcccagcacttcgggaggacaaggcgggaggattgcttaagcccaagagttccagaccagcttgggcaacagactccatctttattaaaaaaaaaaaaaaaaaaaaaaaagatggctgggtgcagtggctcatgcctgtaatcccagtactttgggaaaacgaggcgggcagatcacgaggtcaagagatcgagaccatcctggctaacacagtgaaaccccgtctctactaaaaatacaaaaaattagctgggcgtggtggtgggcacctgtagtcccagctactcaggaggctgaggcaggagaatggcgtaaacccaggaggcggagcttgcagtgagtcgagatcacgccactgccctccagcctgggcgacagaacaagactctgtctcttaaaaaaaaaaaaaaaccgacaataatttttttttcttttgaggcagggtctcactctgttatccaggctgaagcaaagtagcatgatcacagctcattgaagcctcaatctccccaagctcaagtgatcctcccacctcagcctcctgagtaactgggatacacatgtgcaccaccaagcctggctaatatatgtattttttgtagagatggggtttcttcatgttgctcaggtctaaaactcctgggctcaagcagtctgcccccaccttggtgtcccaaagtgctgggactacaagcataagccaccaaactcagcgaagaatatattaaaattaaaaaataatgataaaccatgtacagaggacgaaaatggagagaataaaaagacagaggtagcagctcctgagggatgagaattccatgacacatgaatgcttgatcacagccctctatccttaactggagtaaggcagagagtactgtccacacaatcagtgctgagggtcagttaatagctattgacaacgccgggcgcggtggctcacgcctgtaatcccagcactttgggaggctgaggcaggcagatcacgaggtcaggagatcaagaccataccggctaacacggtgaaaccccgtctctactaaaaatacaaaaaattagccgggcatggtggcgggcgtctgcagtcccagctactcgggaggctgaggcaggagaatggcatgaacccgggaggcggagcttgcactgagctgagatcatgccactgcactccagcctgggtgacagagggagactccatctcaaaaaaaaaagctattgacaagccagtatttttaagaacacaccagacaccgaagccacccaagcatacctttgcagaaacttccgcactgatttcctcctgtgtttctgccagccgcttcttggcgagctcagttctccgatcacattcagcaataaaggactccaagtgatccattgcctagcacgggaaaagcacagcgctataatcaatgatgtgtaaagcgtaaagtcttagaacccatttgcttgataggaaatacactcctaggttcgtttctttaaagcctgtacattcaagggaaagatcttaaactacactaccactaacgcattcataattgcattaaatcaaggggatctgttaaacagaatgattgtttggaagcatggtcttctcatttgatttacttatttccaaaatttgtaaaaggacctccaaccctcaataacattacaaagaaattctgaggaaaattaaaacacttggcagcaattcatagagttctcggagggacagaaaaggctgagcctagactcgtgctggaggccctcttctggggagttgtgagagatgcatatgatgtactcactggtctttgtgagccacgtaaatattattccctcatgttctgagggtagggtcccccctttcacctcaaaaacaaaacaatagaacaaatattactgagagctatgaatacattttgttattgcctactatctaaagtagcaggaaaaattggttgctatttacccaaagagataaaggaaaagaagctgtagacgtcaaattgcttactctgaaaagggtggtgggaaacattaagagaactatcatatgctaaggttaattcaccataactaggcaaaggctaacataatttcagataaaaacagagacaggaccggacgcagtggctcacacctgtaatcccagcactttgtgaggccaaggtgggcggatcatgaggtcaggagttcaagaccagtctagccaacatggtctctaataaaaatacaaaaattagctgggcatgatagcgggtgcctgtaatcccagctactcaggtggctgaggcaggagaatcgcttgagcctcggaggcagaagttgtagtgaactgagaccagaccaccacactccagcctaggcaacagagcaagactccgtatcaaaaacaaaaacaaaaacaaaaaaaggcagggcccagtggctcacacctgtaatccctgcactttgggaggccgaggcgggaggatccatgaggtcagaggttcaagaccagccttcccaatacagtgaagccccatctctactaaaaacataaaaattagctgggcgtggtagcatgcacctgtagttccagctactcaggagactgaggcagaagaatcgcttgaacctgggaggaagaggttgcagtgagccgagatggcaccactgcactccagcctgggcaacagagcaagattccatctcaaaaaaaaaaaaaaaaaatagggcatcacttttccgactgtcagccagtgaccagtagtaagaaacactaacattaaaccatgagtcagcttgctaatgtcagcatcatgataaacataaataagtttgttttgcaatgatgacaaggttagatagcatgatcttttaccaaaaactaaattttaggtggagatgagaaggcagatgacaggaaaacactaaggggtgataacctaagtcaccgctcctaaaacagacaggagacagtaggtcagctgtaataaactgctccacaatggattacacagacactggagaagattgtgatcttctctagaaatcttaaatatttttttcaaaaacatgcatacttgggagtaggtaagatagggaagaacctccaagtctcctggtgcccagtctcccaagaagctggagaaagcacaagcagcatcactgatgaaggctgactcccagatatcactccataattttggaattcaaaaactgcctcttggccaggcgtggtagctcacgcctgtaatcccagcactttgggaggccaaggcgggtggatcacttgaggtcaggagttcgagaccagcttgaccaacatggagaaaccccatctctactaaaaatacaaaattagccacgagtggtggtgcatgcctgtaatcccagctacttcggaggctgaggcaggagaactgcttgaacctgggaagcagaggttgcagtgaactgagatcgcgccattgcactccagcctgggcaacaagagcgagactccctctcaaaaaaatacataaactgcttcttgttggtcacccagatattctctagtcaacatttcagtatgttcaaatcaaagaatcaggaaaacaaatgatccggcatttgactgcttctatgcacctgtacactggactttctggaaaggtgaagagctggctggagctcatcaggatccaagtattaaggagctgacaagggtcactgtgccttctcttctgtgcttacctcagacaacagcccctaacagaccagtctgagatgctccaggttcacccacacagtggccctgtactgtctgctcaagctgagcaatcaatcaccaacctgagacagattcagggattcactcgaggggtcaaatgggaaataggcagctgacaactctcccaatacctaaacccatcaaagcaattacctgcaccttaagcagaatccaaattggctatggactcagatgtctgataacctaaaaactaaatggtggccgggcgtggtggctcacgcctgtaatcccagcactttgggaggctgaggtgggcggatcacggggtcaggagatcgagaccaccctggctaacacagtgaaaccccgtctctactaaaaatacaaaaaattagccgggcgtggtggcgggcgcctatagtcccaggtacccgggaggctgaggcaggacaatggcatgaacccgggaggtagagcttgcagtgagcagagactgtgtgccactgcactccagcctgggtgacagggcaacactccgtctcaaaaaaaaaaaaagaacactaaatggtaggcccagcacggtggctcacgcctgtaatcccaacactttgggagtctgagaccagcctggccagtatggtgaaaccccatctctactaaaaatacaaaaaattagccaggcgtggtggcgggcaccactggttgctatttacccaaagagatagaggaaaagaaactctagacgtctaattgcttactctgaaaagggtggtgggaaacactaaaagaactatcatatgctaaggttaattcgccttacgaggtgaatcccagctacaagggaggctgaggcaggagaatcgcttgaacctgggaggcggaggttgcagtgagccaagatcacgccactgcactccagcctgggcgacagagcaagactggctcaaacagaaaacaacaactataaatggtaaacttcacaacagagaacaagccaaccaagagctgccaagttctttaaaaggtggctttctgttctactgccctctcccttcaaagtgtttctcaactttagcctgtttcttaaaagagcagatctaaatgataaaaaaaagacattcgattccaaaaattaagtcctaatcacaacctaccacttactagaaagtcacccaatctctctctatctctgagtagcgttatgaaacataaaccctaaaagcccctgagcacagacagcaccagcacaaagacttgtgtcctaacagtatggcaaaactggacaatatcagcacacgtcatctccactgaggaggctgtccctccacacacggactgcctggtgctgttaccagctctcccggcccagcagcactgacacaggccggtggtcactgagcctgagaaaagcccatgatgtcagtcagaactgtcacagcagacaggtgcccttgtgctgcactaggcacgtgcgctaaacacctccaaagagccgcagaggggccgggcgcggtggctcacgcctgtaatcctagcactttgggaggctgaggtgggtggatcacctgaggtcaggagtttgagatcagcctgaccaacaaggagaaaccccatctctactaaaaatacaaaattacccaggcgtggtggtgcatgcctgtaatcccaactactcaggaggctgaggcaggagaatcacttgaactcgggaggcggaggttgcagtgagctgagatcgtgccattgcactccaacctgggcaacaagagcgaaactccatctcaaaaaacacagccgcagaggagctcgtcgggtctccattgcatggatgatgaaagtgaagcacagctaccaaaccactaagtaagcaatggagtcaggatccaaggacccttgtggtctggctccaaagacctgcacttcatcctcacaaatctgaggcagccatcgtcagcccagtttatagatgaaaaaaagaaggtgaaataacttgcccagggtcacacagggactctaactcaagacatttgacctagaaaaatgtcactcttatactggacaactgtaagacaggaaaactacatacaatcagaactggtctcatgtggtatattaaaaacagctttgaaatgagcccatatatgttgttttgaaaacttttcaaaacatcacatggccagacaacatgggagtaaaggttaattacacttttggtgaattacaaagacacattcattacattttcaacatgtgaacactaaagaaatataccttttttttttttcccgagaggatcttgctctgtcacccaggctagaatacagtggcacgatcacggctcactttagcgttgacctctcaggttcaaaccatccttccacctcagcctccaaagcaggtaggactataggaacacgtcactacacccagctaacatttctgattttgtagagactttgcccaggctggtctcgaattcctgggctcaagcaatcttccggcctctgcctcccaccaaagtactgggattacaggcgtgagcgcacacctggccatctgtaactttttcagagcttaatatgattaatattgctgtttgacagtttacaagttgagaaacttagtttatttatagactgccttataacaaatatagcacacatcctttcctaggcaacttccagataaaacatatcaaggcctgggtcttttgtggtcaggctgaggctgactcaggctggaagcagccaatgatgaggacagggagggtatcttctcccaggtaaaacaactgagtactgggaggatcctgggtagaaatgtgccaggagttccatccatcaagcttaaggtgatggtccaggcagaaaataaaggcccacaattttttttttggaaggggacagggagacacagcgtcatcttgtcacccaggctggagtgtagaggcaacatctgagctcactgcaacctctgcctcccaggctcaagcaattcccctgcctcagcctcccaagtacctgggattgcaggtgcacaccacaacacctggctaattttatttctgtatttttattagagacaggttatcaccatgttggtcagactggtctcgaactcctgacctcatgcaatccgtctgcctcggcctcccaaagtgctgagattacaggcgtgagccaccgcacccggcagaaatcttttttctttttttctttatttgagaccaagtctcgcactgtttcctggactggagtgcagtggcgcaatctcggctcaccgcaatctctgcctcccaggttcaagcgattttcctgcctcaccctccaaagtagctgggattacaggtgcccaccatcacacctggctaatattttctatttttagtagagatggggtctcactatcttggccaggaaggtctccatctcctgatcttgtgatctgcccacctcagcctcccaaagtgctgggattacaggagtgagccactgtgcctggcttgagttgaaatcgttacagctttatattttgtgtctttgttttgtgttctcatgagcaattgttttttttttgaaatggagtcttgctctgtcgcccaggctagagtgcaatggcacgatctcggctcactgcaacctctgcctcctgggttcaagctattctcctgcctcagcttcctgagtagctgggattacaggtgcgcaccaccacacccagctaatttttatatttttagtagagacagtgtttcaccatgttggtcaggctggtatcctgacctcatgatccacccacctcagcctcccaaagtgctgggattacaggtgtgagccactgagccctgcctatcataagcaatttgaaatcattagacaggtttcacaaacattagtttgaagggcagagtctatcatataggttcattataatttattcactcatttctcttcttgggcatttttcttgatccaaatttcaatctcataaacaattttgtcataagtatcatttatccattcattcatttatctgagacagactcttgttctgttctccaggctggagcacagtggtgcaagcacagctcacttcagccttgatcctccgggctcaactgatcctccagcctcagcccctcgagtagctgggactatagttgcaggccaccttgtctggctaatttttttggtattttgtgtacagacagggtttgtcatcttgcccaggctagtctccaactgggctcatgcgacccacccaccctagtctcccaaagctcttggattacaggcatggaccactacacctggcccacaaacatctttactataaccatgtttccatgtatttccaattactttcttaggatagagatttctagaaataagtcacaaggcagagatacttttaggccaggcatggtggcttgtgactgtaatcccagaacttcgaagactgaagtaggagaatagcttgaggccaggagttggaggctaccgtgagctatgagcacgccactgcaatccagcctgggcagaacaagatcctatctcaatagttgtattacatcttttttttcctcttaaaataagttacgataaacatcttttctctgcattcattttcacatatccttaagacacattcccaacagtggaattctggaaaaaaatgtttaaaacaccaacagtaggccaggtgcaatggatcacgcctgtaatcccagcactttgggagagtgaggcgggcagatcacaaggtcaggagcttgagaccatcctcgctaacatggtgaaaccctgcctactgaaaatacaaaaaattgggccgggcgcggtggctcacacctgtaatcccagcactttgggaggccgaggcgaatggatcacaaggtcaggagtttgagaccagcctgaccagtattgtaaaaccccgtctctactaaaaatacaaaaaattagccaggcatggtggcgcgtgcctgcaatcccagctacttgggaggctgaggtaggagagttgcttgaacccggcaggcggaggttgcagtgagccgagatcatcgcgccattgcactccagcctgggcgacaaaagcaaaactccgtctcaaaaaaaaaaaaaaaagaaaatacagaaaattggccaggtgtggtgacatgcacctgtagtcccagctactcaggaggctgcggtgggaaaattgcttgaaccgggaaggcagagatggcagtgagccgagatcatgccactgtactccagcctggacgagagtgagacactgtctcaaaaaaaaaaaaaacatcgacagtgtcttgacagatcactctcccacaacactgctgctccaccacacccagctaattttctattttttttctagaaacatgttcttcaggcaaaaactcctgggctcaagtgatccttcacttttggcctccaaaagtgacaggattacaagcagaagcccccttgcctgcccagcccggtttactgttttttttttgagatgggatttcgctcttgttgcccaggctacagtgcaatggcacgatcttggctcactgcaacctctgcctcccaggttcaagtgattctcctgcctcagcctcccgagtagctgggattataggtgcccagcaccacgcccggctaattttcaatttttaatagagatgggggtttctccatgatggtcaggctggtctcgaactcccgacctcaggtgatctgcccgcctcagcctcccaaagtgcttgggtaagaggtgtgagccacagggcccggcccttgtttactctaattctttgagtgaggaggacctttttcttttccacatgcttataaacactggttatcaaatagttgttttttttttttttttttttgagacggagtctcgctcggttgtccaggctggagtgcagtggcacaatgtcggctcattgaaacctccgcctcctgggttccagtgattctcctgcctcagcctcccaagtagctgggactacaggtgcccaccaccatgaccggctgatttttgtattttcggtagacacggtgttgtactatttggccaggctggtgttgaactcctgaactcgtgatctgcccgcctcggcctcccgaagtgctgagattacaggcataagccacctcgcctgacctaattattttaatatgagccccctgtaaggtcaaaaatgacttttagggagtgggagatgcgggtagttttcagggagtaactcttgtatattgtacattttcacataggacaaaaaggtctctgacctgttctagctctctaacccattctctcaaggcacatgccaccacgcctggctaactctggcatttttttgtagagacggggtttccccatgttgcccaggctggtcttgaactcccgggctcaagcaatcctcctgcctcagcctcccaaagtgttgagattacaggcgtgagccaccacatgcctggccaaggccactattttaaatagaatttttttttttgagacagagtttcgctctgtcacccaagtagaataaagtgcaatggtgtgatctcagcacactgcaaccttcaccaactgggttcaagccattctcctgcctcagtctcccgagtagttgggattagaggacagcaccaccatgcccagctaatttttgtatttttagaagaggcagcgtttcaccatgttggccaggctagtcttcaactcccgacctcaggtgatccacccacctcagcctcccaaattgctggaattacagctgtaagccactgcacacggtccaggaatttattctttattgagaattgcattcctgtgtcaaatgaaacatctcaggtaccccccaaatatatacacctattatgtagccacaacaaattttttaaataggctgggcgcagtggctcacgcctgtaatctcaacactctgggaggctaaggcgggtggatcacctgcggtcaggagtttaagaccagcctggccaacatgacaaaaccccgtctctactaaaaatacaaaaatcagccaggcgtagcgatgtgcacctgtaatcccagctactcaggaggctgaggcaggaaaatcgcttgaaaccaggaggcagaggttgcagtgggccgagatcacaccactgcactacagcctgggcaacaagagtgagactctgtttcaaaaaaaaaaaaaattttttttttaaataaataaacagaatttacttgaggccaggtgcagtggctcacgcctataatcacaacactttgggaggccaaggcaggtggatcacctgaggtcaggagtttgagaccagcctgaccaaaatggtgaaacctcatctctactaaaaatataaaaattagctgggcgtggtggcgggtgcctgtaatcacagctacttgggaggctgaggcatgagaagagaaggaggttgcagtgagccgagatcatgccactgtactacagcctgggcgacaagagcaaaactatatctccaaaaaaaaaaaaaaaaattagccaggcatggtggcaggcacctgtaatcccagctactcaggaggctgaggtaggagaatcgcttgaacccaggaggtggaggttacagtgagctaagatcatgccacggcactccagccgaggcaacaacagtgacactccgtctcaaaaaaaaaaaaggaagaatttactgtaaaacgtattgacatcttgtaatgcaagcggagggaccctttcccttgggttttatatttttcactggctccctcatcccatgctcagtgccttcccggtcttcactcaagaaccagaatggcatcaaacccctctactaacctctggtcatactagcgatgggtgattagggattaaaaaacaattaaaattgagtgagtttaaatcatgtattcttaccaggcacagtgtaatcacacctgtaaacccagcactttgggagagtgaggtgggtggatcacctgaggtcaagagttcaagatgagcctggccaacatggcgaaaccacatctctactaaaaatacaaaaatcagctgggtgtggtggcgggcacttctaatctcagctacttgggaggctgaggcaggagaattgcttaaacccaggaggcggaggttgcaatgagccaagattgcgccactgcattccagcttgggcaacagagggagactctgtctcaaaaaaacagaaaaaagaatcttaaaaggctccactgggggcaacaacgaaaaaaagctgaaaaatgctactctaaatgaatttactggccaggcatagtggctcacacctgaaatcccaataccagtgagaggccaaggtggcaggatcacttgagggcagaagtttgagaccagcctgggcaacatagtaaaaccctgtctcaaaaaaaaaaaaaaaaaaaaaaaaaaaggccgggtgtggtggcacacacctatacccgcagctactcaggaatccgaggcagggctatcactgagccgaagaggtcaaggttacagcaagccatcatcacgccactgccctccagcctgggtgacagaacaagaacctgtctcaaaaataaataggacaggcgcggtggctcacagctgtaatcccagcactttgggaggccgaggcaggcggatcacaaggtcaggagatcgagaccagcctggccaacatggtaaaaccccatctctaccaaaaatacaaaaatgagctgggcatggtggcgcatgcctgtcatcccagctacttgggaggctaaggcaggagaatcacttgaaccagggagtcggaggttgcaatgagccaagatggtgccactgcactctagcctggtgacagagcaagactctgtctcaaaataaataaataaataaaaattaaaataaattaaataaataattagccagacatggtcgtgtgcatctgtagtactagctatttaggagactgtggaagaaggatcacctgagcccagcaattcacttacagtcagctataatcatgctgctgcactccagcctgggcaacagagtgaaactctgtatcaaaaagaaaaagaagctaggcacggtggctcaacctgtaatcccagcactttgggaggctgaggcgggcggatcacctgacgttgagagttcgagaccagcctgatcaacatggagaaacaccatctctactaaaaatacaaaatcagccgggcatggcggctcatgcctgtattcccagctcctcaggaggctgaggcagaattgcttgaacctgggaggagtaggttgcagtgagccaagatcgcactactgctctccagcctgagcaacaagagtgaaactccgtctcaaaaaaaaaaaaagaatttactaatgtagataaaataacacaactactgagtactaaaaaaatgcaaattgagatcagaaagaaatgccattttacaaccactaaactgcaaaaattaaacagtctgataatacaaagtgttggtgagcgtgcagacactgctatgggactttaccaaatagaaacaagaagacaacattacaaaattgtcttgcgaggataaatacgggtatctcctataaaccagcaatccctctcctaggaatatacccaaaataaatccttatccacgtgacaaggaagttatgcaaaaatattcatattgtctgcagtagcaaaactagaatcaatctaaatgtctatgaataaagcaaagatcgtttgagaattattcaagcagcaatgaaaactatatgcaacaacctgggcaaacagaaacatgatactgaaccaaaaaaatctaattttaaagactctacactatgaaaccattcaaaactaagcaaaaataaacactgttcaaggactcataaaaatgtaattaaaatttttaaaagcaacaaaatgagataacacatattatcatttaggacactgacaggacgctggacacaacatataaacagtactggctgtattctagctctgagcttgagtggcaggataacaagcaactaccttattattttgcttcataacttacgtatgttacatttttcttgttagttcaatattgggttcttcgcagtaggaataaatcaacattaaataaaacttacatctaattcaaaaaacaggtctctttctttacttgcaatctcataatctgctcggagggccaagtcgtggattttggtacattctcctaaatccatgcgctgtgggaaagaaacagaaaatgcagacctcagtgcctacctactgtagaaagcacacaacgcgacttggtgtttcaactgtcaccaacagaaatgatcacttttggaacactgacactgcaataagaaaattaagaaaggagatatggctgagaagcctcatttcacttttaccatcgtgactacgtgatacttgaaactgatgcatttaatagtgtaaagtttctattttagacccagagataattggactgtaatcatcacaactacattaattggcttttgccagtttttaaggagtctcacctgtcacccaggctggagtacagtggcgcgacctcagcttactgtaacctctgcctccggggttcaggcaattctcctgcctcattctcccaagtagctgggattacaggcacgtgataccacacccagctaattttttttttttttttttttttttttttttgtattttcagtagggacagggtttcgccacgttggccaggctggtcttgaacctctgacctcaagtgatacacccaccttggcctcccaaagagctggcattacaggtgtgagccacggtgcctggcccagttttatttatgcatcagtccaaggattcagtaaatggcagcatgtggggtggcagggataggaaacggccagggctgggcgtggtggctcacgcctgtaatcccagcactttgggagggtgaggcaggcggatcacttgaggtcaggagttcaaggccagcctgcccaacatgataaaacccagtctccactaaaactacaaaaattagccaggtgtggtggcagggcacctgtaatcccagctacctggggagctgagacacaagaatcgcttgaacccaggaggtggagtttgcagtgagccaagactgtgccactgcactccagcctgggtgataaagtgagactctgtctcagaaaaggggaaaaaaaaaaggaaagggccagaaaacagtctcactgcaacaaatttctaggcattgtcttgcaatcttgactacttgagatgctcgatgcttaagatgcagagacagaggaagaggaaagagcggacagaagttagattttggcaattacatcacaacctaacacttggctttgtgtagctgattgtgtatcaaagggaataaaggagaacaggctggttcgtagccaaatacatgctctacacattttcttagcctgggaaatgaccctggacatctaagtgaggacagataattgtcccactcagttcctccatttgacaagcaaaacgttccattactaaaacaaaatgatttatgttgtcagtaagaacagcatgatgtgctattatgtgtaccatatgcagtacaattagaaaacagtgtatgattttaatctaaatcctaagtataggactctatgcagacaccttctgcctctcgccatctacacagcaacagggaggtttgtgtgctgaggatcatcgtgtcaagttatagagtgcatgttaacaaaacccaacatcccaactaggagacacccccagtaggacaaaagaacatgtctacataaccagaaaaaaaaaaaaaaaaagacgttagtaccagttgcagtggcacatgtctgtaatcccaacacctttgggagggcaagatgggaggatcacttgagcccaggagtttgagaccagcctgggcaacatagcaagaccctgtctctatgaaaaaattaacaattagctgggtgtggtggtatgtgcctgtagtcccagccacttgggaggctgaggggaagagatcgcttgagcctaggaggtcaaggcttcaagtgagctgtgactgagccactgcactccagtctgagcaacagagacccctgtctttttaatttttttttttttttgagatggagtttcgctcttgttgcccagactgtagtgcaatctcggctcaccgcaacctccgcctcccaggttcaagcgattctcctgcctcagcctcccaaggagctggaattacagacatgtgccaccacgcccagctaattttgtattttcagtagagatggggtttctccatgttggtcaggctggtctcgaactgctgacctcaggtgatccacccaccttggcctctcaaagtgctgggattacgagcgtgagccacctcgcccagctttttaaagagaccccgtcttttaaaaaaaaaaaaaaaaaaagaaaggaaggctttaaacctttaatccatcttgagggggaaaaaaatagagaggcttgcatgtctgactcttgggatgcagtctcatagaaagcatgtagcatgctaggctgggcacggtggctcactcctgtaatcccagcactttgggaggccgaggcgggcggatcacgaggtcaggagatcaagaccatcctggccaacacagtgaaaccccttctctactaaaaatacaaaaaaaattagctgggcgcctgtagtcccagctactcaggaggctgaggaaggagaatggcatgaaccagagaggcagagcttgcagtgagtcaagatcgcaccactgcactccagcctgagcgacagagcgagactccgtctcaaaaaaataaaataaaataaaataatagataaaaaaagaaagcacgtggcatactcactaacaaaacatccttcagtatcaccaataataaagctaacatggaggcggcagacaacgggtctgccttgtatggtgatgtttattttgacgaaagattgacttttctcctttatcattcttactctgaagtcagatgggactcacgttatggtcggttacatagaagacttagagataggacaatagtggttctagaagccaaatttgcacttaaaatcactgtcactgaaaatctgacaacttttacctcattcactctgttttttcttttttttttttgaggcggagtctcactctgtcgcccaggctggagtgcagtggcacgatctcagctcactgcaacctctgcctcccagattcaagtaatcctcctgcctcagcctcccgaatagctgggactacaggggcacgccaccacgcccggctaatatttttgtatttttagtagagacaggttttcatcatgttggccaggctggtctcaaactcctgacctcaagtgatccacccgcctcctcctcctcctcccgaagtgctgggattacaggtatgagccaccgcacctggcctcattcactcttctaagttgtgggtgttgtcctttaaaatatatagtttccacaaactaagcattgtagctgaaaaatgaatggcagctatcagaaaaaatgctttaaactaatcaaggctttgttgttcaaagaaaaagctactaccaaaggaagcagaccctaaaacctgaagtacaacaaagtatgaagtacaaattgatttccattataaaaaactcaactgtcaagaaagatatgacattagaaaacctcatgaggccgagcgcggtggctcatgcctataatcccagcactttgggaggccgaggagggcggatcaccttaggtcagaagttcgtgaccagcctggccaacgtggtgaaaccccgtctctactaaaaatacaaaaattagccgggtgtggtagcgcacgtttgtaatcccagctactcgggaggctgaggcaggagaattgcttgagcccgggaggcggagcttgcagtgagctgagatggagccattacattccagcctgggcaacaagagcgaaactcagtctcaaaataaaaaaaaaagaaaacctcatgaggccaggcgcggtggctcatgcctgtaatcccagcactttgggaggcagaggtgggtggatcacctgaagtcaggagtttgagaccagcctggccaacatgatgaaaccccatctctactaaaaatacaaaaaaaattagccaggtgtggtggcgggcgcctataatcccagctactcaggaggctgaggcaggagagttgcttgaacccaggagacagaggttgcagtgagcagagatagcaccatgcactccagcctaggcaacagagtgagactccgtctgaaaaaaaaaaacctcacatgaagcaaaattcagcacttacttttcaatgtgagagctcccaaaagagtccctgcttaagcacactgaggataggcttgggttctatgattaccctctttggatgtagcttttcagctttgccaaggaggcagggaaaaatactactggccattcccctggatgcccaacatcaagcagagctgaaatatcacattcattaagtccttccacaatattccacatggctgctaaatccagtgtgtcaggcgttttttactccacaacctgtgttctcttctgtaccttctactggtctaacactactgaccaggaagggcaccaaagtttccggaaccttcagaaaacacagttctggccgggcgcagtgtctcatgcctgtaatctcagcactttgggaggccaaggtgggtggatcacgaggtcaggagctccagactagcctggtcaacatggtgaaaccccgtctctactgaaaatacaaaagttagccgggcgaggtggtgcatgcctgtaatcccagctactcgggaggctgaggcaagagaatggcttgaacctgggaggcagaggttgcggtgagccacgatcacatcactgcactccagcctgggcaacaagagcgaaactccgtctctttttttttttttttttgagacagagttttgctcttgttgcccaggctggagtgcaatggctcgatctcggctcaccacaacctctgcctcgcgggttcaagtgactctcctgcctcagtctcctgagtagctgggattacaggcatgcgccaccacacccagctaattttgtattttaatagagacagggtttatctatgttgatcaggctggtcgccaactcccaacctcaggtgatccacccgcctcggcctcccaaagtactgggattacaggcgtgagccaccgcacccagcctgaaattctgtctcaaaaaaaaaaagaaaagaaaagaaaagaaaagaaatactctcactcagattatttttctcaccagtattctgcagctatgctacacagggtctggccaaggaaaacatggttgaaatcttcccgagagtgcacatctatctgctccctctgacttccttcactatgggtttatcaagaattccaagttgtgcatcctatgaaaataccctacagtgaaacttcctttgacgagttgaaatcattaatctgtattgacctcggtacacacaacaatctgcatcaaacagtaacgttttcccatcccaggccaaacagcagacaacaccccaaggaacagaggcacaaggtttggcattcatttcgcatttgctgtcagaaaactcagcttgagaagttttaatacatctgagcggttttccagaaggtgctcctccctaatataagcaatgattcatcatgaagaaaacttcctttaacatatgcacatttcatccttaaaatgagaggatagtttttaacctccgtgaggtagctgtgaaaccttaaaatgggggtggtctctacaggactccttttctctcagtggcgtaatcaccacagataaccttccactattcagtcttttcaaattcttacttcgaataaatgcacattatacaaagctagcgtttatctgttttgttcatctgaagtgaacttaaaattgtagggttctatattcattagatagcatgttgatttcttgaaggggtggcacaacacaaaactacaaaatcaatgtatcctcaactgatttttaaaaaccaaaaaattgcgggaagaaaatgtaccttgctagatcaaaagttttccacacaaccaacttgaggtcaaacaaacccacgcagaatcttcaaagaacttcaggctgacctaaagcatattttttgctacagccaaattagaatacttgccctatttagttgtgaatatctcagtataaatgactttacaaaaaatctggtaactttacagacagaattttacaacagtgaaatttgttccataatataaaatcctaccaaatgaatagaatctatcattttaagggcatcagggatttctgcctgttgaagagtggaggattgagaaaggagcagtggctcatgcctgtagtaccagctgctcaagaggctgaggtggtaggattgctggagcccaggagttcaaggctgcagtgagctgtgatcacaccactgcacttcagcctgggcaacacagagtgacactccatcgcatgcatgcatgcaaacatacatacgagtggaggaacacctgccataattaagccacttagagaaaaagagacttaagttaaaacaaaattcaacatagaaaaaccgtcactgcctatacagcactcatgtcagagtgttccatgaggtcccccaaaatgcacctaccgtcccagccaggatgtcatgggggcagcagtccagaaggtgactcttgcagacacggtcatctgtaaacttgaccctctgtctggtttcgtctcctgaaattcatttgtggttttaaataagacaatattatcacattaaccaccaaaaaataactagtataacaattcacctggatgatttgcagactatcatttctgtgttctccccatcaaatgcaatgaaaagctgatctaaagatatttacaactggagtggaatacacatttttttgaggctagttatatcatggagaatcacacttaatgagatctgactccatcactgtaccaaagaagtcaaggagtcagacgtaaacagctgagcaccaaaaggccattggctccacatatacatgtggcaatgagactgcaaaacccaagctaatcagaggtccatgaaccaccaagggtgacttatagagctggtaatttccaccaacaaaagctacttattaatctaatctttttgttatgaacaaatgcagaggcagtattttgcccaaaattgaatgaagaagaaagctttcaaactctatcgaagactgttaaataatctagatctattcttcctacgtccctttcgttcccacccttaaaaaagagagttgctacctgggagtcacttttaacaagacaataccaaaaaaagcaaaaaaggaactaggttagtcaatacacactgtgagctccaacacatactgtacccatctgcattcttcaagacctcagctgcagaattttatgcccgctgttgaaaagtgttaaaggaaaagttttcttgcccacacctgcagtaaggaagtcgggggaatgatacataaaagtaaaggtaaagtggtatgtgacaaattttaaagctagtctgtgtatacaacacagagctgtgcaacgctagaggaggaatatattttaggatttgcaagcatccaggattaatgtagtgtctttttattgaaaatgttttctttctaaactacacttttaaagttacttgtgaaaaaaagcaaacacttttttgttataacagcttagaaattggttgtgactcacggctcgatgaacatgaggctttctgcaactcccttgcagattgatgtaggcaggcaaagatacactgaacctttataaataaaatagaggggccacaattgttcagtttgtatgaaataaaaatatgggaagcaattcaaaagcaactcaatatacaaagaaagctaaaaagcacttattcacctatgaaataaagtgcaaataatctgcacagccctgagaatgtgccagtgtgaacttacaacttcattactcagcagaaaagaaaacacaaaccacagcaggtatatagttttgcaaagatgcaaccgctttctcctgtgacaaccatcatgatcttgagctcctccctacacagtacaacctacctaacgactgtcaagcgctggctacacagaggctctcctgtgtgctggggggaagggggcagctggaaaagtacttggcagaaacccacgttagaaaagctcagtttacggttccccttgcaatggtacagaaccagagcgggccaggttttcgaggcccatccggctccctcgggtgtagcttcttcccaaggagcctcggaagagttctgccacccggctgccagcgacctggagcccacgctgattccagccctccgccgactccacagttcgcggaggggcacggagccgcggcgcccgccggggaggaagtagcaggacggtacataggaaggaggctgaagccccatccatggcgcagactccgagagaggagcccgacctggacccacggccgcctcagagacgcaccggcttagacaaaggcccggcgcctgcggtcggagcgcgggggaggaggagcgatgccccgcgcaggcgcaggcgcagacgatcgcggcccccgcctcaggccgcccggcggcctcgcctcactcccaccccagaccctcgcctggttggccgctctgactcaccgtcccgagccgtgcccatgagctggtccagcagggcccgcatctgcgcctgggcggacatggtagccggcggaggcgacggggtcggccgcgacgacttctctcaggcaggcggtggcagcggcgtcgacaaacgatggtcgcgtcggcctcgagcccactcggctctttcccgccgcgggggacgccgggaggaagtacgacggcgccggcgcacgccctgctgggaaatgtagtttctggggtgggtgcttagggaggctgaggctctgagtggtcgcaagttgtccaacggcggaaccaaaatcccaaccctgattttactctagacccccaggacctcaaacgagtctctacggagggtaaactacaataaaatgaaatacagtcaatcaaaaacaagatgaatccgtgctttttctaagctagccatgaaaccgtgagcatattatttagctccccgacgctcgtttttttaaatctgtgaaatgagggttctaaaggtgcccctcatatgatttttgtgaaagttaaataaagcatggaattttatttatttatttatttatttatttagagcgagggtcttgctccgtcgcccaggctggaatgcagtggcgcgattaccgctcactgcagcctcgacctccccggctccttatcctcccgcctcagcccggcaaagtattgggattactggtgtgaaccaccacgtttggccatcagtcatggcattaatattaggttctatgattacaacctcgtggtcgtccttttgtgagctcatggtctactgtcccagggactaaagaaaaggcatatgtaagcagttattttatgtgataatagaattatagcatgcacttatgtgtgcatagtctggcatatacttctattatattaaacctctattatttatttatttatttttgagacggagtttcgcccaggctagagtgcaatggcgcgatcttggctctccgcaacctccgcctcctgggttcaagcgattctcctgcctcaacctcccaaagtgctgggattacaggcatgagccaccacgcccggtctttattttttatttgtttattttttttttgagacggagtcttgctctgtcacccaggctggaatgctgtggcgcgatctcggctcactgtaagctccgcctcccgggttgaagcgattctcctgcctcagtctccccagtagctggaatttcaggcgcccgccaccccctccggctaatttttgaatgttaagtagagacggggtttcaccatgctggccaggctggtctcaaagtcttgacctcaagtagccagccaccatgcccagctgatttttgtattttcggtagacacggtgttgtaccgtattggccaggctggtcttgaacttctgaccttgtgatctgcctgcctcggcctcccaaagtgctgagattacaggcgtgagccaccgcgccctgccgtattttatttatttttgagacggagtctccctctgtcgcccagcctggagtgcagtggcgcgatctcggcttcctgcatcctctgactcctgggttcaagcgattctcttgtctcagtctccccagtagctgggattacaggcacccgccatcattcccgactaactttttttttgtacttttgcagagacggggttccgccatgttggccaggctggtcttaaactcctaacctcaggtgatccgcccacctcagcctcccaaagtcctcggattacagctgtgagccagaacgccaggcccctgctctctatttaaaataaataaatagggtgtccgttgggctgctcgggtcggattccgcggtgccagcccttccccatggccgaccctgagaagttgcaggtttcttcgccgcccccgccgcctccttctccctcctcttcagacgcctctgcagcatcttaccctggcagcccagtgagtttgggctggccagttccgagcaggagcagcggccgaacggtggacccgctggaggaagtggggctgcagatcggagacgcagccttttcattaaccaaacttcttgaagccacatctgcagtatcagctcaagtggaagaacttgccttcaaatgtacagaaaaggcacgtttccttaaaacgtggcgggacctatggaaagaaggctatgattctttgaaacctgatgactaatttggcatacttcgttgtttaataatgactgcaataattcatacttcttcttatgtcatatttgtacgtgtaccacacgtataggatgacctctgtccagcagttctgtatatactcagaatgaattttttcttggttttcttggcttttctgaaagcagaataccgatgctatttttgttgcggaccagtacttgtttgtccttacatacttcatgcctctgaactttcgtagaatcctttatgaaagttaacttcatcaatagatggttaatattaatagagccacagggctaccagcagcaaactaggtggaccattatttgttttgaaacaagatgctaagcatggcagagtttgaagttgcatttcatcttaaggaccaagggaggtaactttaaggttgccagtggtggatccagctccattaggctacgttgtctacagctaatgattgtgcttcattctgtatccccagcacctaaaacagggtcacacaacactcactgttggttgaatacaagaattaacaaacataaaaataaataaataaatataggccgggtgtggtggcatgtgcctctagtcccagccactcgaagctgaggttggaggatggattgagcctgggtggttgaggttgcagtaagctgtgatcacaccactgcatggcagcctgggcaaaagaacgagaccctgtcttggccaggcacggtggctcacacctgtgatcccagcactttgggaggccaaaaaaaaaaaaaaagaatgagaccctgtctcaaaaatgaaattaaaacttaaaaaacatgccaggctgggggcagtggctcatgcctgtaatcccagcactttgggaggccgaggcaggcgatcacctgaggtcaggagtttgaggccagactgaccaacatggagaaaccccatctctactaaaaatacaaaattagccaggcgtgatgacgcatgcctgtaatcccagctactcgagaggctgagggaggagaattgcttgaacctgggaggcagaggttgcggtgagccgagaatgcatcattgcactccagcctgggcaacaaaagcaaaactccctctccccccggccaaaaaaaaggccgatcacagtggctcacgcctgtaatcccaacactttgggaggccgaggtgggtggatcacaaggtcaggagttcaagaccagcctggccaacatggtgaaatcctgtctctactaaaaatacaaaaaaactagcctggtgtggtggcacacgcctgtagttccagctactcaggaggctgaggcaggagaatcacttgaacccaggaagcggaggttgcagtgagccaagattgtgccgcggcactccagcctgggcgataaagggagactccatctcaaaaaaaaaacaggccgggagtggtctattttgacactccacctcaaaaaaattaattaattaaaaaataaaatttaaattttaaaaaatcatttcacaaatgataatttaatatgattgctgccctggaagggggaaaaaagacttactctaagaatacaacaaagactgttcatgggctagaagcatcaaaagtccagacacggttagacaagttttgttttcatttattttgagacagagtctcactctgtcgcccaggctggagtgcagtggcgcgatctcagctcactgcaagctccgcctccgaggttcacaccattctcctgcctcagcctcccaagtagctgggactataggcgcccgtcaccacgcctggctaattttcttgtatttttaatagagacggggtttcacagtgttagccaggatggtctagatttcctgaccttgagatccacccacctcggcctcccaaagtgctgggattataggcatgagccactgtgcccggctgacaagttttaaataatgttttaaggcatgactttgcttccaattggccatttgaacaaagcaattaaatcatctgaattacgcacctaccaaactgccacagttactagaaatcagacaactgccaggcacagtggcccatgcttgaaatcccagcactttgggaggccaaagcaggagatcacttgagtccaggagttcaagaccagcctggttaatatggcaaaaccccatgtctacaagaaaggaaaaaaattagctgggcatggtggcttacagctgtagtcctagctactccggaggctgaggtgagaagatcacttgtgcctgggaagcagaggttgcagtaagctgtgatcccgccactgcacttgagcctgagggacagagggagaccccatccttttttttttttttttgagacggagtttcactctagttgcccaggctggagtgcaatggcaagatctcagttcaccgcaaactcttgcctcccaggttgaagcaactctcctgcctcagcctcccgagtagctatgattacaagcacgcgccaccaagtccagctaattttggatttttagtagagactgggtttatacatgttggtcaggctggtcttgaactcccgacctcaggtgatccacctgcctcggcctcccaaagtgctgggattacaggcatgagcccctagccttttttttttttttttttttttttttttttgagacacggtctggctctgtcgcccaggctggagtgcagtggcgcagtctaagctcactgcaacctccgcctcctgggttcacgccattctcctgcctcagcctcctgagtagctgggactacaggcgcccgccaccacgcctggctaattttttgtatttttagtagagacggggtttcacagtgttagccaggatggtctcgatctcctgaccttgtaatccgcccgcctcggcctcccaaagtgctggaattacaggcgtgagccaccgcccccggccctggcaccgtatttcaaggccgaaaattcgcatcctcagtgccagcaattctcctcgtggtcaaagaggagaaacactggggagagcacccggaagcgggggcgaggacgcagatcgggggtcgacgtcaagaaagaaggcgggaagaggacaaggtcgggagaggaggaggaggggagcgaggacgcagagaaggaggggaaagaggacggagaggagcgaggacggaggggggacgggaacgaagaggggcgaggacgttcagcatccattgcgacagcgacaaacaggacaccgccaggttcccggcggaggcagcgcccaagatccccgttgccgagcaaccgaagcatggcggtggggcggggtcggagcctgcgcatttccgcccccgcccgcccggctggtcggaagtgacgccagggggcggggccagcggcgcggtcgggtgagaggccgcggcggcaggtgagtgagcgcggcctcgtactcgcgcgtgcacgccgcaggggcgccgcaggccgccccttcgctctgggaccccggcccccaggttccccagtccctcggcccctggaggaccccgccgtgctgccccctagctcctccgccttcccgagtcgggtgcgggccgggaggctgcggcggggccccaagtccctcagcgggtcggcagcagcgcctctggaggctgattctttcgggtttcccccattgccgcagcctgggtttcagtggcattcagaacaagcccacatgttcctcaaagcggggttttacctcccggtagggagctccccgccgtggcgcagcgtaggtgagccggccgtggtcgctttcgctcttggtgccgcctgggttgcctgagagtgtttttttatggtggaagaatgtggatgagaagcctcacgggggtcggagaggcgtgtcctctctcgggacgctgtctgcaagcttgtccgtccggcaccccgggaaagctccccgagcgcagccgaggttgctcgtctgtgggagggactcaggcatagaacacaaaacagaggctagatgggaggaaaacactgggattagcgttcctggctctcccctacgttcgttggccgagagttgtcaaggagagagtttgcccttggacagactgataggatatcagggtaggcaatttcacttactctctggttctaaaccttgtgattccagctgaggaggctgtgacgcgctcccttccatgtactggctgccggtgtctttacggcgccagcatcagattacactacttcccttattgcaatttcagtctgcatccaattagagcagaataactcaacaaatactctccgagtgtctgctgggaaccagggatggttgtaggagctaaggatatagtactccacgaaagaacttcctgtcctcaaggagcttctattctactggagggtacagatagtaaattagataaataaaaaatggagcttgctgggccggcgcggtggctcacgcctgtcatcccagcactttgggaggccgaggcaggcggatcacctgaggtcaggagttcgagaccagcatggccaacatggtgaaatcccgtctctactaaaaataaaaaaattagctgcgtatggtggcaggtgccggtaatcccagttactcgggttcaagcgattctccccactcagcctcccaagtagctgtgattacaggtgcccgccaccacacccagctaattttttttattttttatttttagtaggggtttcaccatgttggccaggccagtctcaaactcctgacctcaggtgatccactcgcctcggcctcccaaagtgctgggattacaggtgtgagccaccgcaactggccctctttttttccttttgctccaccctcctgagtatctgggactacaggcatgtgccaccatatttatttttcttaaaaattttttttgggtgggcgcagtggctcatgcctgtaatcccagcactttgggagtttggggtaggcggatcactaggtcaagagatcgagaccatcctgtccaacatggtgaaatcccgtctctactaaaaatataaaaattagctgggtgtggtggcgcacacctgtagtcccagctacttgggaggctggggcaggagaatagcttgaacccgagaggcagaggttgcagtgagccgagattgcaccactacgctctggagacatagcgagactgtctcaaaataaataggccgggcgcggtggctcacgcctgtaatcccagcactttgggagggcgaggcgggcggatcacgaggtcaggagatcgagaccatcgtggctaacacggtgaaaccccgtctctactaaaaatacaaaaaattagccgggcgaggtggcgggcgcctgtagtcccagctacgcgggaggctgaggcaggagaatggcggaaaccccggggggcggagcctgcagtgagccgagatcgcgccactgcactccagcctgggccacagcgagactgtctcaaaaaaataaaataaaataaataaataaattattttgtagggatggggtctctctttctcagtctggtcctgaactcctgtgcccaagcaaccctcctttgttggcctcctgaagtgctggaattataagtgtgagccactgcgcccagcctgtttatttatttatgtatttttttaaaaaaatatgtagatgggttctcactgtgttgcccaggcaggtctcaaactcctggcttcaagcagtcctcctgccttggcctcgcaaagtgttaggattacaggtgtgagccaccatgcccaccccttctttttcttttcaggctccttgcttccattctgctgacttctaatggttgtctgctgcttgtaacaacacaaagtttaatggattaaagtgacgaatatttattatccaacagtttctgtgggtcaggaattgatcagtggcttatctgggtgattatgacttcgggtctcatggagttgcagccaagatgttggctggggctgcaggtgtctaaaagctggatggagtcttttctgttttttctagaggtcgaaaatttaaaaagaacaaataaaataaaagctggaccagggctggaggatctgattccaagatggctcactcacaaggctagtgactggaagcctcagttccctcttggctggtggcaggagccctcagttccttgcatcatggaactttccttagggcccatgtcctcacatggtaattatcttcccttagagcaagtgatctcggagtgaaagtggaaggtttccaccacaaaacctgttaatgaaattcttttttttttttttttgagacagagtcttcctctgtcacccaggctggagtgcagtgacgtgatcttggctcattccgcctccctggtccagctattctcttgcctcagcctctggaggagctgggactacaagcacgtactaccacgcccagctattttttttatttttagtaaagacggggtttcaccatgttggctgggctcgtctcaaactcctggcctcaggtgatcctcccgcctcggcctcccaaagtgctagggttacagacttgagccaccgtgcctggcctatgttatttatttttatttatttatttattttgagatggattctcgctctgttgcccaggctggagtgcagtggctccatcttggcccactgcaacccccgcctcccaggttcaagcgattctcctgcctcagcctcctgagtagctgagattacaggtgtgcatcaccatgccgggctaatttttgtgtttttggtagagacgaggtttcgccatgttggccaggctggtcttgaactcctgatgtcaagtgatctgcccatcttggcttcccaaagtgctggaattagaagcatgaaccaccgcccccgcccctgtccgaacatttttaaaccactatgcagcttaccactcctgtgggacaagagtgcctggtcctatgatttcagctggggtgctggccgtaatctctgggaatctgattagttagctagggccaggcctaatttattaatgaatgcattaataaattactgttctggccaggcacggtggctcacgcctgtaatcccagccctttgggaggccaaggggggcagatcatgaggtcaggagatcgagaccatcctggctaacacagtgaaatcccgtctctactaaaaatacaaaaaattagccaggcgtggtgacgggtgcctgtagtcccagccactccggaggctgaggcaggagaatggcgtgaacccgggaggcggaggttgtagtgagcagagatcgtgccactgcactccagcctgggcgacagagtgagactccgtctcaaaaaaaaaaaaaaaaaaaaagaaaaaaaaaatccctggctgggcgtggtggctcaagcctgtaatcccaacactttgggaggctgaggtgggtggatcacgaggtcaggagatcgagactatcctggctaacatggtgaaaccccatctctacaaaaaaaaaaaaattagccgggtgtcatggcacgtgcctgtagtcccagctactcaggaggctgaggcaggagagttgtttgaacccaggaggcggaggttgcggtgagctgagatcgctccgctacactccagcctgggcgacagagcgagcctacgtctcaaaaataaaaaaaaaataccatcctggctaacacagtgaaaccccgtctctactaaaaaatacaaaaaattagccgggcatagtggcgggcacctgtagtcccagctactcgggaggatgaggcaggagaatcgcttgaacccaggaggcagaggttgcagtgagctgagattgcaccactacattccagcctgggcgacagagcaagactctgactcaagaaaataaaaataaaaataaataaaaattgtgccggatgcggtggctcacgcctgtaatcccagcactttgggaggctgaggtgggtggatcacgaggtcaggagatcgagtccatcctggctaacgtggtgaaactccgtctctactaaaaatacaaaaaaaactagtcggacgtggtggcgggcacctgtagtcccagctactcgggaggctgaggcaggagaatggcatgaacccaggaggcggagcttgcaatgagtggagattgcgccactgcactccagcctgggtgacacagctaggccccgtctcaaaaaaaaaaaaaaaaaattaacactaatttgtgggggagttgcaggaaatctgccttggaattcaggagaaaggcttactccatggtattttctggacagactacaaaacttattctgtgtaatagttgcctatcagctgttcgccctcaacttatttttaggaggcattgtgagcccttctcaagtactgtaaaagtttttcagttctgcaaaggaaaggaacttgtgtttgggcttttgagtgctgactgcatgtgctgtgatacttttgcctttgtcatggaaccatgatctttaaagtggttctggaaaaatggttatgggcctgttctttgtcttgagattattcttggtggagagagaaatagctgcttgctgtaaacaactggacacagtagctgtccttgtctgacatctgctttgctcagctgaaacatctgcctcattggctgttgtgggtgtctctgaagctcatgttgaattgctgtcaaatgcccagcgtgttcttggtggtgacacagccacattgtgtaaatacatttcttaagtcatttgtgtgtatagcagctggatttggggacaagcatttgggcacactcgctacaagattggttagtgattatggatgatgaagtctgtcggaaaattcagatcttgattgtgagttatcttacttgtcttttaagttctctttcatccatttggctcaggggacacagcagacatcttcctggccttaaatagctttctttctgccaggtaagagaagtatgatgagtgctttgaaagaaaaatactgagttctctggggtggagtgtggttaaccagggtcagtgggggtcaccccaaacttatttaaggcttgagccgctgcatctgggtgtatttttttttttttttttgagacagagtcttgctcttgttgccaaggctggagtacaatggtgcgatctcagctcactgcaacctctgcctccttggttaaagcgatactcctgcctcagcctccctagtagctgggactacaggcgcgtgccaccacgccggctaatttttgtacttttagtagagatggggtttcacaatgttggccaggttggtctcgcactcctgacctcaagtgatccagccgcctaggcctcctaaagtgctgagattacagttgtgagctaccacacccagctgggcttattatttttaatccattgacaaaatcttttcagtttctgtttctaactggtgaaactagatagtaacattaatctataatcatagttttcctctaaatattaactaaatattttatccatttaaaacactgttttcttctcttttttttgagacagggtcttgccctgttgcctagactggaatgcagtggtgtgatctccgctcacctcccaggctcaagggaacctcagtctctcgcacagctgggactagaggcacataccaccatacccggctagtttttgtatttttttgtggaggtagggttttgtcatgttgcccaggctggtctcgaactcctgcgctcgagtgatcttcctgcctcctgctgtagcctcccgaagttgctgggattacaaatgtatgctactgtgcctagccttaaaacacttatcttgaccgcagaggaggtctacacaaaaagaaagaaaaaaaaaaagctgtctgcttcaggctgggcacggtggttcacacctgtcattctagcacttcgggaggcagaggtgggaggatcacatgaacccaggagttacagaggagcctgggcaacatagtgaggctctcatttctacaaaaaatttaaagattagctgaacaaaaattagctggtgcatgcctgtgctcccagctactggggagcctgaggcgggaggatctcttgagcccggggattcaaggctgcagtgagccatgattgcaccacttcattccagcctgggcaacagagcaagaccctgtgtcaaaaaaaaaaaagttttcatcaaatttctgcaattaaaaaaattagaggccgggcgcggtggctcaggcctgtaatcccagcactttgggaggccgaggcgggcggatcacgaggtcagcagatcgagaccatcctggctaacacagtgaaaccccatctctactaaaaatacaaaaaattagccgggcttggtggcgggcacctgtagtcccagctactggggaggctgaggcttgaaaccaggaggcggaggttgcagtgagccaagattgcaccactgcactccagcctgggcgacagagcgagacaacgtctcaaaaaaaaaaaaaaaaaaggcaattagaatgagacttttgtttttattttctgttctctgtgactcagtaaacttcttagagaaagaactcttggagaaaagggagagacctgtcacttcctttctgcatggactgtggtattcctgccccacccctgccgaaatgttaatgagctgtgcaaactactgctggattgttttgttcttccccctaatcagagtttccactcaggactgggtagcctgtggactccctggaggacagataggtgtggcagcctcagtggcctagagtggacagctggtttaccgatagtccttttttttgagacagagtcttggtctatcacccgggctggagtgcagtagtacgatcttggctcaccacatcccctacctcccaggctgaagtgattctcgtgcttcagccttcccagtagctgagactataggcagacaccaacatacccacctaattttgtatttttagtagagtcggggtttcaccatgttggccagcctggtcttgaactcctgtcctccagtgatctgtccacctcggcctcccaaaatgctgggtttataggcacgagtcaccgcgggcttactgatagttctgtaggccaggggaataatccgtttgaataaccatatatgaggtattgtgtttatctttctttcttcaagttattcttggtgtcagctccttttttttttttttttctgagacagagtctcgctctgtcgtccaggctggagtgcaatggcgctatctcagctcactgcaacctctgccccccgggttcaagcgattctcctgcctcagcctcctgagtagctgggattactgatgcacatcaccacgcctggttaattttttgtatttttagtagagatggagtttcaccatgttggccaaattggtctcgaactcctgaccttgcgatccacccacctcagcctcccaaagtgctgggattacaggcgtgagctaccacgcccatcccgtgtcaggtcttttaccttaattaatacgtattgtattgacaaattttcttttctttctgagccctcacttttttttttttttttgaaacaaggtctcactctgttgcccaaactggaatgtagtgataatgatcacagctcactgcagcctcaacctcttgggctcaagctaacctcccacctcagcctcccaggtagctgggactacaagcacatgccactacacctaattttattttactttttgtagagatggggtctccccatgttgcccagactggtctcgaacacctggcctcaagtcatcctcctgcctcagcctcccaaagcactaggattataggcgtgaaccaccctgcccggccatgaagttaaatttttggttattagcttgttgagttctgttttctgtttttttaaatagccacatggcctgactctctgtggtcaatggtatggatgctaaagtagagcaaggacagtgccctgctcaagtctctctgacctgggtccatggggattttctctgccagtcaggttcctgaagctctggctacggctcctggtatttttaatgaccgcagtagagaaaaacattggtatcttcttgctgttgatgagcaaatctttggacctgtctcatggtgtctttatttgcaaactggttgaatcatgaactgcctggctttggctgccttgccgttgtggcttttaataactacccctatttctggtggctcagtcaagtttccaaaaaggaagtcttacctggagatcctgtgaaggaattcctgaccagctttttaattttccaaagacaggccttattcgtgttaaacacacaccccttttctgtggccaggccggtgtgaaagcatgtgcagaggctgtatagcagtaagagttcccaccccttggggcattttcattgtcaccacattgtctgactttggagacgaccccttttaaactctggcatttgctcaggtaagtatttggggagtattgttataaatgctgtgcatatccgttttttccccacagtggaaaggaaaatgattttttttttttttgagtcggagtcttgctctgtcacccaggctggagtgcagtggtgccatctcggctcactgcaacctccgcctcccaggttcacaccattctcctgcctcagcctcctgagtagctgggactacaggcacccgccaccacgcccggctaattttttctatctttagtagagatggggtttcaccgtgttagctaggatggtctcgatctcctgaccttgtgatccacccgccttggcctcccaaagtgctgggattacaggcgtgagccaccgcgcccggtcggaaaatgattttaatggatggttttgaggaagctggtgattattttgtaatggagaattgtaacatgccaggggtttggctcttctttcagtatttcttcaggctaccacaaaactccactattgatattcttccaaaaataaacaaaacactaaaaggactcctgcctttggaacaaaatagcttcatattaaggtagctttgaggcacaaaccaagctgcctgtggagaagctggttcttcctctaaaacttacatgaacctctgaccccactcccccttactaacggttttcttttctcttttgattttctattttatactttttattttggactacttatagattcacaaaatgttgtaaaaatagcacagggctggaccctgaagtctgcttccctgaatggtaacctctttttttttttttttttttttttgagacggaattttgcttttgttgcccaggctggagtggaatggcacgatcttggccactgcaccctctgcctcccaggttcaagtgattctcctgcctcagcctcccgagtagctgggattacaggcatgcaccaccacgcccggctaatttttttttgtatttttagtagagatggggtttctccatgttggtcaggctggtctcaaactcccgacctcaggtgatctgcccgcctcagcctcccaacgtgctgggattacaggcatgagccatcgcgctcgaccaataactaccatttcaaattcccacgactattgtactgcagacctgttatcgtatattctcaccaacacattttaaaatgcttaacttttaggctgggcgtggcccacactttgggaggctgaggcaggcagatcacttgggccctggagtttgagaccagcctgggcaacgtggcgaaactctgtctctacaaaaaatacaaaaatttgcccggcgcggtgatgcacacctgtggtcccagctactttataggctgaggtgggagaatctctcgaacccagcaggaggaggttgcagtgagcctagatcaccactgccctccagcctgggccacagagtgagaccctgtctcaagatcagataaaatgaaatgcttaacttttgttaatgtcattggtcctgctgtgtctatgagtgagactgagtgtgtttcccctgggcaccggccactggcgtgtgctcttcagtgaactgcccagttatgaattcgtttcctgtttccccactggggtccttgcctttcttttgtgggtttgtgaaaaccctaagaatatttatcctggtttgttttgtggagctaacaacaatcttttggcttccctgggccacgttggaagaattgtcttgggccacacataaagtacactaacactaatgatagctgatgagctgaaaaaaaaaaattgcaaaaaaatctgtgaatgttttaagaaagtttctgaatttatgttaggccacacttcaagccatcctgggccgagggttggacaagcttgggttagacatttcataatatatttagttcatcagtgtttttcttaatgatttccacctttggggtcatgcgttcaagactttccctaacaatacataaacattctcttctattttcttttagtttaatgtttgttaaaaataatgtttacatttttggccaggcgcagtggctcacgcctgtaatcccagcactttgagaggcttaggtgggcagatcacgaggtcagcagttctagaccagcctgatcatcatggtgaaaccgtctctactaaaaatacaaaaattagctgggtgcggtggtgggtgtggtggtgggtgcctatagtcccagccactcaggaggctgaggcaggagaatcgcttgaacccaggaggcagaggttgcagtgagccaagatcacgccattgtactcccgcctaggtgacagagcaagattctgtctcaaaaaaataataataataataataatgtttacatttttaattcatttggagtttatcttgattggtggatttttttttttttttgtgacgaggtctcactctcacccaggctggagcacagtggtgcagtctcggctcaccgcaacctctgcctcctgggttcaagcagttctcctgcctcagcctcctgagtaggtggtggcttttttttttttttttttttttgagatagtcttgctctgtcgcccaggctggagtgcagtggtgcgatcttggctcactgcaagctctgcctcccgggttcacgccattctcctgcctcagcctcccgagtagctgggactaaaggtgcccgccaccacacccggctaattttttgtatttttagtagagatggggtttcaccgtgttagccaggatggtctcaatctcctgaccttgtgatccgcccgctttggcctcctaaagtgctggtattacaggcgtgagccaccatgcccagccagctggtgttttttttttttcgatcgattggtgttttgttttgttttgttttgtttttgtttttttctttttttgagatgggggtcttgctctgttgcccaggctggagtgcagtggcacgatcttggctcactgcaacctctgcctcccaggctcaagtgattctcctgcctcagcctcctgagtagttgggattataggcgcatgccaccatactcatctaatttttttattttagcagaggtggggtttcaccatgttgttcaggctggtctcgaactcctgacttcgtgatctgcctgcctcggcctccgaaagtgctgggattacaggcgcaaaccaccacgcccggtcagttggtggttttttaattgattgattgttggttttgttgttttatcgatgttttgttctgttttgttttgttttgagacagagctttactctgtgtcaccaggctggagggcagtggcgtgatcaccactcattgcagcctccacttcctggcttcaagtgaccctcccacctcagctcctgggtagctaagaccacaggcgtgtgccaccacaccgggctgattttttttttctttctttttagaaacggtctcaccgtgttgcccaggctggtcttgaactgaactcaagctttccatgcgcctcggcctggcaaagtgctgggattatagacatgagacaacactcccagccttattaatgattttttttttttaagagaagtcttgctgttgtccctcaggcttgagtgcgatggctcaatctcggctgactgcaacctctgcctcccaggttcaaacaattctcctgcccttgactcccaagtgactgggattaaggtgcccgccaccacgcccgactaatttttgtattttttagtagagatggggtttcaccatgttggccaggctggtctcgaactcctgacctcaggtactccgcctgccttggcctcccaaagggctgggattataggcgtgagccaccgcgcctggccttattaatgatttttaaatcagtttctcacaaactcttttgatcttagatcagtctgtgtttttcataaatgcctcaacggctggctcggttttagaaacctgtgtttgtcagttaaaatgatgatcctcccaaaaatgttcagtgccattttctaccctgacctgggttcgcccaagtggtgggagagtccccatggaggcactgcggggcctgactgtctgggaaccctctcagagtggagcccagtgctgggttcaggtgggtgctcatctggttaagtcaattgcctgcattgttttgcgtcccgtaatggggctttgccttctgaagcctctgtttctgtcttccctcacacgtatgtgatatgtcttatttcattctgctctgcaggtgaggacactggaccaattgtagatgctcacaagacacagatgacccaaatccccaaccgtgttactaatgagcatttagagagttttttccctttgtccttctaaatcttgttacagagatggtccgtgcatgggggaaatgtttgtcctttcggccaggctctccaattcaaaaggcaggaattgagaaaatgacagtactttctctgtccctgccacagaatgtccagtttggtctgatttaacatgacaaatcatgctgtagagataagtaagtagtttgaattttatttttcctttaatttttagaagccaccttataactcgaccattctagtcacatttttttcatatagattgtatactttatatactccatgcttatccacatagagaatacttctggaaggacccatatgaaactggtaccatgcttcccctcttgagcctgggagccacaagatgaaaggagatttacccttttatagtttttaagttttgtgggtttttttgaaacagggtcttgttctgttgcccaggatggagtgcagtgtcctggccatcgctcactgcagccttgacctcccgggctcaagcaatcctcctgcctcagcctcctgagtagttgggactataggtgcccaccaccacacctggctgatttttgtatttttgggtagagaagaagtgtcccctgttgcccaggctggtctcaaactcctaggctcaagcgacccacctgcctcagtcccccaaagtgctgggattacaggtgtgaggcagtgcacctggcccttttaaatgttgtatatatttattactgattttttaaaattataaatccaaactacattaatagtaattgtcttgcagggtcctttggtcatagcttacatattagaagaaggattaagaaagggagtgatataatttactagcttgaggtctgcatttggattgactttactaagcttgctgtgaactccaaggaacagaaaacccagaatacaggccgggcggcatcttcagaggaagaggccctttcccctttgccttgcttgcttccaggctggctgtggggggatgcagtctccccttgagggtcaggagatgtctggccatcatctggtagttagagtgggatgaaccgaacaagggcagacttctcggtctgttcttctctgcttggctccaccctggaatcagctggagagtgccagcagctgctcctgactgggaccccacacccaaagtggccaacttagtccttctgggggtggcatcaggattgcgaaagcacccaagttattttcatgtggagccaccactgagagtcatgtctttgggaggatctaagttcctgacctgccaccttcgcaggctgcctgagctgcacttgacaagtggctttatgatccctaggtccacctgggcttgcgaaggcacagattccccgtccacagctcacgaccagatgcaccagcaggagtccacatcgaggacgtcctccgggcactcccacgaccaggtaggtgaggactggtgggcccgtggctggatgggtggtgttttcagattcctggtggtggcggttgatgcccctccttgagtagtgctttcctgcacgctttctttgatgctctagctcccaccagatgaggacagctgaggctcagagctcgaatttcttggctgcaattttaaagctcttaagtttaaagccgtaaagatagaaatccagaattataacattctggttcttactccgtttttttctttcctttgccaaaggaatctatgttttatttatttattatttaaaaaaaatttttctttttagacggagtctcgctctgtcgcccaggctggagtgcagtggcgcgatctcggctcactgcaagctccacctcccgggttcacgccgttctcctgccgcagcctcctataggcgcatgccgccacacccagctaattttttgtattcttagtagagacggggtttcaccgtgttagccaggatgctctagatctcctgacctcgtgatcctcccacctcggcctctcaaagtgctgggactacaggcgtgagccaccgcgcccggccaggaatctatgttttaaacatttcacacatcccttccttggggacatggtggctagatttgctgaattaatggccgtctcctcttcttccagccctggccccagcccctcaggccctggcaatgaggcactcctacgttctgttgctggctttttccctagttaccttttccagacaacccacgtcctgccttccccacccccatgccagctgcttgggtttaatgaggtccttggtcgcgactcattgtttgattttccgtgttctaactcactgcctttgataagcacaccttttctgacttccaagatgttaaaacttaagcctcagcacctaggagaatgcacacattttttcttattgtggtaaaatgtacataacgtaaaatttgccattagtaacatttggtatgatcacagcattttgtaaccatcaccactattttcatcatcccacaaagaaaccctcagcccatagcagtcattcccgactctccctgttccgcacctggcccccacgagtctactccctgcctctgtggatttgcctgttctgggcgtttcacactacaggggaccttcgtgtcctagtcattgcatttagcataattttataatgtgtcagaattttagtttttaccatggctgaaaaacacaccactgcattatggtgtaattatgcactgtattatggataggccacattttgtttatccattcatatgttttgttttgttttgtttttgagaaggagtctccctctattgcccaggctggagtgcaatggtgcaatcttggctcactgcaacttccacctcccgggttcaagcgattctcctgcctcagcctcccgagtagctgggattacaagcgcctgccaccatgcccatctagtttttttgtatttttagtagagatggctttcaccatattggccaggctggtctcgaacgcctgacctcgtaatcctcccgccttggcctctcaaagtgttgggatcacaggcgtgagccactgcgcccagccgatacgttcatatgttgttggacatctgggttgtttctacattttggctgttgttaataatgaaccaatatgaacatttatttacaagtttttgtttgagcctctgcagtagggtttttttttgttttgttttttttgagatggggtcttgctctgtcacccaggtggcagtgcagtggcgtgatctcagctcactgcagcctccacccccctgggctctagtgatcttcctaccccagcctccgggtagctgagaccacgggcgagcgccgccatacccaactaatttttttggtatttttagtagagacagagtctcgccacattgcccaggctgttctcaaactcctgaggtcaagcactccactcactcggactcccagagtgctgcgattacaggcataagccaccatgcctagccaggtttttttttttttttttttttttttttaagagatggggtcttggccaggcgtggtggctcatgcctgtaatcccagcagtttgggaggccagtgcgggtggatcacgaggtcaggagatcgagaccatcctggctaacatggtgaaaccccatctctactaaaaatacaaaaaattagccaggcatggtggcggacgcccatagtcccagctattcgggaggctgaggcaggagaatggtgtgaacgggggaggcagagcttacagtgagccaagatcatgccactgcactctagcctgggcgacagaatgagactccgtctcaaaaaaaaaaaaaaaaaaagagatgggtctctctgttgcccaggctagagtgcggtggcatgatcagagctcactgcagcctcgagcaatcctcaagggatcctcctgctttggcctcccaaagtactggcattacaggcatgagccaccgtgctggccatgtctctgtttttctgttttttgttttttttttttttttgagacagagtctcactgtcgcccaggctggagtgcagtggcgcgatcttggctcactacaacctctgcctcccaggttcaagccattctcctgcctcagcctcccgagtagctgggactacaggcgcccgccaccatgcccagctaatttttgtatttttagtagagatgcggttttcaccatgttgtccaggatggtctcaatctcttgaccttgtgatctgcctgcctcggcctctcaaaagtgctgggattacagccgtgagccaccgtgcccggccggaaagtctgtttttaattcttgtgggtgtacacctaggactggacttgctggagagtatggtagttctgtgtttaactttttgaggatctgccagactgtgtttcacagcagcggcatcattttacagtcccaccagcaacgtacgatgttctgatttctccacatcctcacccagactcgtcgtttttcccttttaaaattaaagccattctagtgtcatacacaggttattaagtgagttacttttattatataattaggcaaagacaaagtccgagtgaacagtttaaaacaaaagccagcagtcccttatctctctgtcttcctgacccttccccagagggtgcggctttcagctcagcttttcctcgccttccctcgctgacctccgcacgccctctttcatctttcacccctccctttgctgtgaactgttgacttcctttttgggtaggtgaaggttttacctcaaatctgcatgatcacgtccagtctctcagtatgatgtgttaggacatcggtttggttgtttaaaaggaaccaaaataacaaaaatcttgcctgagacaaaatggaagtttgtttttttctcgttttatacagtcgaagcagctcaggctgggtggtggtggttggcagatatcaggggccctgtgcctttcccatgttcaaatgtgttttccgttttggtttctaagacggcgactgccggtttccccaccgcatccacccccggtccggccagcaggaaccaggggaaggagagggcatgtttttcccctcagaattggggctcagaagttactcccagcaccgagctcactcaacacagctgtcccctgtcctcccctgcggacttctgtttgaatatattttattttatttttttctagttagtctgtgcttatccatgaacatattttattaataataattaggtagtgtttgaatgtttactgtgtatcatatgatcttataagtactttatatgcatttaatttttttttttgagacggagtgtcactctgtcgcccaggctggagtgcactggcgtgatctcggctcactgcaagctccgcctcccgggttcacgccattctccagcctcagcctcccaagtagctgggactacaggtgcccgccaccgtgccctgctaattttttgtatttttagtagagatggggtttcaccgagttagccaggatggtcttgatctcctgacctcgtgatccgcacgcctcggcctgccaaagtactgggattacaggtgtgagccaccacgcccggctacatttaattatttaatccttagaacaggcttctaaagtagatattgtttgttttacagataaggaaactgaggcacagttcagtcaaagcacatgtcctggtcacacagctagggaggtgcaagcctgcccgcccagagcccatcttcactccgggtactttgaattttgggtctgtggccctccagggagtccatgtgtgcgcacctgggtcaccttttccatctgtgcttgaggctggtggaaggtggctcagatatgctcagaggctgagtaggtggggcttagttaacactgccctggagctcattgagcatttcctgggttcggcaggcaggaagcaccagcgtgttctggatgaaaatagttcctgcctgctggctctccacagctaactcgcctttccacactaattagagaccttcttaagtataatctgttaagactgacaccctaaacatttatttagcttttatttcctgggctggtggcccatagttagagctgcagccagtccccaagaagccgacgccagcagacccctctgtgctgcagctttgtgccgtgggactgctggcctcgccgacctcttgctttatcgacacagtgaccaggagttaaactttgggatgtgcccgtgatgttggaccacaaggacttagaggccgaaatccaccccttgaaaaatgaagaaagaaaatcgcaggaaaatctgggaaatccatcaaaaaatgaggataacgtgaaaagcgcgcctccacagtcccggctctcccggtgccgagcggcggcgttttttctttcattgtttctctgcctttttgtggtgttcgtcgtctcattcgtcatcccgtgtccagaccggccggcgtcacagcgaatgtggaggatagactacagtgccgctggtgagcctcggcttccccgcccagtggggtccaaagcagctcttcccaggggatggggcggagggggcagaactgtgtctgcgagtctagaagtggcctttaaacagtgaatcaatcccaagaggctgccagttctatgtccaaggttttcccggagttttagggagcgatagaccagcctttttatttttgagatggagtttcgctcttgttgcccaggctggagtgcactggcacaatctcagctcaccgctacttctgcctccggagttcaagcgattctcccgcctcagcctcccaaatagctgggattacaggcgtgcagcaccacgcccagctaatatttgtatttttagtagagaccgggtttcaccatgttggtcagggtggtctcgaactcctgagctcgtgatccgcccgcctcagcctcccaaagtgctgagattacaggcgtgagccacagcgcctggccctaattttgtatttttggtaaagatggggttttaccatgttagccaggctgctcttgaactcctgattttaagtcatcctcctccctcggcctcccaacgtgctgggattacaggtgtaagtcaccacacctggcccaattcagtgatttgtagtcagtttgtagagttatgtagctgtcagtacaattccgttttagaatatttccatcatccctaaaagattgctcaagaggctgggcacagaccgcatctctacaaaaaatacaaaaatcagccaggcgtggtggcatgcagctgtggtcccagctacttgggaggctgaggtaggagtatcatttacacctggaaggttgaggctgcagtgagctgtgatcgtgccactgcactccagcctgggtgacagagagagaccctgtctcaaaaagagaaaattcctcattatctttgccatcactccctgttccctcctctcctagccctgggcaacctagtctcctgtctccaaagattagtctttttatttttttagacagagttttgctcttgttgcccaggctggagtgcaatggcacaatctccgctcatctcaaccgccacctcccaggttcaagtgattctcctgccccagcctcccgagtagctgggattgcaggcatgcaccaccacgcccagctaattttgtatttttagtacagatggggtttctccgtgttggtcaggctggtctcaaactcccgacctcagatgatctgcccgcttaagtctccaaaaagggctgggattaccggcgtgagccaccgcgcccggcctctagacatttcttagaagtgaaatcatacagtatgtaagtgaaggagtgtgacttccttaacttagcgtgatgttttgccgttcgtttgtgtcgtggtctgtctgtgtctttccgttgctgagcagtgctcctgggagggttggctgacgatcacctggatggctctcagttgagactcttatgaataattctgccgtgaacattcacgtgcagatcttcgtgtggatatgttttcatttctcttgggtagattgctaggagtggaattgctgaaccctatggtaagtttatgtttaactttctgaggagctgacaagctgttttctaaagcgactgcaccatttgactattttccattcctactacaatgctgaggaggcctttagtttcttgttattgtctgtcttcttattacactcatgctagtgggtgtgaattagaatctcccagtgactgaaaatgttgggtccctcttttcgtgtgagttttagccattcttgcatcttctttggtgaatgtctattcttgcatcttctttggtgaatgtctattcttgcagtcttttgcccatttttagaaattaaaaataatttatttttatttatttatttatttattttttgagatggagttttgctcttctaccccaggctggagtgcaatggcgcaatctcggctcactgcaacctctgcctcccaggttcaagcgattctcctgcctcagcctcccaagtagtagctgggattacaggcacaggctaccatgcctggctaatttttttttttttttttttgagacagagtttcgctcttgtttcccaggctggagtgcaatggcctgatctcagctcaccgtaatcgccacctcccagattcaagtgattctcctgcctcagcctcccgagtagctgaaactacaggcatgtgccaccacacccggctaattttgtatttttagtagaaacggggtttctccatgttggtcaggctggtcttgaattcccgaccttaggtgattggcctgcctcagcatcccaaagtgctgggattacaggcacgtgccaccacgcttggccgtaacttttgtatttttagtagatgcgaggtttcaccatgttggccaggctgatctcaaactcctgacctcaagtgatccgcctgccttggcttcccaaagtgctaggactaccggtgtgaaccaccacgcccagcctttccactctcttgatagtgtccttcgatgcataaaagcttttagtttcaatgaagtcttttttttttttttttttttttttttggagacagtcttgctctgtcatccaggctggagagtgcagtggcgcgatctcggctcactgcaacctccacctcccgggttcaagcgattctcctgcctcagcctcccaagtagctgggattacaggtgcccgcctccatgcctggctaatgtatgtatttttagtagagacggggtttcaccatattggccaggctggtctcaaactcttgacctcaggtgatccacccgcctcggcctcccatagtgctgggattacaggcgtgagccaccgcactcagcctcctgtgcttttgtatcaaagaaaccatcaccagatcccttgtcatgaagatttttcccgttttttttttctaagagttttataattttagctcttacgtttaggtctttgattcattttgagttcatttttgtgcatgacgtaaagattcaacttcatgctgggcgcagtggctcacacctgtaattccagcagtttcagaggctgagacaggaggatcacttgaggcctcgagttcaaggccagcctgggcaacgtagccagaccctgtctctaaaataagggggacggggttcaactttattcttttttttttgtttgtttgtttttgagatcgagtctcgctctgtcgcccaggctggagtgcggtggctcaatctcaactgactgcagcctccacctcctgggttcaggcgattctcctgccttagcctcccgagtagctggaactataggcgcccgccaccacgcccggctaatttctgtatttttagtagagaaggtttcaccgtattagccaggcttgtctcggactcctgaccttgtgatccacccgcctcggcctcctaaagtgctaggattacaggcgtgagccacctcacccggcctattttttttttttttttttattgatcattcttgggtgtttctcgcagagggggatttggcagggtcatacgacaatagtggacggaaggtcagcagataaacaagtgaacaaaggtctctggttttcctaggcagaggtccctgcggccttccgcagtgtttgcgtccctgggtacttgagattagggagtggtgatgactcttaacgagcatgctgccttcaagcatctgtttaacaaagcacatcttgcaccgcccttaatccattcaaccctgagtggacacagcacatgtttcagagagcacagggttgggggtaaggtcaccgatcaacaggatcccaaggcagaagaagttttcttagtacagaacaaaatgaaaagtctcccatgtctacttctttctacacagacacagcaaccatccgatttctcaatcttttccccacctttctcccctttctattccacaaaaccgccattgtcatcatggcccgttctcaatgagctgttgggtacacctcccagacggggtggtagccgggcagaggggctcctcacttcccagtaggggtggccgggcagaggcgcccctcacctcccggagggggcagctgggcccggcctatttttttgtttttgttttttgagatggactccagctctgtcggccaggctggagtgcagtggtgcaatctcgctcactgcaacctctgcctcctgggttcaaacgattcttgtgcctcagcctcccgagtagctgggactacaggcacgtgctactacacccagctaattttttgtatttttagtagagacagggtttcacacgttggccaagatggtctcaatctcttgacctcgttatctgccctcctcggcctcccaaagtgctgggattacaggcgtgaggcaccttgcccggccaacttcactcttttggtgtttgattttagggcataaagtttatcacttgagtccttgaatgaaaggaagtgtaaaccctgacgagtatggagtgtggactgtctagatgccccctggtctagggagggatttatccctgaacagaaggtgccagaacatccaattcttaatgcccagatgtcctgcttgttcctttctgaaggttaacactaggcattgttgcccaccccctggttttcacgaaggaaattactcatcctagtgaggaagaagccaccgtcctcgttgggtgccctcacagtggcaggttccatgtagcagagaagtaggtcgtgctggacctgatcgttcctggaaaccaggcatggcccgcggagtatagtctgtggttttctctttcagttatctatgactttctggctgtggatgatataaacggggacaggatccaagatgttctttttctttataaaaacaccaacagcagcaacaatttcagccgatcctgtgtggacgaaggtaatttcattttatatgaaaaaggcggagctccctgtagaaagaggaatcgtcattttgggtcaccctctcgctttcagtgtttgggggaagcagatggtggtgtttctggaacccatctcgtcatccttcctggcagaccagaaagaggcctggaagcccagtcccagcactgccctggcccctgagccccgtggggtcagcattagagccccgggagcctgcaagatacaggagatccacctggcgggaggggctgtggcctaggagaggtgtgaggaaaacagacctggaacagcacatgctggggctggccggcctgcctgcccagatggtgcaacagtgaggtgccggtgtctctccctacaggcttttcctctccctgcacctttgcagctgctgtgtcgggggccaacggcagcacgctctgggagagacctgtggcccaagacgtggccctcgtggagtgtgctgtgccccagccaagaggcagtgaggcaccttctgcctgcatcctggtgggcagacccagttctttcattgcagtcaacttgttcacaggtaggccagccaggcagcggggttctcactgagggcctctcacctgagccacctcaccctgagggctaatgccaggaggccgcgacgaggctcagccctgtgatcttgagggtggctggatgggaaggaaggttatggggagaacctccaagtgaggctgcaagcgtgtggaaggcacacgcctcggctgccttcagctgcactgtgtctgttacctcccgttacaccttgctggtgggctgtaacacacaggggcagtccgatgtcacctgccatggggtagcagagaggaggagcggcttggcccccggctgctcctggggtgtcagtggtggcagtgcccagggcgagcccagaacatgaaccagcactcggcccgtcaggggagatcggggcctgtcagtgcccctaagcctgaaggtgcaggtctccgagccccagcggagccggcctcgtggaaggacgagggaaagaatgcgtggtgcacggggccatgtgtgtgtgtgggctccttgcacctcatcgcggtctggaagatttctgtgcctagatttggtgaatgttcatatttcccttacaagctgtcattttaaggatatggaggagaataaagagcaggctgaaaatattttaagaatcaaggaatctgtctttaaaaaaaggtttggatgagattgtatgtgcgtaaggagttggacgaggacctgtggtcagtagatctgcctccgggcgcacacctccattcttgccttctatgtggagggcagatgaaggggccactcagctggggcctgcatggcaccaagggcacgcctgcaaccccagcaggaggcaggggcttcgagaggtgggtgaggtcaggcttcatccactcgggcaggagggtcagcatgggccctagaggttccaggacacgcagataggagaaaaggaagggggaactctgcggttcccaggaatgaggctgtcagcgtttggcatattgccaccgagtctccatacacgggcaggacgtgtgtccaccacctccgcgtgctgctccttcacgagcacaggagtgccgccctcccctcctgttggcatctgctctgagtgtgcagtgagccgtgggctcacgagggtgatgcctcaacaggagcctgcctgtcacaggccttgcagttgccgggctgctgttgaaggggactcagggccacgttccgtgaccgtgtgcttgattctaggggaaaccctgtggaaccacagcagcagcttcagcgggaatgcgtccatcctgagccctctgctgcaggtgcctgatgtggacggcgatggggccccagacctgctggttctcacccaggagcgggaggaggtacatcccagcctggctctgctcccaagtcacgaggccacctgccacacggccctgctctacctccccatctgctgccacttcccagacaggattcgggtctgaccacttgccggggactcgcccagagccccacgttcccaactcccatagacccagcatactcagggggctccatctctaccaggcagctttggggcctccccaagaatggtggagtacacacttcccatttgtgctgttgcagtgttgggggtgaagctctgagggctgggagcacctgtgaggcactggggctgccctgcctgcctcatgtgccccgtgcagtgtggaggcaccaaccatcgtggcagactctctgatgtcagcgtgtctttcctcaaaaccaagagcctgtgggccccttacccttccacatctcccattgtagagtgccccgcccccaggctcacgtccctctcttcctgggccttgtgtcattgcagccccaggctcaggtccttctcttcctgggccttgtgtccttgcagccccaggctcaggtccctctcttcctgtgtcatcctgtgtcattgcaggttagtggccacctctactccggcagcaccgggcaccagattggcctcagaggcagccttggtgtggacggggaaagtggcttcctccttcacgtcaccaggacaggtgcccactacatcctctttccctgcggtacgttgtttctgccacatccctggccagcctcactcgtggagcatgactgccctgcggctcctcaggtcctgcttctgctctcgaggtgctggagtcaggaagcccaggggcctggctccatgtggcactgcgtgcccctggtccgggttcacagcgtgaccctggtgacctcgggcccttctgtgttttgaatagcaagctccctctgcggctgctctgtgaagggtctctacgagaaggtgaccgggagcggcggcccgttcaagagtgacccgcactgggagagcatgctcaatgccaccacccgcaggatgctttcccacaggtgggtccgggccgcagcctttctccatgcagagcgcccaccccatggctctgctcgcctgcctcagcgttcggacaatctgtgtggagcccagagcagccccaccggcagggaggtgctcggggtaccgcaaggtcaccctgggctcagatgtgagaaatggtcaaataaaagttgagtaaagagaagaaaggttcccgacgctgtgcctgtctgtctccacggaaagtgggggtctttcttctcttttctgttttttttttttttggttgttttttttttttaagacggagtcttgccctgtcccccaggctggagtgcagtggtgcgatctcggttcactgcaacctccgcctcccgggttcaagtgattctcctgccccagcctcccgagtagctgggattacaggcgcgcacctccacgcccagctaatttttgcatttttagtagagacggggtttctccatgttggtcagactggtctcgaacttctgacctcgtgatccgcccgcctcggcctcccaaagtgctggaattacaggcatgagccaccgcgcccagctcttctcttttcaagctgtagaactgagaaacgggttatgggggcctaagaggagcaccctgagacgggcggtgccagagcctccactgggtgcctgaggccgccccggggacccggcgcccctttctcccactctcctgtctagctctggagcagtgcgctacctgatgcatgtcccagggaacgccggtgcagatgtgcttcttgtgggctcagaggccttcgtgctgctggacgggcaggagctgacgcctcgctggacacccaaggcagcccatgtcctgaggtacagggtttccccaaggaccgcgcaggtgctgcaccccttcccggcatcccgggcacatcccgttggctggcgaggagacagcgctgggggtggggccggaggccgtgtgctgctgcccgggcttcttgcctgtctctggtacttgccccttgccccagacgtcggctccgtgtcctgggccctggtccagatgtggccatgggagactgaggggcggacgtgttcctgggtgcttccttcatctcagtctcctcactgagacccctcgtgagcgcttcctccatattgttccagaaaacccatcttcggccgctacaaaccagacaccttggctgtagccgttgaaaacggaactggcaccgacagacaggttcgttgttcttccttcggaggtggcacctttgttcttagctgaggatagactggtctgaaagcagacggggctgcggcccaggaggctgctgccgtcagagctgctgagaaggttctgcctccctcagagcatctgcctccagggctggcatggctgagggcacgtgtgcctgtgcaagcctcgagcttttcccggtagcccccacgttggcccccacagtgtcccctccctccccagatcctgtttctggaccttggcactggagccgtcctgtgtagcctagccctcccgagcctccctgggggtccactgtccgccagcctgccgaccgcagaccaccgctcagccttcttcttctggggcctccacgagctggggagcaccagcgagacggtacgggagccaccctcggagcagccatgctgggagccggggccagagacccaggctggagctccaccgtggagtgcccagaagctcatcggtgcctgggcaacctcacataagttgaagtccagtgacagtcaggatgaggtggtgcaagctgaggcaaagtgaccttagaggggtccagcgagaaggggctgatggccttcggtggataggggcgcacacagccatgccctgaagggagtggctgccggcaaggaccagtgtcaggaccaggtggggtgggaggacctgggaggtggccacagaactgggggctggcatttgggggacccagatagggcccctagcagacatagagctccaggcacggtcactctgacagcagtgtcctgtgggagtgctcagtgaagggcgtggggcccattgctggttctcgctccaggagaccggggaggcccggcacagcctgtacatgttccaccccaccctgccgcgcgtgctgctggagctggccaatgtctctacccacattgtcgcctttgacggtgagtgtggcctcggccagggacccgggtgttccgcggggtctgccctggctggtcctgagccgccctgacagctgtgtcccccaccctgcagccgtcctgtttgagccaagccgccacgccgcctacatccttctgacaggcccggcagactcagaggcacccggcctggtctctgtgatcaagcacaaggtgcgggaccttgtcccaagcagcagggtggtccgcctgggtgagggtgggccagacagtgaccaagccatcagggaccggttctcccggctgcggtaccagagtgaggcgtagaggcacgccagccagagcctgtggagagactccgcctgctgacactaaacgtcctgggaagtgggcccttccctgggtctctgcactgactcccccactcctgaccctggtgatggtcgccactgggcagcagcagccttaccagtcctccatgatcacacccagggacctgcatgggtgaggggacaccctgggcctctctcccgcccagcatcctccctgagtccccacacagggcctcactctgcaccccaccagggtcccgctcacaccaggcagccttcatagtggtctccctggccaccttgggcagagctgggtcatgcagcaccccatccttacccggtgccctctccttgccagcttctccccaggccagagcggccatcgcgtagaaagaaccagggtgtccccgggacaggccgtcccccaccccatcctgtagaagtccattccccttttccctcctgtgctctgtcccccaaggagtcatggaactcagggtactgggcctcaacgggaacctgagacagctccagcttcgcagcccttcccggagctacagggggatcctctagcatggggggtgtgacttggttcctttgaccaggtcctgtgaggaagcctggagcaagggtctcccccagcaggatgggtggggcctgctctggagctgagcccgtggccgctcacaggtgtccttagtggtgttgcagctgtctactggctgcatgtgctgtgaatatcccaaggaactggctgtggaatgcgtgtttgggtcagtctgtgccctctcagtagacactggagctgctctgtccctgaagaggccccgtgccccaggcatggcaagcgcctgcctctccccttccggtgctcacacgcccacgccgtgccacccgatgcaggactcacctctgtgccttgctgctcctgaggcccaagggcagccatggtgctctgtactgctcgggccgcccaggtcacagagcctgagcttcgtagccaaagcagcctgatgacccacccaccaaggaagaaagcagaataaacatttttgcactgcctgaaaaaccccggtggtcaggcgtgagcctagcgtgtgtgcgtctgcctgtctgtctgctccctaagtagtcaaatggatttgttcctggaggagtgaccaggaatttgctggccagcctgggtcagggtggggagggctgccgaggaggcgagcacccccacccagacctgctcagtcagaaactgggcacccagcaatcttgacatcctctgggggtctccggtttgaggacccctgcccaccaagctgggcaccctggccccatgcaagcgggtgtgctcccacctggaacagacggtggcctcggcaccgcgtgacgtctgagggctggctggagtccagcgtgaagggatgatggtagggccggggtgagctctggtgaccctgcaggcaagaggagcccaggcaggggcttcccggagatgcagctttgggtgtggcggcagtgaggggcaggcaggtgctttagagagccctgcaggactgtcccacggccatgtatgcaagtgtgaaaagccccgcttcagagccacacaggtgtaaccttgttcccattgctccttccaaggcgtggtagggggacgtgggggatgaggttgaacaggtgggtgccctcgtgccaggaagcggttctcttgtccctgagaaaagtaactcagcccagaaggccttgggtatgaaagggccatatagggctctgcggacgcgtcctataagtgagaaccgccaggcgggcagggtggggctggagggagaagggaaggttcactggggttgcaagagctgccccctgacagcacgggagggagggcagggggtccccaaagggaggggtcaccctgcaggtcagaggagcagctgtgcccctggccatggaggggtgggcagggccatgagccccaccctgagaagccggagttgaggggctgggccaaggggtgccattgctggtgggcagaagtttccctccctgcaggaacagcctgcacccccagactgtgaagaagggattcttgccctgtggtcactgcgggccctagagagtctgggccatgccatgccatgccctctgcagctctgtggccttagggcaggctggggacaactgcccctccccagaggcttccttaacagtttcctcactgttccccctctggagggcaggcgtccccacacactaccctgctcaccctagcccaccagagcacagtgccctggctgtctcctcccaaagaccagatgccccaagtctgctgcctgggtctgagagggtcaagtccctcctccaccatcgactccacacacctgggacctgccccctccctcaccacacactgcacacatcacatgcacaatacattcacacatatgtactatacatgtgcacacctcatacatgcaatgtgcaccacacatgcatcctacacgacacgtgcacacacaccacacatgcatgcctcacagtacacctgcacacgtgcactacacacaatcacacgtgctatgcgtacacaccacacgtgtgcctcagtgctacacatgcctcatacgacacgtgcacacacatatgcatgcctcacagtacacctgcacacgtgcactacacacaatcacacgtgctatgcgtacacaccacacgtgtgcctcagtgctacacatgcctcatacacacaacacgtgcacacaccacacatgcctcacagtacaccacacgtgcactacacacaatcacacatgctatgcgtacacaccacacgtgtgcctcagtgctacacatgcatcctacacgacacatgcacataccacacatgcatgcctcacagtacacctgcacacgtgcactacacacaatcacacatgctatgcgtacacaccacacgtgtgcctcagtgctacacatgcctcatacacacgcacacacaccacatatgcatgcctcacagtacacctgcacacgggtgctacacacaatcacacatgctatgcgtacacacacttgtgcctcagtgctacacatgcctcatacacacgacacgtgcacacacacaccacatatgcatgcctcagtacacctgcacacgtgcactacacacaatcacacacgctatacatacacaccacacgtgtgcctcagtgctacacatgcctcatacgcacacacacccatgcatgtgtcacatgcaccgtcacaccataagctgcacccacagcaggatgggctcagagccagggcccaagggtcttttatttgtgtgctggacgctgttgggagtgactggatgtgagccagccctatgggtggggatggcaccgccctaccgccgagagagttgaagctgcacccccgaaaggagccagctgtaccttcacccagtctgggggactggtgaggcacttgggggatggggagcaaggccagctcacgaaggaagacttgggcagggaggatcagggacgcctggcaaggatccaccctatggaatcgggcctcgtcagtggggtgacaatgtcagagttgtctataaatcgggggggaggccgcggcctcgaggtgggaaagcaggtgccggcgcacctgtggacaaattctggaacgcgtttggcgagggaggaataggcgcagctccggaaggcagtgacctcgaggcagcctcagcacggcactctcttgggtcctcttccaggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagtgctggactgaagaccagagaaggtggagctccctgtggccttggtctcacctctcttcaggtaacaggctctgccctgacccaagctgagccaatgaaccccctccctgggaatccacacctggacccattccttctgggcagggagggcttgctggagggagggaggctgtgcaccccacagaagactgggccccctgggcacaaggggacactggtgctgggttcagcagcccccaggacctgggccaagacgggggtggctgctgcattcacgcaggacgttgagctgcagggactagagtggcagatgggccaggtccactaggccaccccatctccacccccagggccacaagccgctgtgggctccacaggggtgggaaggagtgcagggctggggctcgagtgccgtggcctccacgtaaacgggaacacgctgtgggcgagaaggcggctgagaacaggctggccagctggtgtcctgcccacctcactgcagggccccagcagcccccaggccacagccgccggccacagggcactgcctgggctcaccgtctcttcatctccagcgggatcccagcctctgccaggagggccttgtacatgtcagacttcaggaaccttgggtaggagtcctacaagagacagcgtccagcccctgacccttctgcctcctcacctctcagccagctccacccgaaggagcagccaaacattgctggagcctcctccagccacagagtctccggcggacagggtgctggaggcagccgcctcggacctgcccagaccaaggcagacgcagggagacctgggctcccgtctgcctgggccatgtcgcagcaaaaaatggcaagagccctggtggccacgtgtagaggaataaaccgcggcacctcctcagccattagcgggaaccaggaatggctccgtgtgccccacagagtgagggcagggttgtggagtcaaataaaaaaacaaggtaggccacgcatggtggctcacgcctgtgatcccggccgggcagagtggctcacgcctgtaatcccagcactttgggaggctgatgcgggtggatcatgaggttgggagatcgagaccgtcctgggtaacacggtgaaaccccgtctctactaaaaatacaaaaaattagccgggcgtggtggcgggcgcctgtagtcccagctactcaggaggctgaggcaggaggatggcgtgaacccgggaggtggagcttgcactgagccgagatcccgccactgcactccagcctgggcgacagagcgagactcgcctcaaaacaaaagaaaacaaaactttttagatcgaagcttgacccttattaagcatgtgatctgggccagtccttcagcctgtctgaacccggagtgggctcaggacggaacactgacaggagagcggccagggcggccccaaccaggtggggaaggtgctccccaggggcagagtcaacgtgggcagtgcctgtgcggacagagcccttgagggtggggacatggaggcccgtctgggatgacccctcctgcccctgcaggctggcccagcacccaccttcttcatgagcatgtatatgtgcagctgggcgtcatccaggacatagcggtggggctggcgcagcccctccagggtctgctccatggtccggctgtcgatgttgacccagtgggcagctccgggggccaggaactgcctaggggtggggacagcactgggtagtctcggctgggtgcacctgcccgttggccaaccggtgcccaccacgcagcacttactcgtacacggcatccaccagggtggggacctgggcctgcgctccatatcgaagctcctcacatgcctcccagaagctgaggttttctcctggggggccgggcacccagtcaaggatcccatcgagagtggcagccagggccggtggggggttcccagggagctggtggaaaccgaggcgggaggggtcccaggcagcagcctccccgctgggactggagcaggggctggggggttctcaccactgaactcctttcccagaaagtccatgaagtgggcccgccccacggggtcctccaggagctcccggaagctgaagccccatctctccacacggagcttcgtgggggcagccaccctggggagagggcagggctgttggggagggtggggactgaccctcctgcgtccccccaggctgggagcacacccgcagtcccgctgccccgcctgggctcacgtgggggcattcatgacccagtaggcgtcattgtctgagatccagggattgctgggcaggcaccccgacacgaggggatcgtggggtccacgctggccgcagaaactcaggtacctggaagggggtatgggggctggtgcaggaggggcctcagcactcagcaggggtctccagctgccacccctcaccccactcacgcctcaaggcagacggaggacttcactcgggtcctgcccagcgctttcctgaagtactcgatctaggatgtggggcctgtgagtcaggtcccgggctggggaaggcacctggcaccctccactcccagctccagaacttacctcccgcttatggaaatctgcactcttggtctagaaggggataggtgggctgcagttagatgcaggtcccctgctggggtccaaaatccccagcaggagggcacctccccaggctgagcccctgccccatagatctggcagagatggtggcccaggcccccagtcccgccccttggagccccttcttccaatcagggatctttcgaggagacctctgggggcctaaggtctggcgatctgtggaatattccacggaacctcaggttctcaaagttgcaactgtaatatgtcatttttttttctttattatttttttgagacagtttcactcttgtttcccaggctggagtgcagtggtgcgatctcggctcaccgcaacctccgcctcctggattcaagctattctcctgcctcagcctctccagtagctgggactacaggcatgcgccaccaagcccagctaattttgtatttttaatagagacggggtttctccatgttgatctagctggtctcgaactcctgaactcaggtgatctgcccgcctcagcctcccaaagtgctgggattagagacgtgagccaccgcgcccggcctaatatgtcacattttcaaatgtacttaaattatgtttttaaacaacacatacttgagaaatactactaatggggatcactggggaaccaggtgtgaccttcattggtcggcacctcgctggggccagagcggaggaggcggacgcgctgcgagtcctggcctgtgtccccgctctctctgaccagctttgtatggggaaatgttagggtcgtgaacttaagaagttttatcagtgaggttctaggtgcatctttccagatgttgggtctggatgggactggtttgaacaaagggttttgctgctgcggggctcagatgctccctctggtctggtccctctggttctggaggcctccacctggagggaggttgctggatctgctgaggtctgtcagaggccgtaaccctgcttgtcacccctccaattcccagcaaaccctgatactgttctggagaagagcccccttcctccccgccagccccctcgtccccaccactccacttacctgcacccagggcagcaggtgggaggggagagaaagcgagagttagcaggggcctggggaacagggagtgaccgggagtgagcaggggcttggggaggctgcaccaagtgccctctgggtggaccaaatgacggacagatgggcagtcccatggtgcgtccagcagggtgcagccggtgtgcagggtgagagggcggccagcacgcacgcaggggctcaccatgagcacacggctggcagcgcaggatccccgccctggaccctgctccagcacatcgggggccccgggctgcggaggggagacgagatgaggtggggatgcagttccggtggctgaccccctttaaggctaagttccccctcccagacccccatgtggaaactgacactcaaaggaactcgggaagagtcccgacctagccgtcagctgtctcttctctgctcaccacctccaaatggcctgtccaccgggcctccccacagccccagctgctcccggcctgtgaactcggtccccccactgcagccaaggccgccccccactctgcctgctcccgaggcagagtctgcagtccccgcaatctggcatccctgtgactctcccttgggcccagagagaagctggcttgtcctgtggtctagggatggagacctgggttctgattggcagaaacgcaactaagtcacgaagtgaaaacgtcctgcccccaccaggagctccaaggcaggtccttccacaggctcaaaatggtggtcctgagagcgcctgtcagggaagcacgctgacccctgcgctggccagcgacccccaccctcaccgcaggtgggctcaccgggggcctgttcaccagccagtaggtctgctcctggcacgcaatgaccagcctgtcccccttgctgcgctgcttggctgccctgggaggaggaggccgagttgagggcacgccctgcacacagcagcccctccgcccccaccctcaggcctggacctgggcaggcagccacacccaggggtgccctccacggtcccagggccaccggagcctggcctgggctgggcttcccgggtagcctgggttgggcgcctgcaggcggggcggggcagggcggggcctcacctcagctgctccctcgcctgcatcagcaccaggtcccatgcgtggttgatcttcttgtgtagccggtcatagcagtcctgggggcagcgaggtttccagtgggtcaccccggcccctgcccccagtgagactgtgtgggcagttggggggttggggactgtcttgggttttggggcctgggctgtatgttctggggtaaaccgtgaagccccggggggccgtgagtgaggcttgggttcctccagctgtacccagccggggcgggaagggtggggggtcccaccttctcataatccaccagggtcccccgttttcggatgttcttcttggccaggtagatggctggaagaacagggacagcctgcagaggggccagctctgccctgcctcacggcatcaccctgaggcccccagtcctgggaacttgtctggggccagccgtccccttgctcaccatagtccagctctgcagccggcctcagggtacttgtccagaagtacggggtctggcgtggtgcagggagaaggtgtccaggacgcctgcgtctgtgcctccccagtgtcaccccaccctcagacctccctgggaagaagcctgggctgggcaggaggtgtctgaggatctccctgcctgcccaccaccgagagactccactgaccactggccagtctctccaactagaactgaggtcaactcgctccttagggccctgttcagacactgcctccctcactggtcaccctaagcccccattcaaggcggggtggggctgggggcctgcacaagtcttggatgtagtcacagtctgtgcctggggaggggtacaaccgacggcaggtcggcccgggaccctgatgtggttagggagggcaggaatgctgtcctcaggccttcacagcccctccctcaggacctgggcctagggacccccaggaagatggcagaatcctctgcacatacgaccccttgtggggccctgctgtggtccccaggaaaactgaggctccatccctcagccgggtccttctcaccacatccgtacttgcggtccaggacttttggggagggggcgatggaccaccagcccacggcgacatggcggagtcccactccaatcccagcaagctcggcgcccctcctgtctccccgagttggtaagctgggtgggtgggggtgggggtcccaccggctcccacctgcacccccgagcctgacctggaacctgtagggcgtctcgtctggccggagcatgaggctacgggggtcgcgcagcgggtagatgtagccatgctgcaccaggacggcgcccaggtgcagggcctctggggaggggtgggacggtgagcgcggggccgcggaagcgggcgagggcgggacgagccgggcctcctctcccctatgtgctccccacccttgcacagcgcgctcagcagggctctgagaactgccagactccaggaaaacccaggcctaggccaccagcccagtgaccccagggcccagtgggaggcagggcgctcaccctcctccgagacgcagaacttctgggccaaccactgcacgacgtcgctgcctgcacgggagagacagaggtggagggaggccgaggcgcgcacgcacccccgccccggcgcgcctcacctgtcaccgcgtggggaatgacggtgaccagcaggcgctggctccgcatcttcacgccctggtcggggtcctgcatgctcacgaccacccgctccatctgggcggagggagtcgtcagggggtgtctggccgccccgcaaccctgattccctggcaccggccgggatgccccggatccgggagcgcggagattaacgcgcggcggcggcggattccaggccgcagctggcggcggggacgcggggcgggccggggagggccggggagggccggggagaccccggagacccccaagggccccaggcctcgccgcccctcccggcctcgcagacctccgccccaggcccgccccgccccgcgcgcccccgtgtccccatgctctccggcccctcccggcctcgggcgccgggaaatcgggggacggcgggacacccacccgcctcgcaccttcctcagatgcggcatctgcgcccgggggcggccggggggcggcgcggggccggcggccatggctgcggggcgaggccggcggggatgaccgacgtcccgcccggccccgccccgcgccgcgccgcgcccgggttaaccctcgggccgcgaggccagagtcgcccaggccccggttcgggttttaagagacacggccacggcccagaggcaaacgagccggccccccacgagcgacccgagtcacccccccgacccaggtcccgggacgctgaggccctcgtgggtgaaggcgaagtgggacgggggagggtgtgggccgggggccgaggggggatgtgaggggatggagctcagctggagcagggggtggtctctgggagaggcagaggggctcatcagcgagggggggttactatggggagggtctcagggagggcagcggaggggatgggggttcagagagggagaggggttccgtgagtagaggagacccgtagggagagtgaactggggtgggaaacgtggtttagggcccactgtaaccccggtcctatgtgtggggccctgaggacatacagggactagaggcctggctgtggggccggggccagggccagcggtatgactgcccgaggccttgtgtcctgcgatgcttgtggccaagactgcatacattgctgtgacggtggctggttaggggcagggtgcatgagagattgggtcagctttctacatgggccggatgccggctgtcagtggagcacgtggctgctgcagagtgtgacccagctgtccccatctcctgctgtgggtcccttatccggggtccttccgggaaagtggctgatggctcatggctcacttccctcagctccacgcaggcctgggtggcccgctggggaatgagcagaaaccctgcccagggcaccctgacactgttggagaggagctttactgcagggaggccctcaacacacacccacttagtgtcaccggcggccgccaggcttcaggccccactccactcccagctctctccctcctccaatggctatgcctgtcccccaggtgcaccccgagccaggcccaggatcttcaggccccaccgggcagtctcggctcactgcaacctccgcctcctgaattcaagcaattctcatgcctcagcctcctgagtagctgggattacaggctcccaccaccacgcctggctaatttttatttttgtttttgtttttgagacggagtctcactgtgtcacccaagctggagtgcagtgatgcggtcttggctcactgcagcctccgcctcctgggttccagcgattctcctgtctcagcctcctaggtagctgggattacaggcacgcgccaccacacccagctaatttttgtatttttagtagagatagggattcaccacgttggccaggctggtttcgaactcctgacctcaggtgatgtgcctgccttggcctcccaaagtgctaggcttataggtgtgagccactgtgcctggccgattttggtatgtttagtagagatggggtttcaccatgttggccaggctggtctcaaactcctgacttcaggtgatccacctgccttggcctcccaaagttctgggatgacaggtgtgagccaccacacccggtcggatcattttttaaaaactaagtcgaggtctcactatgttgcccaaggtggtcacaaactcctgggctcagtccatcctcctgcctcagcttcccagcgtgctgggattaaaggcatgcccagccagcatcttttttttttttttttttttgagactgagtcttgctctgtcaggctggagtgcaatggcgcaatctcgtctcactgcaacctcctcctcccagattcaagcaattctcctgcctcagcctcctgagtagctgagattacaggcccccgccaccacgcttggctaatttttgtatttttagtagagacagcatttcaccttgttggccaggctggtcttgaactcctgaccttaggcgatctgcccacctcggcctcccgaagtgctgggattacaggcctgagccaccgagcccagcctcagcaccatttttaaaaggtgcaaatgcatctatttctgcttgctttctttattttttaaattatttatttatttattttgagatggagtttcactcttgttgcctaggctggagtgcaatggtgcaatctcgggtcactgcaacctccgcctcctgggttcaagcgattctcttgcctcagctcccaagtaggtgggatcagaggcatgcgccaccatgcccggctaatttttttttttgtttttttttttgcatttttagtagagatggggtttcaccgtgttggccaggctggtatcaaacttcctgacctcaagtgatccacctgccttggcctcccaaagtgctgggattacaggcatgagccaccgcacctggccactaattttttttttaatttcatttttatttttgtagataaatatacacgtagcccctcgcttatccctgtctgtaagggcctcagtttcttgctgtgttgcctaggctggctgatcttgaactcctggcctcaagtgatcctcctgcctcagcctcccaaatgttgggattacaggcatgagccatggcacctggctatgtatttattttttgagagatggcagtctcattctgtcacccaggctggagtgcagtggtgcaatcataaactcattgcagcctcaaactcctgagctcaagtgattctcccaccccagcgtcctgagtagctgggactacagatgtgtaccaccgcatctggtctatttctgctttcttggaggcagagtacctctccccatccttacccactcagagggtgctaggggctgggcagggtgggcggttggccttgggctgggagcccctaacatagtggtctgagtccatttccattgccggagaggccacgttcagcatgagctggggcagggggcttgtggggtctcttactccagggtaccatctcgcttggatcccagtgagccctcccatgccccacacccaggtggggtgaggtggcccaggtctggctgccctgtctgcaggggtgggcacccatggtagctgtgaggcagaatagggaatgagggtagccaagggttgggcataagaaacggaacagcaggtgcagccagttctaggcaggattgggcagctcacaagccacatcctggctgctgtgataacaagacagaaatttccacttcacctctgattggtctcgggccaatccttcatagggtgtagccaattggaggcctctaaagggcacaagggctgtggtcaggtttctttgcttaataaaaatcctaattacagaggctctggagctacttgctccagcccactcccactctgtgaattgccttccgttaaatctgtgctttccttactccgttcttctgactcagttttgtttccttgtgtttcgttgttcttttgttactttgtgcgttttgttcaattctttgttcaacccaccaagaacctggacaactcacctccaagaccttctatctggtaacagctgcaggagctggagctgtgggcctggggacaagtgtcctaacagcccccgctccctgcagcgaagggtcagcagaggtggcgctctaggggggcctgggcacaagttcataggatcctgccctggaaaggttgtgggcagttggggggcaagggagacagtccccacccaaaccccaatgccccctagcacccaaggtggtcttctctcaattgaggagctctttggcaagggcgggtctaatttctggtgtccctggaaccggccaggggtgtctaagaaagggactcaggctggtgttcggaccccttctcccttatccagacgcaggcctttggtccagctgtcccagccagggcctgctcacccctgtcccctgccgggtcccatcccccccacccacccacaggtctcagtttaggtgtcaatatcagaagccccctctgtgctccggtctctgtactccgcccccttgtcagtgtcctctccctgaggacagggggctcggtaactgggtttccaagagccctgcagggacaccccctcttgggaactcacacagcgcagccaggtcgctaagcctttgaggggcccttgttgcctcctgggtgtgcgtgcgacccgcgcccactgtggtcccgccctactgatgaccgtgaacctgtagggtgttgggccagcccctcaccccaaggctgggcaggcccccggagtccccctcggcccagacagaagctccctcaggagcgggggaggggaagggggcgcgcggtccggccccaggtgtggccgcggataatgagaccctggggatgggggcgcacctgcgccacggcgccccgcagagggtttcccaggagaccccctcgggctcccgccgcgccgtgggggtggggcagccctgctggccagagccgggcacgggccgggcgggcggcggggatcgtgaccgcggctgcgtgcgtccgcgtccgggcgcttctgtgcggggtcctggcacgccggcgggggcgacccgggtgccggcccgtgcgggcgacacgcgcgtctctgcggggctgcgcggggtccggagcggctgggggctctctgccgggcgcggctgggcgcggggggcgctcccggccgggatgagctcaccgcagtcgcgccggggctgagcgccgagcggggcggcggcggggcgggcggcggctcctcggcggctccgcggcgcccgggccgcgcgccgccatgctgggcctggacgcgtgcgagctgggggcgcagctgctggagctgctccggctggcgctgtgcgcccgaggtgagcgggccgggcaggggcggggggctcggctggtctcagccccgggcggggagtagcccctcccccgcggcaactttgggggcgcgcatggggacctcgcggcgccgaccccccggctggggtctggcaggggtgggggacttcatccaggctccagccctgtggggaagggaccaggtgcggacgggtcggcttgggaagcggcggcgctgggaccctctccccctggacaccgccgcctggagcccctctgtcttgggtggggctggggctggggctcaggctctgtagggcgtgtggtgatccccgagaagacgggagcgaagtgggcagggactcagaaacccctgcccagggcaccagggagaggggcttcaggaggccaccagcccggggcgccatgggaggcggcgcagagcctgagcccagggatttggagacagccgcccccggcacccgagcaccatggggaggaactcctagactgtgggaaagtgttcagagaccccagtccagagcagggtggtggagggccctagagggtcagtaggcttggggggccgccgagggccctagagggtcagtaggtttgggggccgccgagggccctagagggtcagtaggtttgggggccgccgagggccgctgctctctagcaggtagcccctgaccctgggctgccctcatctgaagtcttcgctcccccgccctttggtctccgagtcagggagggggcccttgtggacatctgggccagaggagctgcaggcctggcggtctctggaggcccctcctgaaggtctgggtgcggtgcggcacctccccaggccgccctgctctctctgctcgctctctccctgagcccccagaggcttcccttgagtccctttggatagtgggaggtacagctggccagagggggctccagcctggtgctcgaatgccagggtccgctagtggctgctgctcacgcccctccccacccccagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtgggtatggcaggggtctaggcttggagggctgggtctggggggctggtgaggagcctggtgggggtggggggcatcctgcagacttccagtttctcctcagacccaagcctgcccaatgtgcaggtgaccaggctgacactcctgtcggaacaggctccggggcccgtcgtcatggatctcacaggtaactcgcaggatgctgcaccctgaacacaggtagggccctcccaggcacgcttctgcacccctgagttccgagccctgggccatcacagtcgcacacctcatgggtaccacaccctacgtgggggctcctggagcaggtctcagcctgtaggggagttccgaccctagctgaggtttccccaataggggacctggctgttctgaaggaccaggtgtttgtcctgaaggaaggtgttgattacagagtgaagatctccttcaaggtgagagccggggcaatgggcggaggggatgggggtgggggcaacagccagaggcctggcccccagaggaacccctaatgcctctgttcccaggtccacagggagattgtcagcggcctcaagtgtctgcaccacacctaccgccggggcctgcgcggtgagggcagcggtggggggaacggggcgggggggggaagcgggggcagacagaggacagctctgatgccctcgccctccctagtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaaggactgaacccccagtccgtgtctcccctacctccctcagttgttgcacagggacccccaagcatccccagcaccccccgtgagtgaccagaccctcccctgctgcccctgctgcccctgctgcccctgctctgtcccgggaccccctggcctggcgctgtcccctgagctgtcccattaaacatggccctgtctctctcggtgccctgggtgtcgtctctttctgcctcccctcccctgggggccgggggcggccgcatgggccttgtctttgctgggactgggcctgtgtgccacgtggcagctgctgcttggcttctggcccccttatctgcccccgccccacgcgccctggcagcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctgtgagtgctggggccagtggggctggggaccggcgggggaccggcagagcccacctgggggccccaccctttgccggcaaatgcagggcatgtgcccaagaggggcctccccgcaggcacttgcccccactgtgcccaggagctctctaggaggggcctgggggtctggttggggcaggcaggagcagtgtggtagtactgggggtacccacaggacttgagaacacctgtgcctccctgctcggccagcggccacggtgccagagtcaccaccttgccggccactcctccagctgccaggggcatcccacagactctgcagaggctcgggcagtatccaggctttgggggcccatggaggtccctgacgtgtgtgccctgtggtcttttcgcaacccttgacacacataggaactgttcttgcctaggaggccttcacaggcagccacatgggcccgggagccccagccatacaaggcacgaaagggaggggtctttttatttttattttttgagatggagttttgcttttgtcgcccaggctggagtgcagtggccctatctcggctcactgcaacctccgcctcccaggttcaagcaattctcctgcctcagcctcccgagtagctgggattataggcatacgcaaccaatcccggctaatattttttgtatttttagtagagatggggtttctccatgttggtcaggctggtctcgaactcccaacctcaggtgatatgcccgcctctgcctcccaaagtgctgggattactggcgtgagccactgagcctggctgtggggggagggggggtggtctttcaagctctcccaagccttactggtccctgtgctgcagcctggggggccacgaagaggcactggtgctcggcttgtccacggccagggctcagggcagaatggagcagcacgcttgttccctgctgggttgtcaggtgtggagagggtgctcctggggttgtggtggcctggggcactcacggccccatcccccagatgccccgtggtgtgggcactgccaggccctggcccccgagtacagcaaggcagctgccgtgctcgcggccgagtcaatggtggtcacgctggccaaggtggatgggcccgcgcagcgcgagctggctgaggagtttggtgtgacggagtaccctacgctcaagttcttccgcaatgggaaccgcacgcacccggaggagtacacaggtgaggggcaggccggtcattgggggggcggtggccaggccgaggctgagggggactccctgcaggaccacgggacgctgagggcattgccgagtggctgcgacggcgggtggggcccagtgccatgcggctggaggacgaggcggccgcccaggcgctgatcggtggccgggacctagtggtcattggcttcttccaggtgagccactgggcatggggggccgggccatgagggcagtgactgtgggtgggaccgggtggcctcacagggccaggcccctcaggacctgcaggacgaggacgtggccaccttcttggccttggcccaggacgccctggacatgacctttggcctcacagaccggccgcggctctttcagcagtttggcctcaccaaggacactgtggttctcttcaagaaggtaggtcaggcccaggtgtgggttggggtccggctgcagcgcccgctaacccacctgctgctgtccagtttgatgaggggcgggcagacttccccgtggacgaggagcttggcctggacctgggggatctgtcgcgcttcctggtcacacacagcatgcgcctggtcacggagttcaacagccaggtgcgtaggctgcagtgcctgggctgggggtgtcccagggtagagtcgtccagggatgggggtgcctaggctgggggtcctgtggagtcatgagcaccctccctactgtagacgtctgccaagatcttcgcggccaggatcctcaaccacctgctgctgtttgtcaaccagacgctggctgcgcaccgggagctcctagcgggctttggggaggcagctccccgcttccgggggcaggtactggggggctgggggaaaggggcagcgggagagtggccggtgccagcatggactccctgccacaggtgctgttcgtggtggtggacgtggcggccgacaatgagcacgtgctgcagtactttggactcaaggctgaggcagcccccactctgcgcttggtcaaccttgaaaccactaagaagtatgcgcctgtggatgggggccctgtcaccgcagcgtccatcactgctttctgccatgcagtcctcaacggccaagtcaaggtccgctgcagactgctcataatggaaggggaaccctgacctcatcccaccagcttggcagggggtgggaacagcagctctcagagccccctgcccctgcaggccccgcagaggcccccctcaacccggcaattctcccaacccggcggttctcccaaccccaacccggcggttctcccaaccccaaacccgcggttctcccaaccccaaccccgcggttctcccaaccccaaccccaaccccaaccccaaccccgcggttctcccaaccccgcggttctcccaaccccgcggttctcccaaccccaaccccgcggttctccaaccccgcggttctcccaaccccaacctcaaccccaaccccacagaggtccctccccccaccaaaccccacagttctccctccccccactaaaccccacagttctcccaaacttgaagaggacctccctgtcaggccctgcagaggatctcccccccacctgcccccggccccgcacaggacctcccccccaccgccccccccacacagaacctccccctgccgctgaccccgcacaggacctcccccccaccccccaggccctgcacaggacctcctgaaccctgcagaggacccctggcaaagcgcctgtcctggtttcccccagccctatctcctgagccaggagataccccctgattgggatcagcggccagttaagaccctcgtgggcaagaattttgagcaggtggcttttgacgaaaccaagaatgtgtttgtcaagttctgtgagtgttgagggaggcaggggtggtgtgggctgggcaggggctgcccagatggctgtgctcaacggctcccatcctagatgccccgtggtgcacccactgcaaggagatggcccctgcctgggaggcattggctgagaagtaccaagaccacgaggacatcatcattgctgagctggatgccacggccaacgagctggatgccttcgctgtgcacggcttccctactctcaagtacttcccagcagggccaggtcggaaggtatggcggacaggtggctggggaggaagccggggtgccatcttgctgggcatggggctgggccccacgtgtcctccagatccccctgcctcttctcaggtgattgaatacaaaagcaccagggacctggagactttctccaagttcctggacaacgggggcgtgctgcccacggaggagcccccggaggagccagcagccccgttcccggtgggtgtccctaagccagggctccaggcctctgcacaaatcctctttacacagggctggcaggggcgggggcaggggtaggctgggagcagagcttcgagctgcacttgtgaccctttctaggagccaccggccaactccactatggggtccaaggaggaactgtagctgcccccgtgtcacccccgccatcactgctggacaggagccacccccttgggtaccagagggagctgtgcattgtgaataaagagtgagcttggttctggactctgtgtgcctggtccctcagcaaggctggcctgatgcagctctgcccagctgggggctccagggcaggaaggtggagcacgttcctgctctagccctgccagcctctgagtcacaggtgatccccatgcctgctggaggccagtgtgccctcctttaccacgggggctgaggctgggagacctaggccaggccccacccgcagaagacacaccacagccagggcaggttcaaaaacagttttatttcattattatccaagtacctttgaaaagataattaattgtacaagtgtcatcgcatgaaaaacagactcgggcagcccctgctggcctagcctgagaaatgtacatatttacacgggccctcagaaaggaggacccaggactgcacagccggcggctggaggcaggtgcagtgctccgtcgccgattcacacagtggcaggcaagagacaagctgtgttgaaggcactcggtggcgcgtacaattgacagaggccctgcaggcctctgcatccgggcctgggccccacccagacctgggtacgtgggcaaatcccagagggaaagtagatcccagcacacgtgcccaagggaggtgccgggggatgggggggggtcacctgaagctggcagcagggacctcggctgcctcacttgggctgggccctccaagtattgctatgaggagtggtccaggctgcctccttgggggcaggacagaagcttgtggaccacttggagggaccccctacctgcctctagacacgggtagaccacagggatgggtggtacacccaacactgttccccatcgggctcctgagtacgaggtcatctgcctggccgtgacacccgtgcccgccaagggcctcgcctggcacagcggccagcccaccagcctatcagtccaccttctccactttgccgatgatcttctcctcaaagacgggcaggacggcctcgtcctctcgaacctcctcaaacaccaccccacagtcaaactcgtcgctcactttcttgaagtagtatctgcaggacggaggtgaggagggcagtgagcaggcagcaccgcagatgggaaggaggcctgtggcaggggacggcgtgtccacaccccatcccgaggagcctcctgtccatgccccacggcccccactgcatgtgcgccccctcccagggcaacagtgaacagtgcaatgaccacatgtgggtgaagtgggcagccatggggggtgagttcactgcctgctgggagcaccccacatccccctgggagtacctgccccagcctctcaggagttgcaggggggaagtggacgggtgtggggtgtctgcttcccaagggctgagccccgtcatggaggtgaccccaactggggccctccctcagcaccacatctgcagtcatggggtgtttgcacagtggcttgtggacggtgggaaccacccgccaggctctgccaggctcttggggtcaggccccctctgctcaccgcccagtgctcactcgggagcctccaaggctggctgcacgcagggccctgcagggctgagtggcccagggcgaatgaaccttggtaggagggggcttggcttttcagtcaggcaaaagcacatgagtccagagcctggagacaaggtcggcctaggggagcctaacacaaggttcagaccatcgtcgtctaggggtctggcctctgttttcccaccccgaagatgagggccctggacgggggtccctttggaccctctcagtcctgtggggccgaaagcctgatgccaccctcagcctagggcttggagaagtggctttagttgcagatgagggacatgagctgaaatggccggaagccctttttcttctttttttttttttgggcgggggtagagacagagtctcgctctgtcacccaggctggagagcagtggcgtgatctcagctcactgcaacctctgcctcccgagttcaagcaattctgcctcagcctcccaagtagcacacctggctaatttctttagtatttttagtagagacggggtttcaccatgttgcccaggctggtctcgaactgctgagctgaggcaatccgcccacctcagcctcccaaagtgccaggattaggacgtgagccactgtgcccggctggaaaccctctttttcataccgttgggcacccacatactcgtgcggggagggggcaccccagccctcacactcacctgtagctgccctttttggtcagcagctccttgaactggcccagggtgacagcgcggcccctcaccagggtgcggtaggggatgggttccccgcagaagtagtacgccacaacgatgctgtcacacggctgggcactcccgccgcccaccttcctctgcgatcttgtcctggggaaagagatgcagcggtggtacctggttttggactgaggtcccacagggtccctcctgctggcctcaggctgccagtgtaaggcggggcaggcctgcaggggtgagcagcaccccattcaaacacctggggcccgcagcccccgcacagcatctcaatctgggatctagtccgctagcagtggagtcggctccgctcactgggagcacgaaggtctccctgctgcctcacagccccaccctcgactggccagggcctggctgccaggtgcactgcagctcccacctctaggatggcagggcaggctgcagggctcctatctcaggaagacctacggcccccaaaccttaaaaacatctgaagggcagggattggacaaacagaactgtgcacgatttctggataagcctgaccccgcagcgaagtttgtcggaggactggggcgggggtggccagcaggcccttcagagggggcagggctggcaccgtctcctgcccaggctgagccgggccctcctctgacaggtgctgtgcttccacagccgtgccgggatgacgggcggggcctggttgctctcgcaccccccactcggctaccccgccgccacctgtccttcaagtgactccagaagctgcccctggcccactggggttcagcccttgggcctcctcctggctgggtgcaccagaggcttccagagccaacaccagggcaggaaggcctcatggccacctgagccatgtgaccatcctctttgcacaccaggcccccagccacgtgcgctcttagacgtcctcccagtgccacatcctcggagcctcctggagccaggcccatcagagaagagccaacacgtgggggctgccccagggacaggtgaaggctgccccaagaccgcctacacgatgagggccacaacaaacctgcatctggggcaagcctggcaaggcctgggggacccttgttctcaaggccccttttggggtgtgccccctcctcctgccaccttgagcacataaaggcgccgtcgacacggcccatgtgggatcacatggtctgagccctttctcacgggttcagagcagtcagcattgtaggtgggagcagagccccgactcactgactgcacgggctggacagacacgcatggctgagacccacactgcaagcagacgcaccccgggcacctcagcacctgcagccccgagcctggtcaagtcaggcctggcagggaccggcccgttccaagccgggtggaggcgcaggcaggtctctgccccacaggaagcctggccgtgacacctgtgtggatgcaggggctggctgtgcccaggcctccagccgggccttttggtcacttgtcatcatgctggacagtcagcgtctcctttgatggagacaggagaaggctctcgggcagcttcgagtctgatgccacgggaccctctcctgccacagctgcttctgagcgtggtacccgagctcaagccccgggacggcggctctacgatgggacctggcttgggacgccagggctggggtgggcaggaccgggaggaccctcaggacgcacgtactctgtctcggagagctccatgtccgacacggctggtaccacgtgcagcaccggcgcgcacgctggcctgacgcaggcgcgtccccgccgcataacctcctgcacatacctagggaacaacccgcgtcaaaggtggctgtgccggcggccaccagccctggggagggagcctcgaccaatgctgctgcgcagggacggacggagcgtgaagggcccgaacaacccaccctgcgcaggctccagtttgcagggtagacaagacaccgagtcccctcctaggcctgccttggtggtacccgatactgcagcgcgccccacattcatgatcccggcaccaaccccctgagttccctggaccgcactttggggagcttccgatcaggggtgctgggatcccaccacctcatcccctctggtgggatgacatctcgtcccgagagtctgtccttcagtctcttggcatgaattccccaccgatagcgtggacactggctctggggcgtgcgtggcaactcggtctgcacctcagggaggctgagggccccccggcgccacaactgaggccatcctggggcagcacagcagctcctctcacgtggacacctccaccggggtacactgggcgaccttgatggtggtttctactctgacatcctgacagggcccagcacccaacctgcctctgggccttcactccgtctccacagcttctcgcaaaaacccacatcccctggacggacaaacccagcaactctgggtttccccatggggggatgctggagcccagcagccaaacgggcgggagggtcgtgtctcagaacggcgggagtggtcccacggctcagcgggcatcccctgccatcatgtggggccacgggtaccaggggaaagcgcagacgcaacctgagagacccctgctcagcccagcaaggatggctcaggaagccccggcaggagagcccacacacgcccagggcctcggacctgctgcacacgatgcccaccacggctcatctgccagcccagtcacacgccccggctccgagcaccacactccaggctcctgcatggcagggggctccagctccttgttggccgaacacgatcacagggtcacagatgtttggtcataaagtggtcaccctttgggtttgaggtaactgtgaccctttctggccccagagctgtcattaggctcacagcctggcagaagctcaggaacctttaatgacttgagaccacacaggctttcagctgggaagggtctgaaccctgatgctggttcggcagaataaggcccctagccacagcctccctggagtggcacagccccaaagctggaggcccgggaggcgggcctggaccccaggccccaggtgacccaaggtggacaggaggagctggtgacctctgaaggcaaccatggcctctgtgaccacagccccagggcctgggtgagctataggctcccaggaccctcaaagagacactgatctgtggggaattccaatgacccaggatggccgagaaaactggccttatgagcaagctgaaaatggagaagccaggttctggcctggagcgaaaatgctgcccacacaaaggggagacctccctgcagcccagacagaagcctccctgccctagggagagaacagggtctggctacggagcccagaagaccaaggagggcgcagtgaggagggctgtgggctggacgtcccggatgagagaagggcacagtgaggagggctgtgggctggacatccaggatgacaagaggacacagcgaggagggctgtgggctggacgtccaggacgacacttctacatctgcacggctttcagaaccacgtagctttccgaccgtgcagagccactcagggctcctgggacgcaactgtcaagaggcagccgccatgcctccaggacctctgccctaaagcccaggctgcccagcagcgagcagcctctggctggggaccggcgttccccacacactggggccctgcagcctccctgcagactgggctcaggttgaggagggaccccgcctccagagcaatgagcgcggcggcctcgggtgtgtgaaagctccagccccagcctccgtccaccgcagggtggcctgccacgtggcccctcagtggttctcagtggatggaagggcccagtatggctgggggacacccagagggccgtttttcccctgaagacctcaggcctcggggagcttcagccccaggagtggtgctgtggtaacccccaagacccaccccaccccacgacgcggccgtacctctgcttggagggtgctcggctggctctcttttcttcctcctccagacgtcggcgcgcctcctccagctgggttagggggttgggagctgggtggggtggcatggtggggtcttggatgaagaggtgggagggctgcacggaggtccggagctgagggccggcccaggggtgctcaagggacaagggtctggagttctcatggggctgtggcttcctcgtccccgaagaccttggggaacaagagaacaagttgtgactgtggccgacaccctggccaggtggcctggtggggctacactcatctcacaagggcagcctccttgagggataggatgggatggggcactggggcctggccaccaagccacatggacgtcctccacagaccacacaataaaaacatcccggccaggcatggtggctcacacctgtaatcccagcatttcgggaggccgaggcgggcagatcaccagaggtcgggagttcgagatcaacctaacatggtgaaacctcatcgctactaaatatacaaaattagctgggcgcctgtcatccctgctactctggaggctggggcccgagaatggctggaactggggaagtggaggttacagtgagccgggatcacgccaccgcactccagcctgggtgacagagtgaggctcagtctcaggaataaaaaagacaacaaaaaaccaaccctcatttgcctgtaatcccaatactctgggaggccaaggtgggtggatcgcctgaggtcaggagttcaagaacagcctggccaacatggcaaaaccatgactctactcaaaaaatacaaaaaattacccaagtgtggtggtggataccagtaattctagttactcgggaggctgaggcaggagaatcgcttgaacctgggaggcagaggttgcggtgagctgagattgcaccactgcactccagcctaggcaagagtgagactccatctcaaaaaaaaaaaaaaaaaaaaaaaatggccaggcgcggtaatcccagcacgctgggaggccgaggcgggtggatcatctgaggtcaggagttcaagaccagcctggccaacatggtgaaaccctgtttctacaaaaatacaaaaagttaactgggcataatagtgggtgcctgtaatcccagctactcaggtgggttagacaggagaaccacttgaacctgggaggtggaggttgcagtgcgttgacactggcctgttgcactccagcctgagccacaggagcgaaaccccatctcaaaaaaaaaaaaaaaaaaaaaaaaaggccaggcgcggtggctcacgcctgtaatcccagcactttgggaggctgaggagggcggatcacgaggtcaagagatcgagaccgtcctggctaacacggtgaaaccccacctctactaaaaaaatacaaaaaattagccgggcgtggtggcgggcgcctgcagtcccagctgctcttgaggctgaggcaggagaatggcatgaacccgggaggcgaggcttgcagtgagctgagatcaggccactgcactccagcctgggcaacagagcaagactccgtctcaaaaaaaaaaaaaaaaaattctttcatggagactttttttttttctttttttgagacagagttttgctcttgttgcccaggctgcagtgcaatggctcgacctcggatctcggctcactgcaatctccgcctcccaggttcaagcgactctcctgcctcagccaccgagtagctgggattactggcactcgccaccacacacggctaattttttgtattttttttagtagagatggagtttttgtcatgttggccagtctggtctcgaactccggacctcaagcgatccacctgcctcggcctcccaaagtgctgggatgaggcttctttttttacattttatttttaacagctttactgggatacaaattatatactaatcctagaggccggcggatagctttgagtccaggaggctgagactgcagtgaacggtgtgattacaccactgcacttcagccagggtgacagagggagactctgtcgcaaaaaattaaaaaaaaagtcttaatgaataaaaagtataagtatgtctcaaagtggaatgtattaatacttatcctaaaatatgggacatgcaatatttagtatatacagctatttaaaaaaaggattcggccgggcacggtggctcacgcctgtaatcctagcactccaggaggccgaggcaggcggatcaccaaaggttgggagttcgagatcagcctaacatggcaaccaccccctgccccggtctctactaaaaatacaaaaatcagccgggcgtggtggctcacgcctgtaatcccagctactcgggaggctgaggcaggagaattgcttgaacccaggaggtggaggttgcagttagccaagattgcaccactgcactccagcccgggcgacagagctagactccgtctcaaaaaaaaagactcgaaggccaggaatggtggctcatgcctgtagtcccagcattttgggaggccaaggtgggaggatcacttgagcccaaaagcttgagacccagctgggcaacacactgagaccccctctacaaaaaatgagccaggcaaggtgctgtgcacccctgttccctcgggagccccagaaaaacgatgagcccgtccccacctcagtcagcaccgatggggaccccaaggccttgcgggacaggcttccaacacaggcaggagggccacgccccaggcgctcagctgcctcacaagttctcatcaagtaatgtggagggagatgcgtcctggccagggcctgggtgagggtggggggcagatcaggacctaagtctgaggaagctggggccatccacccaccagggccaacacttcccagctgacctgcctctgaccacgacaggaaggtggggggtaccacctctgtggggcccctggccctcctgctgggttccgggcacgagtgcaggcccagggggcgagcaggagcaacaccaagaccggcccggcgggcagcggcaggggctggacctgtggcgccggggccttgctccacaccacacacgaggcctctgcccttctgggaggagagaagtgctcacgctacacaagagccttccccagccctcagcaggacggccaggtgtgagcacagaaggctcctccgtgggcacctcgggagtgatggtcagtgggggccttcccaggtgacttaggtcattctcatgtgggggtcagactggaaatgacctcccgagagcatctgtgctgcctgcggggtgacagccacgtcagcttccctcctgctcggggcttcagggacagcctctctctggggacatgaggttttcctcctggagacgtggggcccagggagcctgctggagggtgcccgggagggtgccacagtgacaggggaagtgtgaggcgtcacaggcgacactcgccacacacactgaagctgcacacactgagactgtgcggaggccaggggtggcaaagcaggccccacgaggctggctgcgtgcggggtgctcacccgtggccggtcctgcggtgcctgctgatctccttttccccctcaatgatccactgcatgattttctggttcttctccgcatcctccgaggcacctggcacctcggtgctggcgctcttccccgactcagccttcttggcatttcttttgcacgccacgcccaccttcccactgcaagggcaagagctgcgagtcgccctggcctccggtggccgaggctgtgccccttcctcgtctgcgaggccccctcctggcatctgtaaggctcccgtggtgcagccgccgcccgctgtcccctgcccgcttgtcccccacccgctgtcccccgccagcttgtcccccacccgctgtcccctgcccgctgtcctggtgctgtctgggggttggtttcctctctaaacacacaggcagtcactgctcaccccctgaagactgagggccagagcgggagccagggtcgggctgtgtcccctaaccttcatctcccacctgaggtcacggcgtggactcccctgacccagggcccagtccactccctccagcagaggggcctcctgcctgttgctggcggtcctgggtttcctgagttttatgaggaggttctggccttctgcagggacacagcctcaccccaagccccctcctcactgacaggcgcacgctcacctgtgggcgaggccatcactggcgttgggggcagcgccaacactctctgagtagcctcgggaccttgccccatggctgtgtggttccaggccccaggcgaagctgctctgggccctgcgggtggcctcggcctccacctgctccttgggccgggctgtgctgtggtggacgtggtggtggacgtgtcggtggtggtgcaggccggccgcgtccagcttcgcccctgacttgggtacgtgcttcccgtgccccgaggcggcaccccccagtgccactggcatcttggccacgtgcccactgtccggggagcgatggccaggcccaggcgactggcggccaggtgtcctcagcacacgctgtacgtgctcgtccaggatgctctcagggttctcctcgtgtgcatcccggagcccggcacagcccatgtccacacagcggggcgggaagtggtgccaagcgggggcgggaggcagcttgtgacacggccctgggggccctgacgatggatcgccgtcctcaccttcctcctcctgtgtggggacaagcagcaccatcacctctcagcaccagctgcacacttggggaaaacaaaaagcatcaggcctgacccagcagccccagcagatgccgtcccagcccagggtggccgggggcccctcgccaccggtcctgtccctgaggatggagaggcaggacggggcatagacagaaggagcggagacagcaaggcctcaaggaatgcagcgtatgtatcggctgtgggcagagctctgcacagatttagtttagttttattctttttttgagacaagttcttgctctgttgcccaggctggagaacagtggtgtgatctcagctcactgcagcctccgcctcctaggctcaagcgatcctcccacctcagcctccagaatagcggagaccacagccgtgtgccaccacgcccagctaatttttttgtactttggggacagatgcgattctcaccatattggccaggctggtctcgaatgcctgagctcaagcaatctgcctgccttggcctgtatatatatatattttttgagacagagtcttgctctgttacccaggctggagtgcaatggtgccatctcggctccctgcaacctctgcctcctgggttcaagtgattctcctccttcagcctcccaagtagctgagactacaggtgtgcgccaccacacccagctaatttttgtatttttagtagagacaggatttcactatgttggccaggctggtctcgaactcctgacctcatgatccacccacctcggcctcccaaagtgttgggatgacaggcatgagccgccgcgcccggcctcccattatattttaaggagaaccttgtacagaacggctcttgggttatgtacatgttgtgatgctgcctgacgagcttccacatgaagccggtggagtttcacttgattctccaagttaacaggtgctgaagcttatctgtcagagcaaacatttgatcactttaattccaagttgcatctcatacttattttctcatcttattggactgacaaactaaaacagtattgagtaaatctggtgtcaatacaaaagaaagagagggaactaagttaccatgtatctatgtatgtatttatttatttagagtcagagtcgctctgtcagccaggctggagtgcagtggcacgatcttggctcactgcaacctccacctcccgggctcaagcaatcctcctgcctcagcctaccgagtagctgggattataggagtgtgccaccatgcctgcctaatttttttgtatttttagtagagacggggtttcaccatgttggccaggctggtctcaaactcctaacctcaggtaatccaccaccctcggcctcccaaagtgctgggattacaggagtgagccaccacaaccggcctatttattttcatttttttgagacagagtctcgctctgtcacccaggctggagtgcagtggcacgatctcggctcactgcaacctccgtctcccgggttcacaccattctcctgcctcagcctgcccagtagctgggactacaggtgcccgccaccacgcccggctaattttttatatttttagtagagatggagtttcaccgtgttagccaggatggtctcgatctcccgacctcgtgatctgcccacctcggcctcccaaagtgctgggattacaagtgtgagccaccgtgcccggcctatttttatttatttaatttttttttgagacggagtttcactcttgtgtcccaggctgtagtgcaatctccgcctcccgggttcaagtaattctcctgcctcagcctcccgggtagctgggattacaggcacccaccaccatgcccagctaaattttttgtatttttagtagagactgggtttcaccctgtttgccaggctggtctcgaactcctgacctcaggtgatccacccaccttggcctcccaaagtgctaggattacaggtgtgagccaccacacctaatcgcagtggtgccatcacagctcaaggcagcctcaacctccaggggtcaagcgatcctcctgcttcagcctgccaagtagctgggactacaggtgcatgccaccatgtcccattaattttttctttttcttttttttttgtagagatggggaatctcactatgttgtccaacctgctcttaaattcctggcctcaagtgatccttctgtcttggcctctcaaagtgttgggattacagatgtgagccactgtgccccacctacctctatattttaatataaacaaacctcccaacgtttagcacccaactctcacacctgcaaaagtatccaaatgcaactggaacaggcgtgccccagagctggtgtgggcttggctgcgggcacctgcactggggctgagggtgaaatatggcactaaagaggacagacggatgctggagcagagccgggggacaggtgggtggtgggcatcccctggcggatgcagctatgctgcctccctttccttggttttgtaggactaaagggcccgggcactctggggagaaatcttaaccgagggtcttcctagggactaaaagtgtttggagttttgatgccgttcactgccttggccgagctccacatcggcaggaattctatcatggggctgtgaaatgttacagattaacttaaccactcggctaatggtttttgttttcttctttgtgctttaatttcccaaatttcacaatgaaaataggttatttaaaaaatctggagttcacgcctgtaatcccagcactttgggaggccgaggcgggtggatcacaaggtcgggagatcgagaccatcctggctaacatggtgaaaccccgtctctactaaaaatacaaaaaaattagccgggcgtgatggtgggcgcctgtagtcccagctactggggaggctgaggcaggagaatggcgtgaacccgggaggcagagcttgcagtgagctgagatcgtgccactgcactccagcctgggcgacagagcgagactctgcctcaaaaaacaaaacaaaacaaagcaaaaaaaaaaaaaaaactggagttattccttttagggaaggaccaccactcctgggccctggtggtgctggatccacacacctgtgggcactgccatgctccctgttgctgggacagagccaggactccatggggtggggaagccttgagagtcacaggtgagagccacacactcagcacctgtggctacgcctgcctttaacatgtcttgcttaaggccaggcacggtggctcgtgcctgaaatcccagcacttcgggaagctgaggtaggaggatcacttgaggccaggagttcaagaccagtgtgggtaatatagcaagattccatctctacaaaaatattttttttaaaaaatgtctcactcaaaatgggaacctgccctactagaagcacaccctgcgaacgggtgaaggcgcaaagatcagaaaattacagacggccaacatgacagcaaagcgttccacagaaaattacagcggccggcgaccgacacaacaacaaaacagcaaaggcttctgcagaaaatgacagcggccaacacggcagcaaaacagcaaaggcttcctttcttacgtttctgttgtgagcatgtttgtttaagggctgctaaccttcacctgccacccaaatgatgatgctgacgtcacagcccgtgggcccggatgtggcctgcggacatgtccatattcttggtaactctgttcccaatgtttggttttcagacaacagcccagtaaggctcccaggcaggccccaatgccgctggcctcaggtgcgcacagccagcctcctcagggccaccccaggaagcaagcgagccgctccagtgaccaccaggtctgcaaggcgaggcctcactctcaccgccacagggaccacgcggcactgatgctgctcctgccagccctgcggccccggctaggttcccgatattggaggacaaattccctgagtcctttccttgggggactgtggagaaggtgaacttggcacctgcagagccctggagctggcaccacccacacctgtgccctacccagatgagggtcaccctcagaccaacggccaggggagacgagaggatgcagctccacatggtggcaaaacaatttactgaggataaaacaaatcgacgtctgtgtgtgagacatttccacacaaaccccttcatggggagctccaccatctgcagcgaccacacctggtccccgccatgaatcccagctgctcaacgagctatgtaaggtctgcctgccatctcaatggagtgcccggcgcacggtttcccagatgggcaccaccagcggcaccctgcgtccaccctcacggtggcatctccaggcttcagggcacagctcacccgggtagcgggtgaaagagtgagtgtaccgaggggtctcctgtggtctgaggagagctgaaggtctgcattttacatcaaggatcaggtgaatggaaacgctcagaagtgtatacattttctaagtattcatattcacgaacattgaaaggagaatgaaggaccaccccccgactcgatggtgcccactgacctcccataggaattaatctggctaagagaaaagcaaaggcatttttttttggcacccaggctggagtgcagtggcacagcctcggctcactgtagacctgacctcctgggctcaagtgatcctcccacctcagcttcctgaatacctgggaccacaggtgtgtgccaccacgcccagctaattttgaaattttttctagagacaggaatttgccacattgcccaggctgggctcaaactcctcggctcaagtgcttcactcgcctcagcctcccatagtgttggggtcacaggtgtgcactgcccgcccggccagcaaaggcagccttgcaagtgagacgaccaggtgggaaggggtctccagagaaactccagccggcctgcgcactgggaggagcgcacactggggtggagccacagaagtctgcaccatttgcagcggggaggagccaggccccgcgtcttcctaggtggaacctgggattcaatctgcgaggcgggaagcacactagcagaactctggctttgcgggaagtgattttttttttttttgaggtagagtttcactcttgtcatccaggctggagggcagtggcgcaatcttggcacactgaagcctctgcctcctgggttcaagcgattctccagcctcagcctcctgagtagttgggattacaggcacctgacaccaacccggctaatttttgtatttttcattagagatggggtttcaccattttggccaggctggtctcaaactcctgacctcaggtgatccgcccgcctcggcctcccaaaattgctgggattacaggtgtgagccactcgcccgcccgtttccctttttaccttttcacccaataaactctgtccttctcacccttcgaattgtctgtgagcctaatttttcgtggccatgtgaaagggacctgtttttagctgaactaagcaaagagtcctacaacacaagtgcctagagggccgtgcaccatggcctcaaggaaccaaaagtgaccaggaggtggcagaaagtctcaggcatcgcagcccccgactgcacgccactagcccttcctgctctgcacatgctcatctcacttgccagccacacggggtgaagaagttgagatcacccgctgcagtctcagcttgtggccctgccacccacaaaggatcaggtacacagcaggcagccgtgtcacccccggccccttcaatgcaggtgaccaaggtgggtctctgggcctctgagggtggcatggggccgctgggacatcccatcttgagctggggctcggctgcagagaaaggggaacaggggactcagccgggaggcctcatgggtcagcaggcctcggccagccccgggcatccccatgaagaacatcaggacatcccggcggcaagaaaacagcacgacaccgacgcggagcgcgacaccgacgcggcccactcaccatgcgcacgcgcttcagccgctcctccagcttctcctcggcctcccgcgtgcgctgcacagcctccaggcggtggatgagctcctccgcgaacttctgaggctccacgcggacctccttcggcacccggtacgtgcgctgcgagggacaggactgtgaggcacgggggttgaaaggtcacaggctaaacatttctttgtgaagggaaagagcgtgtgctatctctgttgtattttattttatttttttgagacaaactcttgctctgtcacccaggctggagtgcaatggcgtgatcttggctcactgcaacctctgcttcccgggttcaagcgattctcctgcctcggtctcccaagtagctgggactacaggtgcccgccaccacgcctggctaatttttgtattcttagtagggatggggtttcgtcatgttggccaggctggtctcgaactcctgacctcaggtgatctgcccacctcagcctcccaaagtgctgggattacaggtgtgagccaccgggcccggcctttgttgtattttaaagcaagagtttactttttcctcctttcagttgggaatcaacttcctcacggtcccccttttcgtgtccggccagtctgtccttcattccccacggacccaggagacagggctgcttctttccagcgtctcccgactaccagatcaagaggcctgagcagggcagcttcaggacacacagccggcgctccccacccacttcagagaagcactcgaggagacgcctgcagaaggtgtgagcagaaggcccccgaggccccacggcagggaaggacgcccaggatttggaggacaggggaggtctgggaaaggcaggctttcctttttaaaagaatctaaaggccaggtggtggctcacgcctacagtcacagcattttgggaagcagaggcgagcagattacttgagcccagaaattaagagaccagtctggccaacaaagtgagacctcatctctacaaacaaaaattttttttaattagccgggtgtggtggcacctgtggttccgactacttgggaggctgaggtgggaggatcggatcgcataagtcctgggagatcaaggctgcagtgagccgagatcatgccactgccctgcagcctgggtgaaagagtgagaccctgtctcaaaataataacaatacatctgcaatgtattttatagtaatataccatatagcttgtttgtttttggttttttttgtttttgtttttgagacagggtctcgctctgtcacccaggctggagtgtagtggcgcgatttcggctcactgcaagctccgcctcccgggttcacgccattctcctgcctcagcctcccgagtagctgggactacaggcgcctgccaccatgcccggctaatttttttgtatttttagtagagacaggatttcaccgtgttagccaggatggtctcaatctcctgacctcgtgatccgcctgcctcagcctcccaaagtgctgggattacaggcgtgagccactgcacccggcccccctatagctttttttaaaaatagagatgggggtcttgctgtccaggctggcctcaaactcctcccacctaggcctcccaaagcactgggattaccggtgtgagccaccacgcctggccctgtgtaactttcaagggtacttcattttaaatttcaaacttcaaaacagctgcaaaaatagaacaaggaattcccgtccaccttcacccagattccccaagggctcacattctgccataactgctttatcatccccttaccggcaggcacatgcgtacacacacatgcccacacatgcgcaggcacacacacccacacacacgtacacacacacgcacacacacaggcacgctcacttttctgaaccagttagagtgtatttaacaaaagcaaggtcgctctcatacctaaccacagtacaaatatggatggttaaaaaaactgaccctgatacaataacatcacgtggcagatcttattccaattttgccagctgctccaataacatccttcatagcaaaacatgttttaaaatccaggccgccagtgtctaagccgcggagggatgcagccagggacagctcccctgtgacaagcaagcagggtggcagatgggaggtgggaccctccgtgtgtgtggccttcctgccctcccgccgtgggctctggcgcagtcctggctctgtgcacccgtttctcatctacacaatgagagtagaaacagcatctaaacctgagaaggatggggtgagactggacacaggggccacacaaaaggcctcctccaggctcagatgttccacagtagacgaggctcagagagaggctggccctggagccacaggcttcacttcaaggaacgtggagtatgaaggggccaagggcacgcccaggacactgggtgatgcctcagagctgggaaaagtcactgctggagtctgggccgtgcacagcgccaggaaggggtctgtcccggagccaaggaggagcatccagtgcttctggaagatgatgaggaaggctggggctggcaccagcagggatgtgggccggtgtgtccgggtgtgtggacggcagggcgtccacacagatggcaaggaactaacaagccaccctttcccgctgcacccggggcctggaggctgggtggctggggggccatgctggcttttccgtgcccagtgctgggcaaggcgcagacgtgggagtggcacacacaggaatgggagctgccagcactgcagggaccacggctgctgtgtctgcagacagccagaggcgcagacagacgcgcttatggtctgaacagtcagcaccacagagaccaagggcaggatgaaaagcccatcatcaggcccagagagcagcacggctgaggggccaacaggagcactcatgccgccacgcgagctccataaaaagactccaggtggccttgcaggctgcgtcaccacggttctgagaacagcaaaactgtcagagtcatcagatttacagagaatggcaacctctccagctttagaggaacagaaaaaaatatcataaaggaaaaagccaagtaaatgaaaacgtgaaacttccaagtaattgtaaaggctaaagatgaagaggcccctccccgcagggcacgcattctggtaccagatgctgtaaagccacggcccccaaccttttggcaccagggaccagttttgtagaagacaatttttccatggacagtgggggcagggggcttttcgggatgaacctgctccaactctgatgggcaggtgttaaagagtctcacaaggtgcacacagcctgggcctccgtgggtgcagccacaacagggttctgctcctatgagcgtctaagctactcccctcctgctgtccctgctgcagagccatggactcaccagagaaacggcatagcttttgcaaaaccaaggccctcaacagagcagaagtgggcagtgcaaccacggcacgtcctgctagcttatcggcttcctgggcctccccccgcctctgctcaccaccatcctcgggtccagtttcccagtagcagcagtgagcaggccccgggcagctgtgcccgtgatgtgggtttctcacttgggcctctggctgagggacctcccaccgaaggttccaaccacagccccacctgacaggccacatggacctgatgcaggttcctacagagcctccgatgaggttgtttgctgcagactgttcacacagaaacgcacactgcggcccccaccccaccacacaagggccctctgggggtgcggaacgcagcagggcctgctcctgtctgtgcctgccgcctctgttggctttcatcttcctggcgactcaaatgtgaccctccaggacctgagggctctgtgcttccctcggttctggaaggttctgacgacgacaccagggactcgccataggcatcctcttttctctgtgttgcatcctgagaggtctttccaggtccacgttccaggcaccaacgcactccacagcttctgtccttcctgacccttctgaggggaggttgtctgcctgatgccccctcatccagagtctgtggcatgcactttctacacacgaagactctgaccagcaccccaaaatcggggcacccctgtggacagaagcctcccgcgggcctcagcccactcaagccccgtcctcatgggcacagagggctgttccgggcctgtggttgctcagctgtcttgtctctcgggcctccgtcatcccagcggctccgcgggttcttgacgttcaggacctgtgacttgaaaatcagaggccggtggctgtgcaggtgccctcgacttgggctgtgacctcatgatagccttgggccatgcctggcaggcagggccccagatcttccacagcacaagcacgcacacacgcacgcacccacacacagcctacagtgtcagccactttttgttaagtagacaccatcagtgcctagttttagccaaacctgagtcaagggttggctggcatcttctcagaagtgataacaaaccaacatcctttcttttcaaccataaagaaattcctgacttggaaactgatgtctgcagaaaagctaaaaggctaagaaatcctgaccaagactgtgtcagtgctctcaaaatgcctacttccctgcacagacactcagatggtcacgtggtttaacctcagacaccgcggctaacagtgcgttgcgcagtggctcacacctgtaatcccagcactttgggaggctgaaacgggcggatcacgaggtcaggagatcgagaccatcctggctaatacggtgaaaccccatctctactaaaaatacaaaaaattagccgggcgtggtggcaggcgcctgtactcccagctactcgggaggctgaggcaggagaatgacgtgaacccgggaggcagagcttgcagtgacagcaaaactcctatctcaaaaaaaaaaaaagaaaacacttttctcatcttcccgtaacatctttcctgttcaaagtcaacccatcaaaataaggaaagatcattaatctgttcatcagcgcaggaatgctctgtagacggagtcaggctgtgctgggctccagctagcactcagctccatgacctactgcccagccaagcccccatgcccgagactgggcaaaggtgccattattctatgcaacagcgaaagccaaggcagctttaaagtcaagacgtttacctggagacgaccactgttcagccacaaaaacaccaagttttccccaagggctgtgcaggggccaggcctgggctctgagtcttgagaaaggctcagagctccccctcttgaggggaagcatccaccttcacaaggcaagacacttcctgccaccagggagggtgtggccttggggcatgggggctcttctgaatgaacagctccctctgggccctaaatgctgcctgagacttgatgtcccctgctgccctcagggactggccacttgcagatgttgctgggatcacacgcttacgcctagaggtaagcctggctcgtgggaggccaggcaagtgcctttcccgcggaccagttcaccaggcccacgctgagcggggaggacgatgggctgaggaccgcaaagccggtacttacgggaatgtgaggtaggggcacccgcccattgacctgcacgctctcctgcatctccctgcggtgctgcttacggatcctgtatggggggatcccatccctgtccaggagaaagaggcagccgttaactcagagaggagcaggagggccagcaccgtgccaatagagctcctggccccgaccgccggtcagcaggcaatgatgaggacacctgtgagccaccaccactgagacacgtgcacacaggtgatgcaggcacccatgtgtgcacaggggaacatgtacacacaaaggttcacacgtgatggtaaagcccaggtgcccagccacgcgtcttcctagctggtatttactgggcacctccacaaagcctccttgtgcctgcctgttctttagggcctgacagctaagagtggtttctacatttttttttcttcttttttttgagatggagtctcgctctgtcgcccaggctggagtgcagtggcacaatctcggctcactgcaagctccacctcccgggttcacgctattctcctgcctcagcctcctgagtagctgggactacaggtgcccgccaccacgcccagctaatttttttgtatttttagtagacacggggtttcactgtgttagccaggagagtctcgatctcctgacctcgtgatccgcccgcctcggcctcgcaaagtgctgggagtaattacaggcgcaagccacggcgcccggccaaggtttctacatttttaaagggtgggggaagaatctgtgacagggactgcatgcggctgcaaagcctcacatattcactgccagccctgcacgggaaacgtttgctggcccctgcttgtggcctagaccactgtgcagtgtgcctgccttggagggcattgctaaatggaccaaaaacatttcaggattgcacagtgggcagccaggacaaccagtgccccacggaaagataggagatgccaaggctgcacactctgcttctctccaggagctggcagggcagtgtggtctctgagggaggcacaaggtagctctttagcaacaggttttcttttatttttttctttttgagacggagtcttgctctgtcgcccaggctggagtgtagtggcgcgatctcggatcactgcaagccgctcccgggttcacgccattctcctgcctcagcctcccgagtagctgggactacaggtgcccgccaccacgcccggctaattttttgtattatttagtagagacggggtttcactgtgttaaccacgatggtctcaatctcctgaccccgtgatccgcctgcctcggcctcccaaactgctgggattacaggcatgcgccaccgcgcccagcccgcaacaggttttctttatgaaccctttagaagatcattaaaacacgaaagtcagattatacatggtctgaataattaccccagggttaagataactcacgcacaaccatccttcatgaaagccctcgccctctcccagctattagaaaagctgccttcgggctgggcgcagtggctcatgcctgtcatcccagcactgtgggaggccgaggcgggcggatcacgaggtcaggagatcgagaccatcctggctaacacggtgaaaccccgtctctactaaaaatacaaaaaattagccaggtgtggtggcgagtgcctgtagtcccagctactcgggaggctgaggcaggagaatggcgtgaacccgggaggcggaggttgcagtgaggcgagattgtgccactgcactccagtctgggcaacagagcaagactacgtctcaaaaaagaaaaggaagaaagaaagaaaagctgccttcggaagcacggcagctccagggatccgtgccgcacccaggggcctctcagagctgccaggagacacaggacgactgaagagagcgcccgacccagggctgcgtggcagacacggcaactcctgaggcatcctcggctgtcacagcaccactgagtgttgtgggcaatggtgagccgagtccaggtctggctcagccacggtgggcgtcaggaacaagtgaatctaaaactcacctaacacttgcctcggggtttgttgaagtgtcctgaagccaccaacctactggtttcttagacatgatacttggattgggtaacctccacaggcctccgtggattagacactgaccccacatctgtgtccacagcccacagcctctcgagtgccatgtggaatgttgtgagcttgccgccagcacaaaagctgagggcagctgccccaccggaatgatgctcttcacctgtccactttttacctctgatttgctttcgagtacgtgtagcaatttcacattccaaattgttaaacacttcagtacaaaccaagatgaacagaatatcaagaaaaaaaatacctatttattttaggtcctccctttaggaaacatatgtcccttttcttggagagaattaggagactttttgagaaaactgagttggcaggttactttttgttgtagtaacagagttttggggaagagggaaaccagatgctaggatgcatgtcaggcgctccgtgggctgcactgcacccaaccacctggcccgaggcttcaggaccacggcaggcactgcttcaactccagtaacctcaagtcaggtgctgctaaaatcacgtcaacattttattttgaagattcaaaattaaacgaggatgaaagaaaccaggagaagccacacacagcagctctgcccggaaggggcagggagctgcccctgcactaccacagctacctggggaaaaaccaaggggccaagacctacggcaatgtgggctggctgaatctggttcagaaacagaatgtgacaacttgttctcctcatctgaaattcaggttttggaaaaatgtttaaagacaggcaaatgaaaagaacaaaccagccaggcacagtggctcatgcccataatcccagcactcgtgaggctgaagtgggtgcagtttgcgcccaggagttggagactgcatagtgaggcctcgtctccacaaaaataatcatcatcatcagccggatgcagtggctcatgcccgtaatcccagcactcatgaggctgaagtgggtgcaccgtttgagcctcggagttcgagactgcatagtgaggcctcgtctccacaaaaattataataatcattagccaggcgtggtggcgcacgcttgtagcctcagcaactctgaaggctgaggcagaattgcttgggaccaggagacagaagctacagtaagccaagatcgcaccattgcagtccagcctgggtgacagtgagatcctgtctcaaaatgaaaagaaccataaaaatggtacatacagtgggaccatcacttaaaacatattcataaaaagatgggcagaatcaccagtaggtgagaagtccctctctcctcctccagccctatccagatctccaggctttcctcatggagaacccagctaagcgggaaagacatctgggacaccactggccgcagtggggatggagggtggtggtccgcgggctccagctgctcacaagttcatagccgctggcttcctccaatgctgaggctgctgcagggagaccctggttcctgcggctcggccccagccctggctaggatggctggtgggcaggtggcgtgtggcgcacagaccagagctgggaaggtctgagcttcatgggtaaccaaaaccccaaatgacccccacaggctggcagccagtgccctactgcaacaagactgttggcatcatctaatggctggggtgtacataggtcccaaaaagccagctgcgaagcacaggggaagaggtcataaaacaagcacgttcctacacatggggtttccctggacaatgaaagaataagcttctgcctgtcacctcgagcgtcacacatgtgtggcccaggcctcagcacaaccacagcatcttccctcactcctgctcccagccccttgccaagtgggtgacagggacaagacaggaccctgtactgcaccagcgtcggcagaaacgccaccctcagggaccacatcactcgccacagccagtggtgaggcagctggcctgtgcctgtctttaagctgaaaccccagactctgaaaaccaaagagcaaactctagcccgggcagcctacagactgtcttaggttcaccctcgatccttcctcatagggaggtcccagcagccctggtcacagagagaagcaaccgacacaaagctgagccctcacttgtactgcttggaggacagcctctgcggtacagcctgcctgcatgtccagacgcactctcactgagacctggggagccaggaaacacttttcctgaagacaaagcccaggcatctctgggtcagcacgaagccccctctgagctggccgcgctctgcagcagggtgggacttacacgctgccatccgcaagaaacagggtgtctggggcaggacttacacattgctgtcctcaagggacaaggtgtctgggaccggacttacacactgctgtccgtgagggactgggtatccggggcgggacttacacgctgctgtccgtgagggacagggtgtctgcatcgctggacaggctctgctgctcgctgtcgttggcactggtggctggggccagggcatagccggcattgacataataggggttgactggctcccgccaggatccatacctgcaaacaggcaagcagggcatgttagtgacagcctgccaacagcctctcattttatttcacattttcatgttatctgaatatctcaatgtattaattaaaaacacaagcaatttggagaaaataaggagcatggagaaaagaccaacatctccacctgtcctcttgtccctctgtccttttcaacggggtgcattaaagcaccgggcatctttccagatctctcctctgattttaggcgggggctttggtgcacacacagagcatccacacgtgatcatttgggtttgttttccgtgcacggtactagaaatgggacgcagatgttctgctcattctgcagtgcgcgtcgggagaggacactgggttttgatcaggatgaggcccttgggattcagctcagacgtctctgcacctgtgcccaagtccaagcatggccacgggactgatgtcagggccggtatgtgacagtgtgtgtgggtggtgccacctcctgtccccctacctagagcagaggttcctccccagctcctgggacgattcacctcctcttgttactgcaaaattagccaggaaatgacaccttttttcaatctgcacttccctgattaatggtcagattggcagtttagcgtatttgtcatttaaacttcttcctctttatctgttcatatggtttaccattttctatggggtggattatgagtttcttggtgatttacagaagtcttcaaatagacttgttattaatctctggttatatacgcaaaaaacattttctccctaaatgtcatttttctttttaacattgctcaggttgattttggtcaaacaaaatttttcatttctatgaaatcagacaggccgggtgcggtggctcatgcctttaatcccagcactttgggtggccgaggcaggcagatcacgaggtcaggagatcgagaccatcctggctaacacagtgaaaccccgtctctactaaaaatacaaaaaattagctgggcgtggtggcgggcgcctgtagtcccagactacttcggaggctgaggcgggagaatagcgtgaacctgggaggcggagcttgcagtaagctgagatcacgccactgcactccagcctgggtgacagagcaagactctgtctcaaaagaaaaaaaaaaaaaaaaaaaagaacagcctgaccaacatggtgaaaccccatctctagtaaaaatacaaaaattagctaggtgtggtggcacgcacctgtaatcccagctacttgggaggctgaggcaagagaatcgcttgaacccgggaggcagagattgcagtaagctgagatcgcagcactgcactccagcctgggcgacagagtaagactctgtctcaaaaataaaataaataaatcaatcagatattccaatcttttcctttatttatttatttattttctattttggaaacacagtccttccttattccagaattacacatatattctatttttctttatatgctccagttttttttagaccttcacctgaaatgtgtgtatacaaaatctaggccagtccagcagagcctaaaggtaaaaaataaaataataaaaaataaataaaatctagctcactccttcacatcaaaatggagatacagctgttagcattaaataccaaataacccatcttgtcctcaataattttaagcgcctctctccaccacatctaactcctgtcaaaggcatgtgccccttccgggcgctctgctgtgctgccaaccaactggcatgtggactctgcagggtccctaactgccaagccccacagtgtgccctgaggctgccccttccttctagcggctgcccccactcggctttgctttccctagtttcagttacttgcgttcagccaaggtctgaaactaggtgcgcacagagcggtaagactgcgagagaaagagaccagctttacagggggtttatcacagtgcaccctgacagtcgtcagcctcacagggggtttatcacattgcaccctgacagtcgtcagcctcacagggggtttatcacagtgcacccttacaatcattccatttgattcacaatttttttagtctctactgtgcctaacttgtaagttaaatttgatcagaggtgtgttcccagaggggaaaacagtatatacagggttcagtactatcgcatttcaggcctccacctgggtcttggaatgtgtcccccgaggggtgatgactacctcagttggatctccacaggtcacagtgacacaagataaccaagacacctcccaaggctaccacaatgggccgccctccacgtgcacatggccggaggaactgccatgtcggaggtgcaagcacacctgcgcatcagagtccttggtgtggagggagggaccagcgcagcttccagccatccacctgatgaacagaacctagggaaagccccagttctacttacaccaggaaaggccctttgacaagatgggaggggggcaggcagcccagcaccttggactctggtgacatgggatgcctggggagatgagcgagcactgcgagctggggacagcctgtggcggtgctgggcagggcctcgctgcacggggccatttcccctggggctgtggcctccatgccctctggagggtatcgcatggggccagaacacacaagcagggcctttcatacgaacagtgctggtgaccgtgctcagctgctcgggaggcaggtgcaggaccccatgccacaatggaaaacacggttcacgatgtcaggcccctgccagggccgatgtccacgagtccctctgacccacccactgtggcctggtcgctcactgcaggccacagacagtcacggccaggtgacggcagcctcaggctgacagcaaccatggggccgctcttgggaaatgggttctctggaaacaccgaccaccggtggctgggctttgtaagtttggttcactcctcgtctcctctctgtacctgacatagagcagataaaatgataccagcctgcagcttcaggctctttgctttaagcatcatgcagtatttataaatgacaccattattcctttgatacttaaagccacagctgctcagcagctactgatattatcactgtaacaaccactgcagccaacctcagatctcaggttaagtactaaagtctccctattactatgaaggaacactgaactttggtaactttctataaacatctatttggccaaataaaaacatttcaaatggaagagagaaggccactgccgcacagaagtttaagaagtctacgtccacggcacacgggtgcatctgtagcccacggcacttggtgcgtctgtagcccacagcacacggcgcgtctgtagcccacggcacatggcgtgtctgtcttggcacgcactggaagcacgtgccctgccctcatgctgccatggggctcacacctgtcccgtcacttgggagccacatacagcagaacgaagccttctgtgttcatgtgtccaattccaaatccttctcccactctgacttcccaggtgtgcctttcacatttttggaaaacctgtttgtctttaaaatgagaagcaggagaaacgcaggtttcccattttccacaagctccagcacacagcaagttccactgcacacaagcaccaaggtcaggcagcaaaggggagagaagcgggagaaggcggctgggagaaaagaaaaggaagaagggcagcctgtttactattgatcttcgtaacaatcccagacaactgccctggctctcaggatctgccctcagcactcagatggctcctgtacctgaagacacaggcggccgggcttggccttcactaccagcagatgcgaccaagaacgttctggtcaaagacacgtccaaggggaggtcacatgggagttccaggatccccccatatagctgggatccagtggcgggaggggcatgtgctcgcgtgcctgcctgtgcgtgcgcctatggatgcgtgctttgtgtgtgcatgcccacgtatccatctgtgtgcgcgcccgcatgcccatgtgtgcacctgtatgcccgcccttcacgagcacctccacctacacctgcacttctcagacagtggagatgctgacccctggctgtgtgcggtgagaatgcggctggggccttggtgagagcggctctgacccctggctgtgcagagagaatgcagccggggccttggtgagagtggctctgacccctggctgtgtgtggagagaatgcggccggggccttggtgagagcggctctggctgtgcggagagaatgcggccggagacttggtgagagctgtgcccagccccccacgctgatgacctcaaacaggaaaacgtgcacagctcttctggaacaggtgccaggactcaggcagagtccggggacacagaggctgggagaccctgtagagccaggtagtgacagactcctcgcaactcttctgtgtgttcaaaggctttctttagggtccggtgtggtggcgcacacctagaatcccagcgacttgggagggtaaggcaggagactcgctggagcccgggagtctgcagtaagatatgatcacgccactgtgttccagcctgtgctccagactctgtctcaaaaacaaaaatgtcgtggagaggaggcatgagaagacacggtgacttagggaaaaacgtgcccatcacagaagggaaagtccagtggagcggtgaggaggcgctgatggcagaatcaatgcccaggagctgtgtcataaacaaacacctgtggggtttgacagctacaaggaccctattagcttcaaggcaacaggaaatgagaagccatgaggcggccagtgcactctaggctggcctaggaggcccaaatgtcagggccacacagaaggtctcccctgcccaggtgttcatggatggtggagaaaggtgctcctcctgccccaggaaggcacctctctgggactcccgcggctgctcccacatccagcatggccacggcaccggctctctggtcactgtggtactttcatcttccgtcttttcacatttaaccattctatattcttctacttgtgtaagcagcctgccttttaaaaaggtagcataacaatttttccttttaatgaggctgtctggtccggttacatttagtgtgatgtggagggagctgggccaccgtcggatcgggttggtttatcacatctgctctacttccttttgctctttcttgccttctttggggtattttttgctttccatttcctccctctgaaaaagtaaatgttgtacagttctttcattggttcctgtgcctggacatgtctcaatcccacacatcacacctgcctcttcccaggccgcatgagaacctcagaaccgacagccccccacacactcacaagcaacgcatttcctgcactgacattttcttttttattccctggactcccaccttagcttcccaggtaggtgggacaacaggcgcacactaccactcctggctactttttcattttttatatagatgaggtctcactatgtcacccaggctggtcttgaactcttgggctcaagtcatctgcccacctcggtgtccgaatgtgctgggattacaggcatgagccatcatgcctggccacaaatcagatcattttaattactgaactgcaaaggggtaaatgctttaaaaggattccagcaaggtaagatgacaacaccaataatgcaacataggggcggataaaatctaaacagaaaagttacacaaaattatgatgcttcgctgtgatggtttcatggagaaatttagaaacaggtcaagcttcacagcatccctccacatcccttaacacacacgtgcaaatttgagagagttccagctttcctcatcaattacctttaaaattactaagtacactcaagaatataaaaattaaaaacaaatatatatgtatatatgtaaatgtatatatgtgtgtatatatgtatatatgcatacgtatatgcgtgtgtgtgtatatatatatatatatatattttttttttttttgagacggagcctcgctctttcgcccagactggagtgcagtggcgcgatctcggctcactacaacctccgcctcctgggttcaatcgattctcctgcctcagcctcccgagtagctgggactccaggcacacgtcaccacgcccggctaatttttgtatttttagtagagacaaggtttcgccgtgttggtcaggctggtctcgaacgcctgaccttgtgatctgcccgcctcggcctcccaaagtgctgggattacaggcttaagccactgcgcctgcccacaaaaaatgtttcatgccaaaagaccacctggtgtgacggatgccacccagaacatgggaagaggaggctggaggtagatctggccctgggaatcacccgaaaccactgctacaggccctcctgcctcctgctacccacgctctgggatgctctgggcccgctgctctctgtgccttccatacccaggcaggagccgccaccctccctggtagtaaggcaccacatttccatacccaggcaggagccgccaccctccctggtagtaaggcaccacatggcacctgctggtgacaaccactatggggaaacagcaaacagcagccccaggagagctctgcatagcacgtgccccaccccgccaagacttctgtgttgttaaaagtaagttctgatggttttgcttaagcagcacaggtcagtacaccacgtaaaataattatagccattttgaaaggcaaatcgcctttttctccaaccacagagctcctcaactcacgacaaggctgtgtcctgataaacctctcatagctgggaatacgaggtagaaggtggattccaacccacgaagggttaaaccctctcacagctgggaatatgaggtaggtggattccaacccacgaagggttaaaccctctcatagctgggaatatgaggtagaaggcggatgccaacccacgaagggttaaaccctctcatagctgggaatatgaggtagaaggtggattccaacccacgaagggttaaaccctctcatagctgggaatatgaggtggaaagtggattccaacctcaaagtgttatccagacacagccttgcccttcgttgacgggcaccctgaatgcttcaggctggttgtaaagttgaaaaggcctaagtggagccatcctaagttagagaccagctgtattctgaaagacagaggctggaattagtaaaatggctggaaacacacatctgtgagccctggatgataagccaggaatgagccaatgaaagcccaattccaagtgagctggacatgaagacggaggtggccgcacagacccaaagatgcacgaccttctgagaagcacagagagccccgtcttgtggccagggaaacccaggcagcgcatgccgcaggcgtgaggctgggtgcttctcccaggcctggctcagggcagggtggctgcaaacagtggtgcacaccccaggctccaggaggaggtgaccgaggggcagctggggaacatggcgcacaccccaggctccagggatggccctgctggtagtgcggtctaacgggaggcaataactcatgactgagtatgtctcccctcaacccatcaccctgtacctgcccgcagtggagtgtgcacctgtgctcaggtatggggacagatgtgctcctacggctgtgtttcctctgcacaggtgtgggaggcctgtgcaggagctgagttagcatggcaggtgctggtgctgacctgtgcctcacctgggcacagaggcagaatcccctgggctgcacatcctcctctccaaagcaagtgggacctggctgtccgcgaggcaaagagtccatgcagactcgggtgtgcgtctgcccctcaataccccatccatgtgtctccagccacctgagtcccacagagccactgaggatggtgggtgaatcctacacacagaatcgctggctcccggggaccctcttcattttctggagctgtgggcggtggacggatgagtgcatcctttagagcccagacactggcagacacaaaagcctggcaagaagcaacacaggcagaaaaggcctctgaggatggcgggcagtggcctgggggaagaggtgagccatggcctgcagctgcgtcccagctctggtctgcagtcatgtccagggaaggggctctggcaccagatggcagggagcggtcacctggcagaggccatggatgccaatgccacttgcttcccaaaactgagagccaagcgtggctcaggcctgaaatcccagcacttgggagactgaggtaggagagctgcttaagcccaggagttcgagaccagcctaggcaagaggtcaagaccctgtcttgaaagaaagaaagaaaaaagaaaagaaaaggaaagaggccgggcgcggtggctcatgcctgtaatcccagcactttgggaggccaacgcaggcatatcacgaggtcaggagatcgagaccctcctggctaacacggtgaaaccccgtctctactaaaaatacaaaaaattagccgggtgcggtggcgggcacctgtagtcccagctactcgggaggctgaggcaggagaatggcgtgaacccaggaggcagagcttgcagtgagccgagatcgcgccactgcactccagcctgggcgacagagcgagactccgtctcaaaaaaaaaaaaaaagaaagaaaaaaagccaaaataagattaaaaaaaacaaaacaaaacaggcggggcacggtggctcaaaactgtaatcccagcactttgggaggccgaggcgggtggatcacaaggtcaagagatcaagaccatcctggctaacacagtgaaaccctgtctctaccaaaaatacaaaaaattagccaagcgtggtggcaggtgcctgtagtcccagctactcgggagtctgaggcaggagaattatgtgaacccgggaggcggagcttgcagtgagatgagatcacaccactgactccagcctgggcaacagagtgagactccaccacacacacacacacacacacacacaccaacaaaacaaaacactgaggggtgtgacttgggttctcacctgcgtctctctaggagcataagcacaggtcttcaccactgtgggtgcaaagggaaaaggtgtcaactgcgacaggggatggaatacggcacagaatgagcaacccaccctggagacaccagcctgtgggagccccaaagcccacaggagagccccatagtccatggggagacctgtccatgggaagccccgtagcccacaggaaaccctgcagaccatggggagcccagtgcaggagagccctgcagcccacaagagtcacatctgaaatacccgggaccgtccgcactgaccagcagcctccatgaggggcagatctggggccaagtgtcagtgagccgccttacgggtctttacgggtcttccgggccacattacgggtcggcactgggcacgaggccacctgctcaaggacgccgatgccatggcatgggggctacatttgctctacaggtctcctgccggatcctttctgagccctcctgggaggaggctgggggccggaatgcgggtgcatagaaacggctggaagcagcgcagggcagaagcgatatggaaaggcgggtcaggcacaggcctcacaggcccgcggtcctccggggaggtttgcaaggatcacatggccaagggcaccatgagcagcttcccaaccaacccgcccagtgtcccgcagagtttgtggagataaacagaagcttgacaaacacaactgagcagaaaacgcccgcaggtggtcagtaggcgcttccagtgttatcacaagaccacacgccgcacgtcagcacatgacacagacacacttacttgatccctgttttgacaagctaagtcgtactttataccaggaggaggaggggcaccccaggtgagcggtccaatcctcagacacggccagtgccatcagcgacctgcatcccgaccccccggaacagcacagccagcagacagaacccgccctgcagaggcagcttccggcagccgcaggcccttcccaggcccagcccccgagtcccgcgcagggaaaggctctgcccaagccttcagggaggcagcagcgcccggtgcacagttcctaagggcgcagaactccgggatgaacaaaggcaaggaaacggctgtgtaaaaatcagctctactgacgcacggctgggtgctcagcggacccgcacagaaccacagtcctacctggcacgttctgacgcgcaccagatcacagcctcagccccgcgggcgcgccccaggaaaccatggcctcagccccgcgggcggccccgcaccccaggaaaccatcgcctcagccccgcgggcggccccgcaccccaggaaaccatcgcctcagcccacatattcaacccggaagcctggggaggcttcccttggggaaatccacctgtcgctcgaggtcagtcggccttttctagaattctgtataaacgcagtctcatggggagctagtgccccccgctgctccggcgccccctccgctctggctttcttcactggcacaggatcctgagatgcacccctgcctccatggttatcagcgactcatcccttttatgccgtggcatgccaggatgcaccacggtgtttttctccaactgcttggcagtgccactggagttggggcagcgcttcccagcgggcagagttgaccccgaggccaacagccaggccacagccagcgccctccccacgtctcgcctcccccagtccagacacaaacctggtcaagggcgcccagaccagggctcaacccactgcccgcaggggccgactgccaaggagcggtcaccgccccagagtgatggctgccacagcgtcgtgtgtacaacttatggtctgtcccacgtggctgcaggctccagccctgagaagaagagaggagagccattccccaacacggcaccttgctctgtgttagctccatcttctctcatgacggggccttcggaaacaccaagaaacgaccaaagcagacaggcactgggagaagcaggacaagcatttcctcacctcacatgaacttccatatgaatgtgacaaaggcacagcacacaaaatgcagatgctgaccacagagagggccccactcactcacgctggccacgaaaaggcccgccctggttcacaccggcatggagaggtctcgcttctgttttagcaatactgacaactggcccccattcatgcagatgctgtcacttatatactatatatataacaagggccaggcgtggtggctcatgcctgtaatcccagcactttgggagactgaggtgggcggatcatgaggtcaggagttcaagaccagcctggctaaaatggtgaaaccccatctctactaaaaatacaaaaaattagctgggcatggcgacaggcgcccataatcccagctactcgggaggctgagtcaggagaatctcttgaactggggaggcagaggttgcagtgagccacaatcacaccactgcactccagcctgggcaacaagagcaaaactccgtctcaaaaaaaaaaaaaaaaaaatatatatatatatatatatatacacacctatagataaataacctacctttgcacccaaaggtcacaaagtttatactaaaaaatgtgattgagagccggacacggtggttcacacctgtaatcccagcaccatgggaggccaaggcgggcggatcatgagatcaagagattgagaccatccttgccaacatggtgaaaccccatctctactaaaaatacaaaaaattagctgggcgtggtggcacgcctgtagtcccagctactcgggaggctgaagcaggagaatcacttgaacctgggaggcggaggttgcagtgagcgagatcgcgccactgcactccagcctggtgacagagtgggatcaaaaaaaaaaaaaaagtgatcaaaatcaggccaccgtcagctatgaaaatctctattttacttcctccataaaatcagggatgtggcctctgcctgaagcgtcagccaagattgccagcactggccgggtgtggtggctcacacctgtaatcccaacagtttgggaggccgaggcggggggatcacgaggtcaggagatggagaccatcctggctaacacggtgaaaccccatctctactaaaaatataaaaaaaattagccgggtgcggtggcgggtgcctgtagtcccagctactcgggagcctgaggcagaagactggcatgaacctgggaggtggagcttgcagtgagccgagatcgcaccattgcactccaacctgggcgacagagcgaggctccgtctcaaaaaaaaaaagattgccagcacccccatcaggtcccagaatactccacctacgtatctcgtgggtgttctgcatggcggcagacacttggtgtcaccctcaggggcaggaacaggtgatgggctgaccagacagcattgaatgaccatggggcagggcactctcaccccttctgctcacactgaatgagcaggtgatttctcggtcactcagggtggcagacacaaaagggcaagagaatgagtcaccaggcaccaggcaggagcttccggctcagccctgcggcctgtgcctaggaggcctcgctgtggttccacgctgcggccagccttttctttgttttataacaccgctggtgcccccacccactcactgtgaaccgcacaacacaccaaaggccctttatgatcaaaatcaaacagtgacgatagggagggtgtgtgtttctgcagactgtccacaggcgcagcacaggcggggcagccctggcagccacccacacctgccatcccgggagtccaacagctcaaactgtggccaaatgcccctcaccagcacttactggctactgaccacaggcagtctgccaattcctagcttacaaagcggaaatgacagtggccacttctttataaagtttctgagcatttcagcaaacagtgcttgggtgaggccaggcacatgatgcagaaagccctcactacagcctagcaaccaaagtgtcctgcacattagttaggggactgggtgggaaaggctgcaggtcacagttaaacccacaattccaactaactgtctgtgagactctaaacaaatgcttcaccaggctggggacagtggctcaagcctgtaatccgagcactgtaggaggctgaggcagaatgccttaaagccaagagttcaagacccacctgagtgaaaaggccagaccttgtctctacaaaaaaatgttgcaaaaattagccaagggctgggcggggtagctcacacctgtaatcccagcattttgggaggctgaggtagatggatcacttgagtcctggagttcaagaccagcctggacaacaaggtgagacctcgtctctgcaaaatatttaaaaaattagccaggtgtggtggcatgcacctgtggtcccagctactcaggaggctgaggcaggaggatcgcctgagcccaggaggctgaggctgcagtgagccatgatcatgccactgcatttcagcctgagtaacacagcaagactctgtcactaaaaaaaataataataatacagccaggtgcagtggctcacgcctgtaatcccaatactttgggaggccgcggcgggcggatcacctgaggttgggagttcgcaaccagcctgaccaacatggagaaaccccatctctactaaaaaaaaaaaaattagccaggcgtggtggcacatgtctgtaatcccagctactcgggaggctgaagcgggagaatcacctgaacccaggaggcagaggttgcagtgagccgagaccacaccattgctctccagcctgggcaacaagagcgaaactccatgtcaaaaaaaataataataaattaaatacttaacaagaacagcatattcacaggaacccaaacactcatgattttgaaaggcacatggcaacgggtgctacagacaggagagatggcaggcagggagagtgtggccgggcaccctgtcctctctgcacagtcccccacagactgaagctgctgctccgctttccaggagagatggcgggcagggagggtctgccaggcaccctgtcctctctgcacaacccctgggtgctgccacgctgctcacaccagtaactatttaaaatgatagtgggctgggcacggtagctcacgcctgtaatcccagcactttggaaggccaaggcaggagggaggatcacgacgtcaggagttcgagaccagcctgaccgacatggtgaaaccctgtctctactaaaaatatagaaattagccaggcgtggtggtgtgcacctgtaatcccatctactcaagagctgaggcaggagaatcgcttgaacccaggaggcagaggttgcagtgagctgacatcgcgccactgcactccagcctgggcgacagagcgagactgtcaaaaaaaaaaaaaaaaaaaaaaagatactgaaaaacatacagagtgggtaacatgaattaggatcccatttttgatgaaaaaaatgtgctaagaaaaatctagagcgatctagatagaatagtagtatctctgagcagtgggatatcagaccatttctttgttctgtgttttctttcttttcttttttttggatatggcatctttctctgttgcccaggctggagtgcaatggcgtgatcttggctcaatgcatcctccgcctcccgggctcaagcaattctcctgcctcagcctcccgagtagatgggattacaggcgcacaacaccatgcccggctaatttttgtttttttttgtttttgagacggagtctcgctatgtcgcccaggctagagtgctggagtgcagtggcgcagtcttggctcactgcaagctccgcctcccaggttcacgccattctcctgcttcagcctcccgagtagctgggactacaggtgccagccaccttgcccggctattttttttttttttttgtattttttagtagacacggggtttcactgtattagccaggatggtctcaatctcctgatcttgtgatccacccgcctcagcctcccagagtgctgggataacaggcgtgagccaccgcgcctggccaatttttgtatttttagtagagacggggtttcaccatgttggtcaggctggtctcaaactcctgacctcgtgatcctcccgcctcgaccttccaaagtactgggattacaggcatgacccactgtgcccggcccttttttttttttgagagagggtctctctctgtcaaccaggctggagagcagtggcacattcacagctcactgcagcctcaacctcccggtctcaggtgacccacccatctcagcctccctagtggctggaaccacaggtgcatgccaccacactcatctcaatttttctatttttttctagagatgggggtctccctatgttgcccaggttggtctcaaaatcctgggctcaagcaatccacccaccttggcctcccaaagtgctgggattacagatgtgagccactgtgcccgctaccaaacgtctttcatatagaactctgacaacaatctgtctttgcattgactgaaaactatgcaataatgtacatgaagaacactttgaaaattataatgcaccaaagaactcactaatgagactcactagttagtgctcagcacaatcagttatgaaactgacgacctctttcctctgctcagcgtgaacaccgtgcattgaattcagttttgtgctgctcactgccacatttcttcaatgtcacaaaagtctcttcagagcctggaactgcacaaatggcttcacatcacatttttaggttcacaaggatctgatgagaaacactttatgtaatgaagagtggtaacatttaaaaagtagaacaaaaaaatgttttatgctttcctccccaggagacactagcaccctcactccagccttcacccctggagcagaagcccccaggaatttactggttccaaagaacagccaatgacctttcacaagctcagattatctatgctgcaacaaacatttggaagtggcaattcccagcaaattgcaggcaatttagagtcatttgccaagatgcaatctgccctattgctccagggtctttacaaaggccagccagactgcagcccttgcagactgcagggtggcaagtctcacgccagcctcagagcctcctcagcagaagtctgaatacatcacttacccagaaccaggttgccggcttacagtcatggtccctgaatcctgcataaaactcacctgaaggagaccagctctcagtgctgaagctacaagacgaaaataacaacttctgaaagccacgtcttattaaaaattaaaacactggacacttatcaatctagttaaggtaaaaattctgtacatgaaaaaaaaaattctgtacatgaagcactctggtttgttcccttgaagtaatttagaaactgcaagttccaagctgggtctaccctctttatgacattctcagggatcctggagcccttccctgggctgacagctcatggacgtccctaacactccaaagcagctgtgtccagtttccttgactctgagtgtgcagcaggaagaagcctctgtctggaaagaaacactctgaggcagaaatagaaaatctttatttttatgagatatttaatttttttctgcttcttttaaaaggagtttcactttacccaaatgaaagaaacgcaaccaactcatgagaatctatcaaacactcctatcagcgtatagaatgcacagcagtaagcggacgcataacaaagccaaaacaaaaactgcctggactgcttttatttgcaaacttttttgttcaccatggaaatgctttatctttgtggtatctccaacataactccacactgcaccacgaagctataaattccaaagctaatggaatttccaagcaaaggtgcaagcctgacactgcatgaggggccctcacgccagtgcctctacttacgtcaccctcagatctccacacaggcgcacctcggccactagtctgacccccagcctcgctgagcccctgctcaaaagcgctgtttccaggcctgtgggttccagagaccacggtgactaagggcccgaccctgactacagcagatgggaagttacttaatctcccagggcctcagtttccacatggatggcatgacactcccacacctcgttaggggctcgcggatggcctgacgcctgacacaggcagtgcgagagtccacaggtcggcagccttcagcagcgacaatggtccctgacagtcctctgttcacagctcctgcagatggtggtggaccagcaacaactgagggccccacggtccaaggacagtttagagaactcgcagcagcaacatcacaatcacaagtaaagcatatttaacttttagaaacaggatataaaacctgcagccaggctgggcgcggtggctcacgcctgtaatcccagcactttgggaggccaaggcgggcggatcacgagatcaggagatggagaccatcctggctaacacagtgaaaccccatctctactaaaaatacaaaaaattagctgggcgtggtggcgggcgcctgtagtcccagctctagggaggctgaggcaggagaatggcgtgaacccgggaggtggaggttgcagtgagctgagaccgtgccactgcactccaggctgggcgaaagagcgagactccttctcaaaaaaaaaaagaaaacaaaaaaaaaattacacttaacatcttaacatctccagaaagattttgatctaaacaatgttgatctaaaccaaaaaaaaaaaaaaaaagtataattttttgagtgtatattcagaaagcaagggcaggaaaaaaatgtattgaaaagatatgaaaacacaacaaaaagaaatgcaaaatatatgaaagatttaaaatttaaaggatcactctaaatggtccaaaatctaaataagatctcaaataagttctaaaatgagaaatggtaaagatggagagaaggaattatcaaagaaataacatttctggccagatgcaatcaatggctcacacctgcaatttcaactctctgagaggccaaagtaggaggagtgctcaaggcctggagcttgagaccagcctgggcaacactgggagaccttgtctctacaaaaaactgtaaaaaaatattagcgaggtgggccgggtgcaattgctcacgcctgtaatcccagcactttggaggccgaggcaggcggatcacctgaggtcgggagtttgagaccagcctgaccaacatggagaaaccccatctctactaaaaatacaaaattagctgggtgtggtggcgcatgcctgtaatcccagctactcaggaggctgaggcaggagaattgcttgaacccgggaggcagcggatgcagtgagccgagatcgcaccactgcaccccagcccgggcaacaagagcgaaattccatctcgaaaaaaaaaaattagtggggtgtgctggtgcctatagtcccagctactctggaggctgaggcaggaggatcgctcaagcctttttttccagactcgcctcagaaaaaaaaaaaaaagaaaagaaacaaataccatttaaactccagaattaaaggacaagtttcttcagcacgatgaaagaaaaaagcccccagcaaaacacagtattatgaaataacactgttgataaagaaaacatccaaaaaatgtctggagggaagaaaaaaagcaccatccacaccgtatgaagagaatggagccaggtctttccagggcagctcagaaaaacagaaggtgatggtgcaaattcctctaaatttatggggggggtgccacccaacctaaattctaaacccaactcatctctccttcaagttcttttggcatgagcgcataacaccagtaccacagcacaacagtaacacagcacgaggtaccacagcatgccaataacacagcacccagtaccacagcacacccagtaccatggcacccaataccacagcacaccagtaacacagcaccaggtaccatagcatgcccataacacagcacccagtaccataccatgccaataacacagcacccagtaccacagcacagcaataacacagcatgcagtaccatggcatccaataacacagcacgcagtaccacagcacccagtaccatagcatgcccataacacagcacccagtaccaaggcacaccactaacacagcatccagtaccacggcatgccaataacacagcacccagtaccacggcatgccaataacacagcacccagtaccatggcacaccaataacagcacccagtaccatggcatgccaataacacagcacccagtaccatggcacgctaattacacagcacccagtaccacagtacaccaataacacagcacccagtaccacagcatgccaataacccagcacccagtaccatggcacgctaattacacagcacccagtaccacaacacaccaataacacagcacccagtaccacagcatgccaataacccagcacccagtaccatggcatgctaattacacagcacccaataccacggcatgccaataatgcagcacccagtaccacggcaagctaattacacagcacccagtaccacaacacaccaataacacagcacccagtaccacagcatgccaataacacagcacccagtaccatggcacactaattacacagcacccagtaccatggcacactgataacacagcacccagtagcacagcacgccaataatgcagcacccagtaccatggcatgctaattacacagcacccaataccacagcacaccaataacatagcacccagtaccacagcatgccaataacacagcacctagtaccacaacacactaatatcacagcacccagtgccacagcatgccaataacacagcacccagcaccatggcatgccaaaagcaaaccatccagtaccatgacacgctaattacacagcacccagtaccatggcacactaattacacaccactcactagagagaaacactctgaggcagaaatagaaaatctttatttttatgagatatttaatttttttctgcttcttttaaaaggagtttcactttacccaaatgaaccaaacgcaaccaactcatgagaatctacaaaacactcccattggcgtatagaatgcacagcagtaagtggacacataacaaagccaaaataaaaacggcctggactgcttttatttgtaaacttttttgttcaccatggaaatgctttatctttgtggtatctccaacataactccacactgcaccacgaagctataaattccaaagctaatggaatttccaagcaaaggtgcaagcctgacactgcatgaggggccctcacgccagtgcctctacttacgtcaccctcagatctccacacaggcacacctcggccactagtctgtaccaggacacactaataacacagcacacagtaccacagcatgccaataatgcagcacccagtatcatggcacgctaattacacagcacccagtaccacggcacactaattacacagcacccagtaccacagcacaccaataacatagcactcagtaccacagcacgccaataacacagcacccagtaccacggcacaccaataacatagcacccagtaccactgcatgccaataacacagcacccagtaccatggcacccaataacacaacacccagtaccatggcacccaataacagcacccagtaccactgcgcccagttacacagcatgccagtaccacacacaccagctccaaggcacccagtaccacaggatgcctaaagagtaactgtttcaaccagagtgggaatatggaagacttcaggacacatgtcttccagagaaaaaatactttatccaagaggttttacagtgaggagaagaatattcacaagcactctattgagctgaagaatatgggaagatttaagttggaaagtaaaatatttaatcaaatgaaaaaaacggccattattaactcaaaaacaaacacacaaaattgtacaggaaagaaaatggccaggcgtggtggctcacgcctataatcctagcactttgggaggccaaggcagggggatcacttgaggtcaggagttcgagaccagcctggccaacatggtaaaacctggtctctgctaaaaatacaaaaattagctgggtgtggtgatgcacgcctgtaatcccagctactcgggaggccgaggcagaagaatttcttgaacccaggaggcggaggttgcagtaagccaagatggtgccattgcactccagcctgggatacaagagcaaaactccgtctcaaaaaagaaaatgattgacccacttggctcagaagtgaaagcaccatgccctggtgcatgaacacctcagggtaggggtgagacaggagagcagcagagctctcaaagagccagtggacacaagatagcagtgagcacgttactcagaaaaggcactaaggaccgaaccgtgtcgcccaattaatatgtgtcagccctgaccatcacgtggctgtgcttgaagtaaggaagtgttattgttagatgagaacgcaaacgtggggccctgacccaagagggctggttccctaaaagaacagacaccagctgggcgcggtgcctcacacctgtaatcccagcactttgggaggccaatgcgggcagatcacgaggtcagtccaagaccagtctggccaatatggtggaacctcatctctactaaaaatacaaaaattagccaggtgtggtggcgcatgtctgtaatcccagctactcaggaagctgaggcaggagaatcatttgaacccaggaggcggaggttgcagtgagctgaggttgcaccactgcactccagtctgggcaacagagcaagactccgcctcaaaaaaaaaaaaaaaaaacaaaacataaatacaagaacttaaccaggtgtgggccaggcacagtggctcacgcctgtaatcccagcactttggaaggccgaggctggtggatcacaacgtcaggagatggagaccatgatggctaacacggtgaaaccccgtctctactaaaaacacaaaaaaattagccgggcatggtggcaggcgcctgtaatcccagatactggggaggctgagggaggaggagctcttgagcctgggagggagaggttgcagtgagctgagatcacaccactgcactccagcctgggtgacagagcaagaccccgtctcaaaaaaaaaaaaaaaaaaaaaaaaaaaagacacatttacgtgtatcctttttaaagaaaaaatgtgcttttgaatagctgcatattttaaagcttttattcttttaataatatactttctaattataaacatgctgttataggaatttggaaaatacagaaaaacaaagaaaaaaattaaaagcccacatatccaactgtatgaatgccactgggcattcaagtcatcctatttgctggaatattacaagcagcactccttagggttattttaaatgtttgtttaggagcagacaccaatcccatagactacaggtgagctagtaaagatccagagtgggtcaaaaccaaaaaaaaaaaaaaaaaaaagcactggagcaacctcaaaggaggcaggagggtgagtgccatgagcagggcacaggaccaagcagcccactgcagctcacagtgaggacagcgcctgccaggacacccggacgcccagctacccggccacctggccacctagccagctgagccaagagctgagcccatttgccagcagatgcttcaacggatcacaaaggaagcccgtgggccgaggctgcaatccacacaagccagcgttcaactccggacagggcccagggtccttgctggaggagaaggggcatggaatctgggccctatgggcactcagccgggcgtgcggcctctgggggccccctggacgccacagcagtatggcagagctgtgtgtgttttcacagagccctgtgaccagtctccatctctcagggagtggagagaccgaacaccttctggagctaatgggttctgagagaaccctgagtggttattctcacagatgtgacacggggaaaaactgaggtgaagctgcttccctccacacgcacaagtaggcagcggaggggcccaagaaagagccaacaggcggccctctctccctgacagccaccatagcccagcctggcccccacctccgataactgcagggtacgctgctacaaatgacgtctgcgtttgacaaggatgagcagaaccggagcgtgtgcgtcaattcaaatctgtgacactggcgcaaaatgtgagaatgggctggggtgccaggcggccagtcacggctagggcacagttccaagaagggccacaggggcccgcagggacacttaccccaagccctccagaaacagctgctgcaggtcagcaccagcaccagggccaggcacacagtctcatcggcacgtctgccactggctgtctgcaaagtgcttccctttcacaacccacccacacagctcaggactgaggtccgcccaggcaaaggggcctctcggttccagaatcctttggcctgacaggcaactacagatactttcgtggactctgctgaaacctgtctgagactatggagctttacgtggctaaggaagagaaaaaatatgtttggagtccttgcccactgacaggtgcataaaaatacaagatggactgggcacagtggctcacgcctataattccagcactttgggaggccaaggtgggcggaccacttaaggtcaagatttcgagaccagcctggccaacatggcgaaaccttgtctctactaaaaatacataaagtagccaggagtgggggcatgcacctgtaatcccagctactcgggaggctgagactagagaatcacttgaacctgagaggcagaggttgcagtgagctgagatcgcgccattgcactccagcctgggtgacaagagcgaaactccatcttggggaaaaaaaaaaaaagtgggatgcaagctggtgctgtggggacagagtccagcagagcaccagcagagtccagcagagtctgggattacaggcatgagccaccgtgcctggccaggaatcatttttaaagttttccttggacatccacaaacaaaaaaaatttccctttgggcagggtgtggtggttcacacctgcaacccctgcactttgggaggccgagacgggcagatcacttgaggtcaggagttcaaaaccagccagcctggtctcaaaaaaaaaaaaaaaaaaaaaaaaaggccgggcgtggtggctcacacctgtaatcccagcactttgggaggctgaggtaggcggatcacaaggtcaggagatcgagaccatcctggctaacaaggtgaaaccccgtctctactaaaaatacaaaaaaaaaaaaaattagccgggcgtggtgacacgcgcctgtagtcccagctgctgaggaggctgaggcaggagaagtgcttgaacccaggaggtggagcttgcagtgagccaagattgtgccactgcactccagccttggcgatagagcgagactccatctcaaaaaaaaaaaaaaaaaaaaaattagccaggcatggcggcaggtgcctataatcccagctactggggaggttggggcaggagaactgcttcaacctgggaggcggaggctgcagtaagccgagatggtgccactgcactccaacctgtgtgacagagcaagactgtctaaaaaaaaaaaaaaattctcttcagatctgctcaaacaggggaagcaaataccccaaaggagactagaaaccccccacacccaggcaaggggagcccacgcaaggggcagtatggctcacaagcacctctgccccctctgcaccacagcagaggtccccttaacaagacaagcctgggggcgaccccaccctgggccacaccctttgcacaggaagcagagttcacccttgcaacacagcccctctgcagccgggcaccttcaacagcaccaccgcctgaggtccaacggacatggaaacccaaaaccactcctccacagacaactctgtacacattttgggccctttctttttcttcttcttcttcttctttttttttttaaccatttcttctcttaaccttttaggccattaccagaaacacagtcaataaactaatgagcaggtccgacggttcctcacgcacccctgcgggaacctgaacggcaagggctggctgcccacctcgaaaggacccaccggtcctctgagcagctccaggaaccagcagcccaagacaagccaccatgttgctcctgctgtggacatgtctgttgtccactctctggccacagccacattgaccagccctatccacaagtgcatcactggactggcccgggaagacacacgaaaatatccaggaagaccctgtccccagtcatcaaggaaggtcagggcagtcaacagaaggggccagcggcgaggagactgcgggcttgaccaagcggacctggcaggggcatgcaaggccagccctgaaggccacctggtgggccaagccaccctgaagggaagcagagcctgagcccgccagccagggagtgcaggccctgggcctcccgcccaacactcagtcaacagcagaacctgcctgctgatccacaccgctgaaatgacgaggtgaaccagccagctctgttcaaagttccactgacaatgggaacaaagacccgagggtgcagaaagtgttcccacagaggcagagcgggggagccagggaggaaccccatgaaaccttggcccaggagctcaaaatgacagtgggtgagtgggacaaacacagaaaagggccaggaatggagctctttcctaggctgagacaaagacctaagcagaacacttcactttcctcaaatcaagtatgtgaaaccaccacgcggctcacacacggaccaacaaggacccgcactcaggcgtcccacaggggaactggatgcctgtggccgtgctggaccgcagcagccccaccgcaggggatgagcgactgtggcagagatgcaggcaaagtagcctccaggacagaggggtcagcacccgagggctggccctcctggcacgttcctccacgcaaattccaccccggtgagaggtgacagcgtgctggcagtcctcacagccctcgctcgctctcagcgcctcctctgcctgggctctcactttggtggcacttgaggagcccttcagcccaccactgcactgtgggagcccctttctgggctggccaaggccggagccggctccctcagcttgcggggaggtgtggagggagaggcgcgagcgggaaccgcggctgcatgcgcttgcaggccagctggagtcccgggtgggcgtgggcttggtgggcccggcactcagagcagccggccagccctgccggccgcgggcaatgaggggcttagcacccgggccagcggctgcggagggtgtgctgggtcccccggcagtgccggcccaccggagctgcgctcaatttctcgctgggtcttaactgccttcctgcagggcagggctcgggagctgcagcccgccatgcctaagccccccaccccctccgtgggctcctgtgcggaccgagtctccccgacgagcgcccggtcccattgaccacccaagggctgaggagtgcgggcgcacggcacgggactggcaggcagctccacctgcaaccccggtgcgggatccactgggtgaagccagctgggctcctgattctggtggggacgtggagaacctttatgtctagctcagggactgtaaatacaccaatcggcactctgtatctagcacaaggtttgtaaacacaccaatcagcactctgtgtctagctcagggtttgtgaatgcaccaatcgacactctgtatctagctactctggtggggacttggagaacctttgtgtggacactctgtatctagctaatctggtgaggatgtggagaagctttgtgtctagctcagggattgtaaacgcaccaatcagcgccctgtcaaaacagaccactggactctaccaatcagcaggatgtgggtggggccagataagagaataaaagctggctgcgggagccagcagtggtaactcgctcgggtccccttccatagtgtggaagctttgttctttctctctttccagtaagtcttgctgctgctcactctttgggtccacactgcctttatgagctgtaacactcaccgcgaagatctgcagcttcactcctgaagccagtgagaccacgaacccaccagaaggaagaaactccgaacacctccgaacgtcagaaggaacaaactccggacaggccgcctttaggaactgtaacactcacggcaagggtccgcggcttcattcttgaagtcagtgagaccaagaacccaccaattccggacacaccgggacgactaaccggctctccacaggatatgcatcccctaacacgtgaggcctaagctccaggccctgctgtggtagcaatgctcaccagccgcctgttcagtacccactctccttttccctttgcattacccgcagccttcctttggaggactgcccccagctccccactggggagcagccgtctgtctgggtggagaacccactttccttcaggagtgaccctgctgcacagcccccagcgcacgcaccgtgactgtgctgagacagacgggacacagcggcacacgtgccctcctcagagcaacagcgggcccatccgtcagagctgcgggaagcatctgtaaacaagggagcccagagcccaaggtcactgcagcagccacctccaacacaaagcccacgaagtcgcccaccaggcaggcaaagtcagaatggcacaaagcaaaggtgccaggccctaaggcacacctgaggctctgcctcaacagtgcccttcagggttgggctcaggtgggtgggtttccacgacttccaacctagtgcaccctcacctacacctggcaggacaaagagaatggtctaaatgtgaggaacgcagcctggacttcatgccctgtctgtgctgacaagcaaccattccaacatcagagatcttcaagccacaaggctgcaccacaggccacctcccacagagaggattcaaccgcagacacgactcccaagccccagggtcctctgccaccagcagccccagagcagtcaagttaggacccaaactgtgtagacagagctacacaaaattagacaggagaagccaatgtatcccactaatttcatagcaaaggttccttattacaaatacagcaaaccaaggacagacagcaaagctactgctcgcagccaagaactgaagagtggctgggagggaggcactggggttccaacagtggaaatcagaacggagctcattttcctcctgcagcccagccctcaacttcagtcccatcttaaaaataaccagccggggccgggcgcagtggctcacacctggaatcccagcactttgggaggctgaggcgggcagatctcttgaggaaaggagttcgagaccagactggccaacgtggtaaaaccccatctctactaaaaatacagaaaattagctgggcatggtagctcacacttgtaatcccagctactcgggaggctgaggcaggagactcacttgaacccaggaggcagaggttgcagtgagctgagattgcactactgcactccagcctgggcgacagagcgagactccatctcaaacaaaaaaacaagcaaaaaaaataaccagccaggtgcagtggctcccacccgtaatcccagcactttgggaggctgagatcactggagtccaggagctcgagaccatcctggccaacgtggcgaaacgctgtctctaccacaaatacaaaaattagccaggcatggtagcacacacctgtaatcccagctactcgggaggcaggagaatcacttaaacccaggaggcagaagttgcagtgagccgagatagcgagatagtgctactgcactccagcctgtgtgacagagcgagactccatttcaaaaaaaaaaaaaagaaagaaagaaagaaactctcagtttataccaggcttactcaacaggataactttgcggcatattgtgtcctaaaatgcttgctaaataaataccacttggctaaagacaatgaacaaaagggaaaaaaggccgggcgtggtggcccacgtctgtaatccccgcactttgggagactgaggcaggcgatcacgaggtcaggagatcgagaccatcctggctaacatggtgaaacccagtctctactaaaaatacaaaaaattggccggcatggtggcgggcgcctgtagtcccagctacttgggaggctggggcaggagaacggcgtgaacctgggaggcggagcttgcagtgagccgagatggcgccaccgcactccagcctgggcgatagagcaagactccatctcaaaaaaaaaaaaaaaattaaccaattaacctacacaatccttttttgttttttttttgttttttttctgagacagagtttcactcttgtcctcttgtcgcccaggctggagtgcaatggcacaaccaaggctcactgcaacctctgcctcccaggttcaagcgattctcctgcttcagcctcccgaggagctgggattacaggcatgcgccaactcgcctatctaatttttgtatttttagtagaaatgaggattcaccacgttggccaggatggtctcgaactcccgacctcaggtgattcgcccgcctcggcctcccaaagtgctgggattacaggtgtgagtcactgcgcccagtcgacagtccatcttaaatcgtatcacttagactacaagtttaaccttagacatgtttaatcctgtgttgatgagcgagtagccaatttctgtgtcacagtaagcttgaagaactaatgcgagtttttaataactcctcaggagagtcccagcacatggggctgtgctttcggagtcttgattaggtcagcaggggtcacatgaattccaggctttcaaagttacacaggccggagcctccggtcaccagctctagggaaagagtgggaaatgcatgcgctctgctcacaagcacagtagatgccagcccgaaagccaaataaacctccaggaaccacgcagggatcacagggaaggaagaacgaagaaacaggttccaaggctgagcaccactctgctccctcccaggcaacacacgcaccccacaggccctgccaggatcgcctcagggtccaggctgctgtggactacacaacagcaccaacagattttgttggcaggaaaaaaggcccaatcctggaatgcccactatagccacaggaagttttcaaagtactctgaccattccccacacgtaaaacgtcccccctgctatttctcagcctgtaggaagaagcttagaagatcattataaaagcaataatctggccggatgcggcggctcacgcctgtaatcccaacactttgggaggccgaggcaggcagatcacctgaggtcgggagttcgagaccagcctggccaacatggagaaaccccacctctactaataatgcaaaattagccgggcgtggtggcacatgcctgtaatcccagctactcaggaggctgaggcaggagaatcgctcaaacccgggaggcgaaggttgcagtgagctgagattgtaccattgcactccagcctgagcaacaaaagtgaaactccgtctcaaaaaaaaaaaaaagcaagaatccaattctccaattcttatcgatgccctgaaacgtccactcctccctttattaagcggaaaggaccatgtctactgggtagatccagctcctatttaagaggtgacagactttactgctgaagggtaaagtttacatgtcattgtgacttctaagaattccgatgttcctaatgactcataaagtcatatattttagtctgttctcagtaaaagtgttctcaacattacaaatataaaaaagtaatgacaaatgcaaaagtatcacaaataagaacagaaccaaaattcaaccccagcggcagcaggacatccggtgtgggttaacgcccgcctcatcagcacctttccctggcttgttctccagctctcggaggtgagtacagaaagtggacgcctggcgtcggactcacctgaactctctgccttcgctgtaccgtctactggaggagaccctcggggcagctgtctccaggagcagcttctgagggagtcttccggggggagcagcgtctctgccatcgtcctcatccatgtcctggtcacacttccattcctcatcttcatttaaggtcggcaggtatccagatatgcccttccctgtccctgacccagagctctggtcactacagactttggggctctccgagcctgtcctcgtatattccaaataaatatcagacttaaggaaggagggataggtgttttcctccatagtggcctggatttcggtctgggcctggtcaaacatggcaggatcgatcagctgcttcatgatgcagccctttatgaagctcttggtggctggcttggtctgccgggacacgatgccattgttatcaagaatgtactttcggtagatggctctcgccagcttcagcctcttctcctcgttcgagtcacagggctccagcttcctgaagccagtgcaggcaaaccagaagtccagcaagtcggcacagccctcctgcttcaggaaagtcctgaacaggcttatcccatcttggtcatccagcagggaatgcagtgactcagcccacttcaagtatggtggggtgggggaggcactgccctcaggctcataccccaggtccagatccgagcgcctcggagtggccgtcgaagtctcacctttaatgccaacacctttcccggagcagaaactgtagctggcgggcctcgggtctgtggacaccagttctccctcctcaccaggcactgggggtcggggagcatcttcggtgaaacttgctccgaggtccaaggggaaaccctgctcttggatattcattttgggactctgcgtcaaggaacaatgagcgctgcaccctaatacatcagtacttacagctccaaagtgaatcaatctgtcctgttgaaaccattaagaggacaaggattaggaaaggtgggtccatgaaacacgaccagaggttttctcaagacaagactcacgatgacgccctcccgctcaaactcaaagcaagaaactcagtttaaatgttcaatcaagatatattttggccacaagcatagttctactttaaagcaatttctggaaacttttacaactacaggaatgcctctcatgctaagaagggatgcccaggacatgggaatgccactccccacaagtctcactgcacaaacatcacggaggctggcagcttgagcacctcccacctcagctgcagagctgagggacagggaaggcaggaagaccggaggaaggaaagctgcctctagtcctgactatgtgtacaaacctgagtgagggctggaccctcacaagtaagatggagacaatcgctccaccagccccagcaacactcagagagaaaggaaggtgcgctacagccccgaaggtggtgggcgtcttctgaaccccacgtcctccaggcccacggccactgttttctacctgctgcatcacgtcacgcgtggtacaccttccgacacatgagaacacactgcagggtgttcctccgactctcaacacacgcctcaaagagagataatcatgggtcaccttcagccccatcgaccgagggatcaaggacaccacccaggcccacagaggcgctcggacaccgtcactggagacaatcttaaaatgctctgtcagaatgctgcacttgactctgaaaagcctctctgatgaggattcagatagcaaatagtaaatgggtacttcaaggaacagagaaggtacagaataaaaggaaatgcaaatacaatttttagctaaggaagctatagttcatgtgacttcactccttaagctgaaaaccaaaccacccaccctcttagacatcagggaactatagaatttgctgctactactgctgctgctgctacaagcctgcaaggggtgtgcaaaagagagtagataagggctccaacagaacccctgccatggtctatggtccttcctgccacgtcctacaggagcccaggagctctggctatgcctgtcaacccggccatgcaggtgactgaaacaacagcctgccatgatgtaagtggtcctggctaaaaggggctggagagagggctttagagaagcatgttgggttcaaaagcctagagtgctgaacaagtcacagcaaacaaataaaaccctaaaacccaggaccaactgaagggggatctatcccccagccaccactccacactgctgtcccttgtctatgtggaatctgtcccccacaccaacttcctcacattgcacacactttaccagccaacagctgctcacggctggaagcacgaaggatccacagagccaggcgtggtgtcacgcacctgtagtcccagctactcaggaggctgaggctggaggatcccttgagcccaagagttcaagactaacctgggcaacatagtgagacccaatctctaccaaaaaacagttcttaattagccgggtatggtagcgtatgcctgtagtctcagctacttggaagactgaggcaagaggatcacttgacccaggagttcaaggctgcagtgagctataatcgcaccccactgcactccagcctgggcaacagagcaagatcctgtctctaaaaaaaaaataggccgggcacagtggctcacacctgtaatcccagcactttgggaagccaaggcgggcggatcacgaggtcaagagatcgagaccatcctggctaacacggtgaaaccccatctctactaaaaatacaaaaaattagccaggcatggtggtgggcacctgcagtcccagctactcgggagactgacgtgggagaatggcatgaacccgggaggcagagcttgcagtgagccgacaccgcgccggccactgcactccagcttgggcgacagagtgagactctgtctcaaaaaaataaaataaaataaaataaaataaaattagtaaataaataagaagcacccatagatggaggatggtttgcaactatgtgcccccaatgacatttcagcagctaaggactttttgtgaacgctgctgggtagtatgtcatcttggcctcagcaggaacacacagcttctaaaggtcaaggcccagtgagctgtgacatcctgctgctcacagaccacttcagcggcagtcactccgtgagccacatcagcatggagggagcaccctgggcgtgggcacctccacactagctcacggtcatctgtctgggacgccatcacaggaaagaaggcctgcaccctgaccacctgagccttaccactatagatgtactaccattcactagcttgaagaaccaagtcaccggagagtggaaagtgattaatcagacagtgctcagaagggaggctaaccacaagtcaccatcatgctctcataagggacttaagtcttctgtgttaattattggtagtagcgggacccacagcacccagcacaaggtcctgcaactaacgggcaccagtaagtcattcactgatgtaaaaaagaaaagacatttgtcacagacgccaaacactggctctctacaggggctgaactactgtaccacagaaaacagcagcaaattcttccaaaactaatgggttttgttgttttgttttttgttattttgagacagggtctcgctctgtcgcctaggctggactgcagtggggcgatctcagctcactgcagcctcagcttcccaggctcaagcaattctccagcctcagcctctcaagtggcggggactacaggcacgagtcatcaacgcccggctaattactgtattttgggtttcaccacgttggccaggctggtctcaaactcctgagctcaaagcaatccacccgcctcggcctcccaaagtgttgggattacaggccactttgcctggccccaaaactaatgttttaattcatgtgtgaaccaaattttcagagcccagaagaaaattttcttacaatcatgtgtatttttggctgtcaactgacagaagactttttggtgtccctggaagcacatgaacccctctacaagctactgatgttgttgaaacatgtcccaattcctgaaatctctgggttcccacagggaagcacaccaagcatttagtgtacacacaagtacacaccacacataaagcagtcacgtttactcagttcagtatcaaatgcctgcaagcactgaatctggcccacagcctgtagctaccatcaataaagtgagtccataaaacgggcgggatgcctacaagtatgatactgtatttaaaattccctttcgtcaccgcttaggcatatgctccaggcatcatggcagcaaactcaatgctacctacgtgtgtaggtatttattttacccaaacgtaacttttgacattttgatttacatggaggaggcaagtaacacaacacgactctgacatcttcccagctgtccattgatttaactcttgaaggttcagggctactatttcacatgtaatttattcccccatcactgaaattctcaatgaccaatgtaatccgaaaaagtctgcttagcttttctgaaactagaaacccaagacaagtcaacaccagctgaaaatcaaacaaaaacagtctgtttttcatgctttcccatccttgtccctgaatggagatcttaaaactgaaaccaaagccaggtgaggtggctcacgcctgtaatcccagcactttgggaggccgaggtgggcggatcacctgaggtcgggagttcaagaccatcctgacccacatacagaaaccccatctctactaaaaatacaaaattagtcaggcttggtggcgcatgcctataatcccagctacttgggaaggctgaggcaggagaatcgcttgaacctgggaggcggaggatgcggtgagcggagatcacgccattggactccagcctgggcaacaagagcaaaactctgtctcaaaaaaaaaaaaaaactgaaaccgagctattgctgagtatctcgggtagccggtttagactgtgttttctccaaaatagggcctgtggatccaagtaagctcgagattcttcctgaagaagcagagaacagaagtgtgagcaaaaacaaggggctgacatgcacataagaaccctttataaattatcttagaaggggccaggcgcggtggctcacgcctgtaatcccaacactttggtaggccaaagtgggcagatcacctgaggtcaggagttccaggccagcctggtcaacatggtgaaaccctgtctctactaaaaatacaaaaattagccggatgtggtggcgcatgcctgttatcccagctactcaggcggctgaggcaggaaaactgcttgaacccgggaggcggaggttgcagtgagccaagatagcgccactgcactccagcctgggctacagtgcgagactccgtctcaaaaaaaaaaaattatcttagaggacggtggtcacccctgtagtcccaacaccttggaaggctgaggcaggtggatcgcttgaggccaagaattcaacacctgctgggcaatatagtgacaccccatctctacaaaaaatatatatatatatatcttatagatgggctgagaaaaatccccagagaactgacatgtttttctctactttcttcaatgccaagctgaaagtttcactgctcgggcagtgcagctctggtttcacgggggctaaattccaaagtgcggggcgggggtagaatctaagaaccacacccaagagaaagaccagtgtttgggcagcaaggcatcaacctggagggtacggacgccggagcacgcggctactcaggccgaaccccgacccggacccggcacgcggcctcggcgagggcgggcgggagtgtcctcctccgggacagccggactcccgccgacttctgggcggcggggagggctccaggcccggctctcccgggcccccgcacgcgatgcgcggcccctgcagctgctccgtgccccgagacgcgcccgaggcctcggacctccaagcggccaccgcgccgccagtcccgctgcccagggacaccccggccccagctccccgcgcgcccaccccctcggtcccacgcgcgtcagccacccgcgccccccgccgcttccgggtcccgcccgcccggcctaccgcggcctagcccgccccggagcccggccctactcacccgcgcgcggtggtggcgggaccccgggcccggctcccggagcggcgcggcgcggtccgggcccatgcgctcagcggcagcgcggcgggcgggacccggcgggggcgcggcccggggcggcccccatctcggcggctgcggctcggcggcccggaggcggacgcggggcaggccgcgggggcgccgcaggggcccagccgccagctcccacccgcccgctccgcgtggacgcggctccgggccgactccggccggctctggcggcggcagcggccacgatcgcctcccgagccagagcccgagccagagcgccgaagcccaggcccgagcgcccccgccggcggcgtccggaagtgcgggggcggggccggggcgcggggacgaggtgagagcgcggggcggggcctcaacacggggcggggccggcagcgcggggacgaggtaaagggtgtggggcggggcttcaggcgcggggcggggctgaaagcgcgaggataaagtgaggagcgtggggcggggccgacagcgaggggacaggtgaggagcgcggggcggggccggggcgtgggcggggccggaagcgagaagacgaggtgaagagctcggggcggggcctcgggcgtggggcggggaccagggagtaaggcggggcccgcctcgagcagaagaggtaaagagcgtggggcggggcctccggcgcggggcggggccggaagcgagaagacgagttgagaaacatgggccggggtctctgcatggccgggagagggcgtggtcagtgcctgccgggggcggggcgtgccgggggcgcggtcgcgccgtcttcccgaggggcggtgcggaagcggagcccgggaggctttggcttcccagagagcggagtgggagaggcggcgttgcaggtccttggaatggccgcggccgtggggagcactgggcggactgcgcgccccgaagggcgcacgtggggcgcagcccttttctgccgccagtacatcggagggcagtcagggggctgcaggcctcggggctccctgcccagccggccctggagaggaggccctcgtggggaccgccacggcctgcccgccgccgtgagggaagcaggctcccaggagtggggtggtcggcaggcagggatggccagggcccttggaaggtggggtgggctccaccctcctgagtcccaaggcagcctggactcacagcgccagggaacacgttaggccccaatatatggtggctctcacccggacaggagccacaacctccaaagagcccaccggctaggaccctctgccttgatttctcccaggcaccatctagtatcagagaagggttctccttccctccgctgcccaggccagcccgagagcaaggccattggagtgtccagacccctgcaccccttcccctgggctgtctccacagcggccctgccaaggggtccagtccgatcctgccaccctggctgcccagatccgtgtcacttgccctgcaggccacagagcatgaggtcacagccccaggcaccccacggcagagaggcacgggcccccagcagcagccccagcaccagctctggccagcccaaccctgtcagaaccaaccctctgctctccacccaggcctcagccaaccatcaggccctccccaaggaggaggatgtgagtaccaggatctgccgcctcccacaacagcccagggccctgtccttcccagagcactattgggcctggcacctcccgggatgctccaggcagccccctggggtcagctatacccccgtttcacagaggagacagctgcagttcaggccacacaggaccagctcgcctcctgttgggtgagggctccccacctcgtccgccccacacctgagacaacagccctcatctatctgccctctgctttaggcctcccagggctccctgctgcccacagcccttcagggcccttcctaagggcgcctcccccacaccttcccctagatgcgtctggccacttgcccgcctccgtgcttccgtgtccatcatgtccatacctgccagctccctccaggcacctctcacgtcacccccatgtctttccctgggctgtgtcaccctggatgcccagcctcacccttcagagctcccaggcaagcacagaagtcccagctccaggctccccgagcttccagcctacccccaaccagatgcccacaggtgggactgcatggggaaccatgtgtggaagcctcccagccctcgcccctgccagcactcagcatggtgtctgatgccagcatcgctgtgtgggaaagggggtagcatgggacaagggccactaggctgtccccagcctgccaagggcccaggcccacctcccagggccatcactgtgctcagagcaggtgggcaggggctggggatatgaacgaagctgcactgttagaccaacacctggccccgctgggtcctggccgcaggcaccctgccaggtcccacagtgctggacactggggcctccccgcaagccccctagcccattcagcctcagaaccttagaggagacagagtgggtggcctccatggtaaagcacagtttccagggatgagggagtcctgggtggccagacagacagcaggacctcagacactggcccctgggctgccccccgactcccaacaaggtccccaatgcttgccttggttctgcagagctgctgctgtgtccgggccaggctctcggggctgtgtccacgtccatcctcctcttggccctcggtggcaggtgtccccaggccctgggaccagaacaaggcccttgggcctccagctcctcggggcccctgccctgcagggacaggaagggggtcagaaagcctggaggaaatgcagcagcccttctaaagtaggttgtggtgtgggtgtggaggggagattctctgagcctagtgggggtaggaggagaccagaggcaggccaggcagaagagaggtagaggaaggccctgaggaggggcagggaggcgcgcgggggcctgtggtgtgcagggtgaggttcagccacctcccttcctcacagagctccttgaagaggcaaacgccctttgcttcgagcgtgagtttgccacgaaggcttttatttgattgaccgtagatgacatttaatcaggttttgtttctaggcaccaaatgagacacttaagagcagacatggaattattttcttcaatgtagacataaaaggtatgtttttttgtttgttggtttttggagacggagtttcattctgttgcccaggctggagcccagtggcgtgattttggctcactgcagcctccacctaccatgctcaagtgatcttcccacctcagcctcccgagtaactgggattacaggcgtgtgccaccacaccccactaattgtttgtatttttgctagagacagggtttcatcatgttgcccaggccggtctctaactcctgagctcaagggatccacctgcgttggcctcccgaagtgctgggattacgggcccaagccaccatgcccagcctaaaaggaataccttgaaaataaagtggctggcccggagcggtggctcacgcctgtaatcccagcactttgggaggccgatgcaggtggatcacgaagtaaggagttcgagaccagcctgaccaacatggtgaaaccccatctctactaaaaatagaaaaattagccaggcgtggtggcgcacacctgtagtcccagctactcaggaggctgaggcaggataattgcttgaacctgggaggcagaggttgcagtgagctgagatcgccccattgcactccagcctgggtgacagagcgagactctgtctcaaaaaaataaaaataaagaaaaggccaggcacggtggctcacacccgtagtcctagcagttcgggaggccaaggccagaggatcacttaagcttaggagttcaagaccagtctgggcaacatagtgagaccttgtctctactaaacaatttttaaaaactagctgggcgtggtgttgcgcacctatggtctcagctactcgggagcgcgaggcaggtggatcacttgaacccagcggttggaggctttagtgagctgtgattgagccactacacgtcagcctgggcaacagagtaagaccgtgtctccaagaaataaaaattaagaaaataataaagtgagttttgatgccttaagtgtgtttatccatttaactgaggaagaccacttataaaaaatgacccaaaggaaaccctggaagacaccccaaggacattagctggggagtgtttgccgctgtacgatgtgtgatggagacagccagctgcagagatggacactgtgcagccaccgaccctgcatcagtgtaaggggagcgggggaagaggacggacggttctgatccagggttctggaggctgagggaagccttgggttcagcctcttccagtctgccccttctctgccccctccgctcagtccataggtgtgagaggtgggagtgggcaggcaggggaggccgctggaggggagggaggcccctcgagggggagggaggccttggaccatcccgttcaggcgagggaggactgcactttccatcgcaggcagagcccccaccaccctccaccgccttccaggctgtaaggcgagccccagctctcatccctgagccttctttttccatcagttctgagcccacaggagaggccagatgctgcctgtgcccccatcccaagcccgacagagaacaaggagctacaacaccccagagacatgccgccaggccacgcacacagggcaccacttttcctgaaaatagaaaatgtgggcggggcgcagtggctcacacctgtaatcccagcactttgggaggctgaggcgggaggatcacttgaagtcagcggtttaagattagcctgggcaacaatgcaagaccctttccctatagaagcattgtttttaattagccaggcatggtggcgtgcacctgtggtcccaggtacacggagacaagaggatggcttgagcccgagtggtcaaggctgcagtgagctgagatggtgccactccactccagtctgggtgagagaaagacctgacactgggccaggcgtggtggctcacgcctgtaatcccagcactttgggaggtcaaggcaggcagatcgcctgaggctgggagttcgagaccagcctgaccaacatggagaaaccccatctctactaaaaatacaaaattagccaggcgtggtggcgcatgcccgtaatcccagctacttgggacactgaggcaggagaatcgcttgaacccgggaggcggacgttgcagtgagctgagatcgcgccacagcactccagcctgggcgacagagcgagactctatctcaaaaaaaaaaaaagggcaagaagactcaaaacagtccacgtgttattagtggaagcagaagcatgaagttccattttcttctttgcatgttcaggaatgtctacagggatgtaacagttatggtcccgtggaacggtctgtgtaagttaacccactgaaggagacgggcatcacggctgaggccctgaggggtggaactgaccactgggcagtgtgtgtccagcagggtgatggtcacggctgatggcagccacatcgccccacggtggcctggggcctggcatggaggttctgccaccttcctgagagacacaccctgccaggggcttcctgggccatcccagctgttggtgtcactttgggctggggcctccccggcctccacatctggcagcccccttagcactgatgtgcccctagataggtccttcctcctctccccctcacacctgtcgggcaggtgtgtcatccaactatgttgcaacacgcttcctatttggagtggtccacatagctctgtagccaaagctgcctccgcagggcagatgccccaggagtgatcctggtccccacaaaaggcagaggcctgggggaaggggagcagggccctacctcatatgccctggctccaatatcaggtcagtgtgactgtcaccatggccatggatgacctgacggcctctgcccccgggacccaccattggctgggcacctgtggtcaggaggacccacccacagagaggtggagggtgaaccactcagccgctgcggggcaggggcccaaagaaacgggtgctgtgtgtggccaggctcggtggctcacacctgtaatcccagcactttgggaggctgaggcgggtggatcacctgaggtcaagagttcgagaccagcctggccaacatggtgaaaccccgtctctactaaaaatacaaaaattaggccaggcacagtggttcacgcctgtaattttagcactttgggaggccaaggtgggcgtatcacctcaggtcaggagctcgagaccagcctggccaacgtggtgaaaccccatctctactaaaaatgcaaaaaattagccaggtatggtggcaggcccctgtaatctcggctactggggaggttggggcaggagaatcacttgaacccaggagacagaggttgcagtgagccaagattgtgccaaggcactccagcctgggcaacagagtgagactccatctcaaaaaaaaaaaaaaaaaagaaaaagaaatgaaacggctgctgtggccacagtgcttggtccccgctggctccgggtccatacttgtcccctggggcaggccccagacctgccgtcacccacgtcgcctgcgcccagccccgtccagcagacctgacagtccccacatccccgctggcctccaggggtcaagggtcaggacgccaaggccaacaggaaagcactggcaacagggcgggggcctggccagccaggcggcccagaggcggtcccctccatcccagggtactgtccacacctcccagtgtcctgaggggagtcctcctgcactgcctttctgaagagttctgaccccagggtgtccaggggctgggactggggccaggtggataccaggatgtggtcaagtaggcctgcctggagggtccggccgcaggggctggggaagtaggaggggagggcggccaccacttcccaactcgggagctgctgacatcaggggactgttgggcctggcctggcacctgcctcccaggagacctgagtgcccatccttgtcttgggccagcctgtagccctaggcaaagcaggcacctccttgtgccagtgtccccctgggcaaagtgatcgtcctgacctggcctcacagccccagaggtccgtgtgtgaccctctctgacaggccgggtggcgggatggagcccacggctggccatggaccaggtctggtgtcccaggcacattgtgagcacagggcagggcctgctggcctcccccaacctcagtgctgttttcccaaaaagaggtggcatccaagtgcaggggccatgccccgaggggcctcgcgctgacttcgggaagtagcaggtgacgtcccacctccctgggcagcctcaggccgcttcctgtccttgttggggggactcctgcccctgccacaccgaccacagtccttgtccctgctgttccctcacctgaacgcccttccctgccctgacggcctccatcccacacgcctctccgggcgctgccgcccccccgttggtgctcatctgtccttctgcccactatccccagcggccccgatacctgcacaccccagtgcccagcggttccccctcgagctggcaaggggacattaaatgggaggtgaggaagtgcggcccccagcgggcagctgcctttgccccggcccacctgcgcccccgcccacctgtgccctccgccgcctccctctgcttggctgtcccaagatgtctctctccactgcctaggaaccctgaggccgcggccaagttctgagcgtgtgactgtgtgtgctgggccccaggcccctttgtcgccgcggcgtctgtcgtggcaaacaaaagtgaaccggattagccacagtggattaaaagatttacgtctcagagtttacctaataacctaacaatcgtgtcaacgggagctttgaacccccagggcgcgcctgccaggccaactgagagctcaaggcctctgtgggcagcaggacgtggtcggggggaggagacgcagccacggctgtcctcacacccagctcggcccctgcgggctcctctgggcagaacctggggaaggcacggcctctagcaggaggtggaggcctttgaaagggtgcaggtgttgggaccaggtacccggcccaggcccccagccgcgtccacacacgtcgcacacggcagcaaggacgcaagcagtgtggaggtggccgcgtcggcgacgtatgggccccgtggtgctgcggtgcacgacctctgtgctgtcaccccacagtgtccgctcctgcacgtacacgcgtgcacgcgcacacacgtgcacacgcacacacacacaagcacgccccgctttgatctctaaaggagagtccattgacaagctcttaatcgcagctgcccttgcagggcctgtccctgaagtcccgagtaatgggatttggcgcttctgatccatcgggctggccgcttcccgtgtcataggtggacattttttttctttatatcgcttctgtttcttttttttttttctcctcgaaaaaatgctgcttaaacggcaccgacttgacatggcttgtctcctaaccttggagtggcggccgggacgccggcctggatcagtcgggggtctttgatgccgcctccatgtgaaacctgacgtggaagacccaccggggcggttttggggtccgaggtccgtcaggattcatcctgcctcaccctgctccctttgtctcttcccctgacccttcctcgggacacccggagagggtctgagggtgagggtgcgggcgctgcgtgtgggcttgcactcgagggtggggtgggccgagggcagggccgcagccgcgagaacaatgggcagaggaggcgcgtccacctgtccgcccggccgcctgcccggcttacctcacctgcctggctccgtgtgcctgctcacgccccaccgtcccgctgtccgccatgatgggcttggccgtccgtccgagcactttcagccactctgggaagcaggtccctgctcttggccactgtgtggctgggaggcagaagcgtgactctgggctgcagctcgggctcctgccgccgattggctgaggcagggaccagatgacgggcctcagaaccctatggtagccatggcaaccagcccctttagacaccgccacccccgagccactcctgactgctgagggagcaggcggcactgcccgtgggcccatgccagggtccccttggaggaacgaggtgggcatggctgcatggtagctgtccccacaacagctgttaagcgtttccgtgtgtttcattcatgtccagtgtgtggggtccttgcccctctcctggcctgtccggggccactctgtgccctgccttacccccagcagaggcagaagcactggccttgcagcccctgctgagaggaggacttcaggtcaggcttgcctcaggggctgaaggccaggcccagtctggtgggaaaataaagggtgggagcagtggaagcgggagcagggagaacttcccagccccactgggcagagccaagctctcgcccacctcagacggcaaaggctgccagctttctctccgcccacagtccactccgccaccctctcgttagctgcggcctgtggaatacgtgcacgtgctcacacagtcccgtctcacaagccccctgaggcccctcccgaggccttgctccctggaccttgggttcccactgggcaggactctgggtctttggccacactgaggagaccgtctcgccatcagtcacacacctgcggctgcacccgctctcccctgggctgcagtgccctcttgcgtcccaagaacgcctcttccctccagggcgcaccagcattggcccctggcaaagctttcccgtatgtctggagacgaggcttctcaaccgtcacccgtggacatcctgggcactgcagggcactgagcatccccggaaccaccccctgcccccagccccgtgacagccagaaacagtgttggcttgtccacgcgctctgacagcagcactgcctggccaagaccccttcgaaggcttcccctaagcccgggaagctgagtcccacttcctggcccaggcccagcacccgatgagcagaatctggtgatgaacagctgcaggactgcaaggagcaagcgagagccttgggctgctgcagcccagggaggccactaccaaggccatcagagggacccgggatccaggggagcctggagcatggtccatggggatccaccttcaagagagcgacttcggggccagtcccagggaaccgggcttggcatgggcctgggcgccgggggtctcgggccgcggctgctcccccaggactctgggcgccgggggtctcgggccgcggctgctcccccaggactctgggcgccgggggtctcgggccgcggctgctcccccaggactctgggcgccgggggtctcgggccgcggctgctcccccaggactctgggtccggatccaagcttcttcgcactggcctggttgtgagccgcctgtcccaggatggaacccggccttgaagcccttcccatgccatgctcagagctaccagcttgtctggggacaggatgtgggtagggacaccatcccaggacagcaggcagtggttagggaggatggtccaaggctggagcccgcctagggagggctgcggggcgctgcggcagagggagccaggaccgcacgggagcccaggctgctgggtgtggccatgtggccagggttccagcttgggtggctggtgggtgtcagagggacagggactcaagggagcctgggagccccacacaatccagcccgtgcctggggccagcagagggctggagttacagacgggcactggtgagagggcgagggcggccaaggactgaaggtggaggcggagccctaagcaggcccgcgggacacacagtggtctcccggcagctcccttgggctcccagcaccctgacgggggcacaggacaggagcagagttgccaagcgacccagagggcccgcccgctctccatgcccttccctccactatcctgctgctctgtgcacctgagcaggactcaggaagcaggcgagacccttggggtcaggggtcagacatggacttgtgactgggtgcctcaggccagcctcacatccactccaccctacccttcctggccttggcttccccgtctctatgtggagtgatggggtcactgacaccccttccagtcctccagttttctacccccaagggatccctgcccatagccgtgagggtccaccccggagtccaccctcaggtccacagcccattctctgcccgacaccgcggctgactgttgtcatggaaacacatggcctctgccaagcctgggacacgcgtggggaactcctggcccctgagggctccgagaggctggggctggtgcaggccggcccagggcagctctgcctcctgtggggttgatcttgctctgcacagatccctctcccactccaggtgcctgagggtctgcacgcctcagtgagggagaactggccgttctcagagacggagtccaacacttcaggaaggagcctgacaggtgtgattggtgaggatggcagaaggagggtctggtggccccagcccggcctggctctggaaggggtggggtgggcatagggagggcagggaaggggtggggtgggcgcggggagggcggggtgggcgtggggagggcggggagggcggggaggggtggccagcagccattcccaggttggctgcccgggctcccagctcagttctcagttccccacacacatgttggagccggtacagtccctgggacccctccccacaacccagaaggcagaatagcatgctggatccagctgctgggtctgtcccagacctgagtcacggtttggtcttgagggatgggtccggcatttacggaaggcctcttacctttttctcagtcaaggacttttgtggcctctgaccagaaagttgtcagggccctggccacacccagaccccacctcagtctggcctggcctcccctgcgggaggactaaacagccatgggttccatcgaggtgactggcagaggaggtaacctgctgaggccaaatgcagcttctcccactggccagctggtagcctggtcccaaacccacaaccctgagtcaacacaagtcaggacacactgataagcacgtgccaccatggccgacagggggaccgaggccagcgcctaccagcccattgccaagcctggcccctaacttcttggggcccccagagtctgacccaggaagccctacaggccttggcaggagccctgcttaccgtggggcttggttggggtgggaaagagcaggtggtgagtgaggggcagccaccgaggcctgagttgggaggtgctggacacacacaccatcagggagtcaggggcaggccgaggggctggagggggcttggcttaagttcacagctgaacacgggaactgtgcagggcagggcgtggccacaacatcccaactctggctagagctggggcacggaacagcactcatgctgtgggcagctgggctgagcctcatggccccacagagctgactgagcactgtctgtttttcataaagtgttttttttttgagacagagttttgctcttgttgcccaggtggagtgcaatggtgcaatcgtggctcactgcaacctccacctcccgggttcaagcaattcgcctgcttcagcctcccaagtagctgggattacaggtgtgcgccaccacacccggctaaatttttgtatttagtagagatgggggtttcactatgttgtccagactagtcttgaactgctaacctcaggtgatctgcctgcctcagcctcccaaagtgctgggattataggtgtaagccacagtgcccggtatgatttttatttatttttttgagacggtgtctcgctctgtcgcccaggctagagtgcagtggtgcgatctccactcactgtaacctccacctcccgggttcatgccattctcctgcctcagcctcccgagtagctgggactacaggcacctgccaccatgcccagctaacttttttgtatttttagtagagatggggtttcaccgtgttaggtctcgatttcctgacctcgtgatccgcccgcctcggcctcccaaaatgctgggattacaggcgtgagccactgcgcccggcctttttttttttctttttgagacagagtctcgctctgtcacccaagctggagtacagtggtgcaatctcagctcactgcaagctctgccttccaggttcaagcgattctcctccctcagcctcccgtgtagctgagatcacaggcatgtgtcaacatgcctagctaattttttgtatttttagtagagatggggtttcaccgtgttggccaggatggtctctatctcctgacctcgtgatccacccgcctcggcctcccaaagtgctcggattacaggtgtgagccaccgtgcctggcctaaaatttttttcaaggtcgttcacagagcaggggcatcacatgaaggcactggtgtggggagcagcaggacatgtcggcagaggtgcccggtgtggaaagagacctcgggggccctcccagggctctgaaccaggcaggtcctgaccccagggaccccttgcggccccgggagccacgtgctcccctgcagtccagcagggccaactgcagactccctctggactctgccacagcccccttgggagccaggggcccctcaatcagccagcaggcccacgtcaggcagctgcctccagttcaccccatcctgccaccagctggggctggcttaggctcaggggacataaacccccccttgtcattctgcacatgcagctgggggagccctccctctgtgctccctgggaaaaccgaatgggtccggaggatcaggatttccaggtaagggttgggggagagggtcaggtacccccaaaacctcagggcgggaaatgccttagggtgcacagcccggcttcccgctggccaaacctccaccctgcaggtcaggtggaggtagcaggaggggacaccaaggtcgcaggtccccaagttcgtgtcgcccccacctcctctaccactcgccacaacagtgctgaccagggagaggctcctgactcaggcagctgcaccagcacggccctctgagggcctgcccctcctggttccttccagtacctgcagagccagaccacagcctcccttgccctgctctgaagaatgttcgagaagggcaggaatgtgcaatggagagggaatgggcatcatccggctgcacccctggatgcccccagctacaccagaccctctaccagaggaaagaaagacacagaatacggccaggggaggtggctcacgcctgtaatcccaacactttggcaggttgaggcaggtgggtcacctgaggtcaggagttcaagcccagcctggccaacatggtgaaaccccttctctactaaaatacaattagccatacatgatagcggggtgcctgtaatcccagctactcaggaggctgagacaggacaatcacttgaactctggaggtggaggttgtagtgagtccagatcgtgccactgcactccagcctgggtgactgagcaagactccgtctcaaaaaaagaaaagaaaaaaaaacacaaaacacagaattgaacctcgctctctgcagctcaccgggggacgggcacagccagagtcaatgcccacggctcatccgaggtctcaggggcagcaagggcaggggtgacaggatcaggatccccaaagagaacaccagtcctcaaagcaaagatacacacacacagcctggcccagactttactcgctcccggccccacgggcacaaggaacactgccgcaaacgtcggggcccagcctgagaggagcctctgggcggcccaggcctcctggggatccctgccaagctggccccgggctggaaggtgcatgggcagcacacgaaaccaggatccacccactgcccaccggtggccctcacagctccccgggatctgtgtcctcagtgcaaagggcctggcagggaaagctgggcctgttggtcaggcatggaggagctgtgtggtcactggccactggctctcttctgcaccaccgccggctctgacagtgcctgctgctgcagctgctggatcagctccgccacatagatcttgaacaggggtacagggtcctgaaggagagaggggctcatggtgaggccagggaagcccagggcagctggagttccgacggggatgggatcagcagctgccgcccagaggaaccggggcatgagaggccctggagggcagagtcctgtcggtgagatgaggaaccccctcccttggggatgccggaggcacacacatacccctgtcccatccctgtggtcatggataaacagagggaataggggcagccagctgccatgccatcaggggctccctgtcctgacagctacctcaggctccagaccctgggatgctggtggccgagcaaaccctcagtgcaggaacccactcctcctactgagggtcctgggacagaacagggtggggacttggaggggagggagcgggccatgctcctctgggtgggcaatgcagagcagcagctcttccccaagcccacccagtgcaccagccccttgtgcaggctctctccaaggcagcacactcccagaccctgaacaccaggctctgggcaggcagcatcggctggtgctcacacactcaccttctcctccaaaagtctctgcttctcaatggcctcctccagcgtgaggcccacccactctgcctcctcctctgggatggcaaattcctaggcaggcagagatggaaagggcagtgaggcccagggccgggccacgagtccccaggtgtagggagcgggacggaaaccctcaccttgtacttgtcgtagatggctgcccgccgctcggggtcctcggggtgcagctgggggtcctgccgggcaagccgcagcagcatccctcgcttcaggtccatcccaaacttggagcacaggtcctccttcggggtctggcagaaggctcacatggggccaggtgctggtggcagggccccacctacccttccagccaacccacctggctcctctctagccgctggtggtcccaggacaggacagagaaggcccgggtggggccgcctcagcaccccagcctggggggtgggatcagcacagaagcaagtccaagtgcagggaaaggggcggctgtgctcgctcaggccccacgggcaagtcagccacccacagagcgacagcctctcctgaaggcaggaaaccccactggtgctggccagaaaggggcatggccccactcacgctttcccagtgaccctcctgtgcagatgtcagcgtgccccggtgtgatgctgacctggggctcccgtgagtctgactggcccatcccagaccctgtgtgcactgactcgccccaccccgcttgccttgaggatgtaaaagtcgagcccataagcctcatcgatgaggtccagggtccgcatggtcacagtcactgtgaacttcttgtccaggatctcactgtagaactctcgctcaaacagctgtggcttccacactttcttcagcctcttggagagctgagggtgcaacagagcctccatgagtactgctgctttctcttacataccaaggggggcccaggcaactgccctcacctcccccccggaggctccatcacagaaccactgctgtcagactggggacctagagctaactgggccggcccccagcccagtgccgccccagcccgacccgggtcctgactgtgtacccagaagtcagctgctccccaacaagctgggcgttcccgccctggtcacatggttgctgcatgtgtttcagaaacatgtgcgaccccacagtttacaggttgtcacattccaacctggaggtgacacaagtctccccacaggcttcagcagtcccgccaggaagtccaccacaagcagcctcgaagctctgctcgcctcccccacctgctctgctcgcctctcccacctgctctgctcatcacacaggcctcctccccatcctaactttaccccgactccccacggcctctggttgctcccccggcctgagtcaccccacctcacccctactttatcagtcctgtttgccagaactgcggttcttcactcagcgtgctcctttgccggagatgtgtcgcctccaggctgtaatccccagggcccacccaggtctctccaggtaccccgggcgtccggcacagagccggcacagccaagccctgagaggagcccctgaaggccgcctgcggacccaccttgtcgttgttggcatatatttggcccaggatccagccctcgccgccccacaacccccgctgggattcggggggaaagtagatgggaatgggcacgtcctccacacgctcccgctgcccgttcttggggttgatcttgaacttggccccatgaggcctatagtgcacgggagtgggcgtccgctcctcctccagggagcgcaggtagtggccgggcaggcgggaacagatgccctcccgcagctgcagccgcttccagagccacacgggatacttgtgtagaggcatcgcgagcctggcgggaggtgggggctcgcagtcagtcgcagcctggccaggcccccggcactcaccccctaccccggcccccgactctcacccgctaccccggcccccggctctcacccgctaccccggcccccggctctcacccgctaccccggcccccggctctcacccgctaccccctaccccggcccccggttctcactccggcccctgtcccgcacccacctgcccctccccttctgccccggcgcccccccacaccccacctgcccgcgcccacctttcagggttcagagcccaccggaaccggaagccgatctgccgcgcctggccctcctcccaccgctgactggctgtaaaagccatccgtctaccccctcgtcccgccccgcttccgtctttagggaccgtaaaaaacaccccacatacagcagcagcagctcaaggcaccgttagctacgtgcggccccggcgtttccgcgaagggcggcacgggcggggcggtgcttgttctcccgggccccacttaccctacccgggaaggagcacagaaaaaatgtaaaaactcgtttagtttgaaaaatcaatgtagaatattaaattcaccaaacacagatagatcagatctacataaaaatatgtcttaatatcttagaattttcctttactccaaaaaaccccatatatatatgtttctcctttataagcttagagattgctttggtggtcaagtgcagggcggctgggggaggtaagaccttcaggaaggccatatcccggacaagacccagaagggaagcccccagagccaagggtaggagggccccacccgggtctcagccactcacttctccagggcggatccgagacactcacaggcctcagggaggggccaggtgctgctcctggtcattgcttcccccacaaggtttgcatgaggagcagagacagtccagtctcctgaacacccacagggcacagagcccagtgcagggggcagacaccaccgcagctcctgggaccaagaggaagctcccagaggggggcccaggaacgctggggtgggtggacagggctgggtaggggttccttctgggccaaacccccagagcagcagagcaccccagtccaaggaagctcttctcagggacccaaggctccagagccaggaaaaagggaggggcggggcgggagcctgcatccccagtgcccatcagctctgggggaaacctccgtctcccgtccctatggtgaccacagcagcagagggggatcctccatgccccaggcaggctggcatcagggccacacaggggccaggagcaggggtctcggagtccacagctcccggccccagtggtgggctcagggctcctgggcgccatgggtctcaccacagcctcgccagggaacaggaccatagggagtccttctccccatctctagccacccacaggccagcagagcacacagccccaccctcgcacaggcacctgtggtctccaagtaaccaagcccaggccccaggggccactgcagacagcagctgggatctgcagagggatctcagcagcgagcaggcagctggcgaggagaggtgcgtgtgagggaggggtggccctctcctcagtaggaggaagtaagagggtatctaggccaatttattcagctggaaatcaatctgtccagggctggaccaggcgcctccccctcgatacagctcctggctgaagaggtcatcagagcagcagctgtccccaggccagtgtcacgtcactgcgtacagttcctcccgatcgttcttgcagatctgatagtggcaggggaatttctgcgagcaggcccagggctcggcgggctggtcaggtggcggcagcagcaaggctgcgctcccggccagcaggatgtgccagatgctgtgggtgtagtagtagttgtcgctagtcatcatggaggtgtagatggcgatgcccacagaggccatagagacgccgggcaggaggtagaaggcccagcgctgccacgaggtggggtagcactggcgccggtgcccgcagcggtaagcctggagaaaacagccacgcaggtatcagtgcaggtggggccgcggctgcagctcccagggcccagatacggtggttactgggggcctgcccaggtctgggcagcagaacgacaagggtgggctgcttcgagggggctcaaggccactggtcctcaggcccaggcctcagggacacagccatgctgggcctctgtgggtgccatggcaacccccagcagatatgggcattcactggttggagcaggaccaggaacgtggctagagcaaggggccaggctctcttctccgagcacctgggcagcagtgccagccagcccggctccttacccacatggaggccatgatcacgaaggcaaagaggcagggccccagcatgttccacatgcccctgcggtccagctgcaaggacatggcgatgaccagtgtacccagaagaaacagcacctgcgcaagacacagggatgactgcagggacgtctctgagggctcaaggcccagcaggagcacgcgtaccccacggccccacagcacctctgcctgccccctcggagctgctgccaccctcagaccagctctgccagcctctgactagctctgccagccggcagggacatgcccctccttcagcttctgtattgcatccacaggtgaatgtggccaggcaggcatctctgggggattagacgatgctcacacaaactggacagacgcatatggccgctctgcacccacacactcactagccccctgtaccactgggtttctagaagtcccccatcagggtggcttcagtctcccacccactgttccatggggaggggctcccaccccccagtctccatcagacacctctgcccacagcctacagttctctgcctatctgcaggttcaggccccgcactcagccctgcaggaccctggtgcttcccagcctcccctctgccctggctgtggggctcccatgggcacccccttggggcagtacccagcctgcagttcccagagcagatgggagggcagagcatgcagctcacaagcccagggcatgagtctccccttgccagggccagctgccacagagagtccccaaagcatcattggccccaaggacccagggagcatgggtgggggcttctcgaaggcagggggcctggcctcccctgcctaccaccttccttcctggcatcctccaaacagctggcactgccccctcacaactgcctgcggggtctcagacccgcatctccgtgtggcatcacagaagacatgaggtttcttttcttttcttttgtcacccaggctggagtgcagtgctgtgacctcggctcactccaacgcctccaatgcctgggatcaagcgatcctcccaccttagtctcccgagtggctgggaccacaggcatgtaccactacgctcggctaacttttcgattttttgtacagcccaggctgctcttgaacccctggcctcatgggatcctcctgcaagtgttgggattacaggtgtgagccaccatgctcggccaaggcattacaggtgtgagccaccatgctcggcctagggattacaggtgtgagccaccatgctcggccgagatgtgaggtttccaggggccgtgcccaacgccaggtccggcctctcccacggtactgcctttcgcaggctgcacttgggggccctgctcccccggagcccacaccccacgtcgagggccactcacgtatttcaggactgtcttgagccgtgccatgcacaggatggtgacccagatggccgccccggagcccaagaagtcgcagtactgcagcgtgtcgtagctgaggatgcacagcaccgcctccccgggctggtcgcaggcgtggtagaactgtggggaggctccatgagcgcggtcctgccctcccaccccacatccctgcaggaggggccagcctaccgtggagaagaacatggtgtaggcgtagacggaggcctccaccaggaagaatcgccgcactgagacggcgatgggggccaggaacatgaggttgctgagcgtgagcagcagtgtggccgccctctgctgggccaccgtctgggctgtgctgttgtccgtgcagctccacccacgccagcctgcggtcacaaaaccccgacgcggaggctgggggcactgctgaacctcagggcccacccctcacccaggaccctgcagagaagccccttcctcacccaggagcaagcagggtaggcacggcgggcggggtccaaggtcaggaggcagtaccaccccccggggatacctggtgcctgtgccaggcagacggattgttggtggggaatgggggagtggggaggaggctttgcccctgcattgctctgcaagggtctctctccagccccttgcggcgctcccccaggggaaaggcacagcacagcactggaagccaacagcagcagcgtctcggggcgggcggggccctggcactcacctgccttgcagctgcagctggcatacaggtagctgtgtctgcggagcaggaggcactggccatagggtccacaatcgttcaaacagggcaccaggtacaaggtggtctccacgtggaccacagcctgctcacagtccctttgaggaaggggccacaggaaagctggtgcagtgatctgacagcccagctgccaccagcgctcccaacaggctgacagacatgagaacgcagcattagggcccccagctttcagcagccctggaggaagcacccctctagctgggtcactccgaacgccaacctcaggcagcccggcctgtggtcctgagtgaaatgacagggtgcctggcccccgtctctgccctaggtttacttactcagcattctcagggcacatgagctgcagggagaggtaccagttgtctgtctctgggtaggggatgatgaggttggccctgcgagaccaggcgctcagagacaaagggtagccctggaagaaggctgcaggggagccagagggccccatcagaggaggccggggcggggggctggccggggccacgctgacggtgacgcctgcccatcatacctgtggtgcagttgagcgaagtattgaagccaaggaagggcgaggcagcattcacgcaggccactacgacggtctcgttccgcatctctgtctggaaagggaggcggtgccggctcagctccagcagcccctggccgcagtggggtcatctgccccacgtgccagctcagcctggtgctggtgcctttctttttttttttttttctgagatggagtcttgctctgtcgcccaggctggagggcagtgccgcgatctcggctcactgcaacctccgcccctgggttcatgccattctcccgcctcagcctcccgagtagctgggactacaggcgcccgccaccacgcccggctaatttttgtattttcagtagagacggggtttcaccgtgttagccaggatggtcccaatctcctgacctcgtgatccaccctcctcggcctcccaaagtgctgggattacaggcgtgagccaccgcgcccggccggtgctggtgcctttctctgagactcctgcaggcccacggtgcaccgggaccttcctccccgggccctgggacatcctgcctccaccccacctctgacccgagctaccccacagccccggggcctgttgacaggaacaaggctgcccagcaggggaggccccccaacatgggcccctgtcttggcccgtgcctgctggtgtcactgtgccgcctgtcccgtgccaaggtaaatgaggaggcgctgcaggggttgcccggcgccctgcccgagcccaggccacaggccgcttgcagacagcaggtaccttgttggcccgcagggagatggtgagggaacccccgctgtccatgccggtgttcaggcgcagccgcatcacggagggcgtgtccgaacacaccctcaccgagaccctgtccaggggctggaagtgcaccgacaccacgtccatgtcctcccgcgtgactgggtagtttgtgaggcagaaggggctgcggtccaccctgccactcctgcccaggtcctggtggtcggggctcggggacagcagaccagaggaggcattgaagctctggttttggctgctctgcagaaggggctggatggtcacgctccgtggcctgcaagctgccgagaggacaaggggtttggctggaggaaagtctggggatctggggaggggcagggccatccctccagcccttgtgcggcccacctgtgagggcagctacagcactgaaagccactgtcccgaggggccccaccaggctctcagctgtcacttgcagccaccggtcccagggcggtgagggcagcagcaggcggcagggccagggggcaccggtgcaggtgagcaccttctggaagttgctaggcagggtgaccgggcccacggtgagacgcacggggcagcccaggctcccattggacacgcagtcccgcagctccagcagaagctcccgcgtgtaatcggggacaaagaccctgcagcgaggggacacagctggctcaggctctgccattcctcagcccagggacgcagcgtgcccaggctctgctgttcctcagcccactctggtgggggccaggcatctggaccacttcccagcccaaccccaggactcagggccaggctctcgcacccactccaccgaatctgagaaggggccggagggcagagccgggctgccccccaggcccccgctcacttgaggtagctgggatgggagaggagggtctgaggaaggggcacgtccggctccatgatggaaatctcgaccacccgcgtgaccagcagttcaggctggaagacgtaggcacaggtgggagccaagccctagggaaagaacaggtgtgggcgggggcggtgtcagagaatgcaggtgtgagggcatggtctcaccagacgcccccggcatgcagggagcagggctggccccagagtgcagcgtggagcctagagcgaggaccaccccaaagaggtgaacggcagggacaggccatcgccgcaaggttctctgcctccatcccggagggcagcccccctcaccttcaactcgatcttctgggatgaggggggcaggtgggcggccacgaaccagtccccgggggccgggtgggaaacgttgacggaggcattgcttctcggtgtggtgctcagcggcaccccgacctggaaggagggctgtaccgcggtgtcgtccgggaagctggtgcccagcgggttgatgaccggaggggcgccggaacggaagtgcctggagacgggagagcagcaccgggttcaggcacagggcttggccaggcgcgggagggtgggcaggcgggcgggcagccacctacacggtgatctccgcgtcggtgcaggcagcgccgctctcccgggagacctgcaggagccagcgtagaagcacagcatctgggggcacgcggaagcggaagagcctggcactgccgtaccagctgtagaaggacagcctctgcggggcctgcgagaagtgctcggacaccagccccacctctgtgaggagaaggaggtgtcagccaggccgggaccctcctccagggccgcagatggggaggacgagtcccccagatggaaagggctggaagcccccggggacccacctggagatcttggcacaccaactctgaccttggcaaaggtcaccgacaccctctggcccctcagccagatcctctgctgtccctccccagatggcctacatcccaccctcctggcatctgggtcttttcacagctgccgcctcactgcagcagcttccaaacaagccgcagggtacctcagcagccatcgccaccctgactgccatcgccacccgcactgccatccccacccgcactgccatcgccaccctgactgccatcgccaccctgactgccatcgccacccgcactgccatccccacccgcactgccatccccacccacactgccatcgccacccgcactgccatcgccacccgcactgccatcgccacccgcactgccatcgccactctgactgccatccccacccgcactgccatcgccaccctgactgccatcgccacccgcactgccatcgccacccacactgccatccccacccgcactgccatcgccacccacactgccatcgccacccgcactgccatcgccactctgactgccatccccacccgcactgccacccggaccccctccaaccttagaagactacactccccatggccaacccaggtcgaagccgaaggacccagcaggtgtcaggaaggagcccccgcccctcatcacagatgccctggatatcaaggcacggtcctcccacctcctctcagcctcccacatctccatccctggatgggttggctgcctgcttgggctatgatgactttggacacggcgagaccggagcccaaattccccttacccagagggagatactgcatgtgggagggacccaggccagaagcctggccagtcatgagaacaaggggacagctgccctctgcgttccaagcgggcaaggctcctaactgtcctcagggaacgcacccacgcctggtgcggggatggagaagggcccgtgggagacatcctgctcatggccccaggcgaggactcaggctctcacccccagccccccgtgccagctccagcctcgtgcccttgcgaccttgggcatccttccctccctgggtcccagccttctcctgggtaggtcagggcggagggcacatccctttgggggcccctccctccgaggttaattaacgacaaaggcttcagaaggaaaagcacagtggacacagcagggggcgggaccctcccctctgctgcagctccccctccccacacactcaggagcgctgcctaggtctcactggagagtggctggctcaggcccaggcccctcctgaggagggagacaggtgagcagcaggctctcctgccagcctcgtgaccctcccatagaggcaccagaagaaacgatacacctgccaatagcagcctgtcggcaaatccaggccaagctccaggggaacctggcgtggcgactgggcaggggctggccaggctccacccacgacgcactccaggctttccaggtgtctgctggccaccaggtcccacccaccaggctgtggcctgataatgtgggcagagaaagctcaagtgctgggagctgaagcaggacagccccccaggaccacggtgtcccggagaaagccggcctctgcgggggcaggcaggggaggccacctgcagcacacacagcccctgggctgctggggcaaagccctcagcccctctggccctggagcgccagcctgagggcacctagaacccagctggtggctgtgaagtttcagcaggtacacagagataagagatctgttcaaggttgtcctaacacccagtccccgactcccagggctcacagcccctccaggcctctcccagggctctgcagcccaagctccctgcccaagttgcccacacataccaggctgttaggggtgctctgagccgaggtgaccacagggtgaggagggccagctacacagccccctgcctgccccacagcccctccacggacacagggctgggtggggaaggtggtaatgcaagtccctggccctgtcctgggaacctgagtgaagaccccagacccacgtcctccaaaccgggacaggcacccatgggagaccctgaccacccacaacgccacagagcacttactcctcggcaggctgggaggagtgaggggctgagccagcacaccaggcctctccactgtccacacacaggggttccatctcccaggaacccctcaccaggcctgagttctgggacaggagaatttcctttgccagtttccaacggagtaaggttttggtatttctgagggtctcactctgtcacccaggctagagtgcagtgccatgaacacggctcaccgcagcctcagcttcctatgtaactggaaccgcaggcttacattaccacacccaggttatttttttttctttctgtctttcttttttttttttgagatggagtctcgctctgttgtccaggctggagtgcaatggagcgacttcggctcaccgcaacctctgcctcccgggttcaagcgattctcctgcctcagcctcccgagtggctgggattacaggcatgcgccaccactgccggctaattttgtattcttagtagagaagggggtttctccatgttggtcaggctggtctcgaactcctgacctcaggtgatccacccgcctcagcctcccaaagtgcgggattgcaggcgtgagcttcgcgcctggccatggagcaatttaatccggggcacggtcctcggggaaaactgcctttcatctctacctgtgccaagctcagaaagcaggaggcacagcccccgaaagaaacaggagctcaaaggagcattatttcaggggcaggggaggggaggggctgggggccgggaagtcggggaacagcaccgcatcagctgccgggcacctgggcacccgcgtggctggggacgtgtgggaacttccagccggccagaaaggacacggcccctccagagtcccaggccacagaggccggggcaagtcctcaccatctcagggtggccaaggcctgacggtctccacacccacgtccctaccccgtggaagggctacgccttctccctggtccagccgcctccttggacctcagtcagggacggggaccctcagggaacagaaatgcaaagggagcccggcgagtttcccaacaagaggggagaggggcgccctttcctcagcccctcttccgccagctgggagtccctcctcccagaagccgggccggcggcaggaagcggccgtaccagggctgggggtcactgcggaagggctggagccatgacgcccacgggcccccgctacagggtctaacaactttctcccggctctgcccctctctcaggccggacccggccggtgagctcacggcccagccactcctcccagctggagtcccgggcagagtcccctgggcccctccacttccccgcgccgggcgcgccggacctgggcgctctgggaggaggagggaggggagggggcgctccaggggccgatgtggcccaaccccgatcgggggaccgaggaggaagcgcggggtcccgtccgcctcgacccctaggacacgaagcgccccaaagggccactgtgcacccccaacccgcggcggggacccccaaccccgcgccggcgccagatgagcgcacaggtgcgcccggggtgtcacaatcccgccccgcccgcagccccggccccacgcccccgatggcgcccgcgcctcccgctcaccgctcttcccgctgtagccggcggaggcaggcgggggccgggcaagcagcagcagcagcagcggccccgccaccaccgcggccaccgcctcgcccccggtcccggtgccagcccggcccatggctccgcgctcggcccggcgctacccggcccgcgtcccgcgccgccggcccccgccgccgcccgggcagcctctgccgcctccgcctctgccgcctccgcctctgcccccggcgcccatggcccggccggtccccgccgccgtcgccccgggcacttccgcccgcaggccccgccccgcaggccgagccgggaaggcgagggcggggtcggggggcgggaccggggggggcgcggacgccggggggaggggtcacgtggggcgccggtaggggggaggggtcacgtggggcgcgcgggggacggaccggggcgcgcgcggtccggggggacgctggagggagggcgcgggatggagggatcgcgggggtcccaggacggagaggtcgcgccgggcgcgctcggaacacgcaggaaattctccccgaggcgtgggctccgcggggcttccccgccggttcgctgagtcccagctccgctcggccgggacctccgtggcaggctcggggagcccgcggggggcagaggcgccgacctccgcctgggaccgagaggaacccgcgccctgccctgccccgcccggcgcgcgtgggcctgagtcaggcgcctcagcacggggacccccgggccggccttcacgccgcagagccgctgcaggtgcgtgtcagatccacgcttttatgcacagacgagaaggctgcttgtgtttagggactgtagtacccgatcggggtggcggttcacacgggtgcgtggcatcaactcccggcgctttgcacctggatggattcccaccatgtaagatttgagccgaaaaaaggaagcgataaagcctagaaaactcggggaagctttttccgtcttagggccaagtcggcttttccaagcgtggcacagagtccagaagttccgccgcgtcgtgggtgggaggggggtgggggcgtctgcaaagccaaactgcataagcgaagtccaaaagacgagcccccgactgggaggtgggggacacagcttgcagctcacaccgcagagctcaccttaataagactagtaacagtgcagtaataaacagctctaaatcaatcacagaaacgctcccctagaaaatactgaaggacagctgccagggatacgctgatcctcctccctcagcgcagaaatgcaaattaaaaactactccagctactccggaggctgaggccagagaatcgcctgaacccgggaagcggaggttgcagtgagccgagatcgcgccaccgcactccagcctgggcgacagagcgagactccgtctcaaaaaacaaaaacacaaaaacaaaaacaaaaacaaaaaacaaaacactaaagtgtccttcccaggatgtgagggtaaaaagtttaaaaaaaaaaaaaattaaaggaaaaccccattaaagtgacttctttttcctttcacctaacacattggcaaataaaaactgtactaacaggtgagactgtggcccacagacactgcttgcagcaggcagaggatgtgggagcctcgtgggaacccccccgacttgtccactgaagtaacagcagcaatgaccttccctcgggaattccacctctgcgtttttccctccaggtacgttcacggaagtggcacactgcatgcgtccagtgagtcaatgtggcaccgcctacatgcgtgtcactggccggtgggacattcaaatcattcatacggggtctaaacgagacagagcgtggccgagacaggaaagacaggaagcgctgtgctgcttggaaatggtccaccaggtgcagcagtagctgcaagaaaggaacaggaagaacggtgtgttcaaagctctaccatttgtgtagaaaagggagaaaaacacgtttcctttgtgtgtgtcaaaggcatcgaatgtctggaatgatccagcaccggctacactggttgaccttggaggaggagaggcggggtggggatggggatggccgcagggaccatacctgtttgtaccttttgaacgccgcagcgggtggtgagggtttacggagcgggggaggggaagctgactccacgagcccagacccctgaaggccagagcagcggaggtggagggtgttggccggggaggaaggaagccccggctgagccttaaagagaccctttgtttcccgggaatcccagctgggccgtcctcagccccgactgaggggaaaggggggctcccaggggttctcattttaaaggcacggaggtcagattgcagattttgctgagccgtgatttgagtgtgctgtgccggactgcacccagcaaccaaggtcagcaccagcacccaggactgctccagacccagtccctgctccaggctgggcccaagcccccctcctcccactgccctcccctgagtgagtcaccttagtctgaggttcctgtgccccaagtcacccaccggagagggagagaagcggcagagcccccacttccagtgctccagctgagggctggtgaacttgaaggtgggtaagaatccccagacggaagtccagagacgtctgctaagtcacagagtgttggcaatggagagactcttctgtaacaggaaacacagctcagtcaggctactggtcagggaaacaaaacaagccactttgtcaaaaaacagccacgcagcccttgccacaacagatgctcacactttgctggcaggcatgtgaaccccctcaaccttctgaaaattattgtgccaacattaaaatgtaatggagagggccgggcgcggtgtctcacgcctgtaatcccagtactttgggaggctgaggccggcggatcacgaggtcaggagatcgagaccatcctgggctaacatggtgaaaccccttctctactaaaaatataaaaagttagccgggcgtggtggcaggtgcctgtagtcccagctactccagaggctgaggcaggagaatggcgtgaacccaggaggtggaggttgcagtgagccaagattgcgccactgcactccagcctgggcgacagagcgagactccatctcaaaaaaaaaaaaaaagtaacggagaggccgtacgcggtggctaatgcctataatcccagcactttgggaggctaaggtgggcgggtcacctgaggtcaggagtttaagatcagcctggccaacatggcgaattatttttgtctctactaaaaatataaaaattagccaggcatggtgacatgagcctgtaatcccagctactcaggaggctgaggcaggagaatcacttgaacccgggaggtggagcttgcagtgagcagggatcaggccactgcactccagcctgggcaaccagagcaagtctccatctcaaaaaaaaaaaaaatgtaatggagaacactaaggcctagagacagacacacaaggatgtttgcagcagaactgcttgtatttggaaaaacctgggcgctccatgagggcaatgggtaaataaatcatgctataatatactctgattttttttttttttttttttttgagacggagcctcactgtcgcccaggctggagtgcagtgatgcgatctcggctcacgcaagctccacctcccgggttcacgccattctcctgcctcagcctcccgagttgctgggactacaggcgcccgctaccattcctggctaattttttttgtttttagtagagatgggatttcaccctgttagccaggatggtctcgatctcctgacctcatgatccgcccgcctcggcctcccaaaatgctgggattacaggcatgagccacagcgcccggcctactctgattttttttttttttttttttttttgagatggaatctcgctctgtcgcccaggctggagtgcagtggcgcgatcctggctcactgcaagctccgcctcccaggttcacgccattctcctgcctcagcctcccgagtagctgggactacaggcgcctgccaacacacccggctaattttttgtatttttagtagagacggggtttcaccatgttagccaggatggtctcgatttcctgacctcgtgatctgcccatctcagcctctcaaagtgctgggattacaggcgtgagccaccgcgcccggcctactctgaatatttatgcaacttttagatgggtctataaatgtgtcttcagaaggaatgtcagtaaagtgaaaaatccagttgctggataacagggacgcatcgtatttccaaacaaacaggaagaccctcaagccccctccccaggtccccctctagtgagcctgggtgagggtagactccagctgcctgcagcctggccggaggggagggttgctgggtgtgggagcagctttccacagtcggtgtgctcttcgcccagcagcaataagcattattatagttgtcttggataaaaatatcaaaagttaaataaaagcaaaaaaaaaaagccgtaatccaattttctccaaataaccaccctgtgcacctcctgcaaatgcttcctgtgtgcaagactgtgtgaggacccctctctctctgtggacactctcccaggctctgcaggttgaaaggagtttccctctgtctgttcatggccacctggtagacatgggagaccctgtcttcccactccgccccgagtttcctgagggcaggagatgggtctctctcactctgtggtcaggcaggaggagtgcagaccgtaaccctgtctttctgacccagtgccctaacctgtcagcatgaaccacaccacaggtgcccagacatcagagtttcacagacagaaatagtttccccagagttttggggcttttttaggctcaactatcatgcattattattctttcataaaaaaagggtcattttcccagcctgggcaacatggtgaaacccagtctctacaaaaaaaaaaaaaccaaaaaaaaaaaaaaaaaaaattggccttttcacaagatggcgctgaaagcaaagaaggaagctcctgcctctcctgaagccgaagccaaagcgaaggctttaaaggccaagaaggcagcgttgaaaggtgtccacagccacataaaaaagaagacccgcacgtcactcaccttccagcggcccaagacactgcgacgccggaggcggcctgaatatccttggaagagcacccccaggagaaacaagcttggccactatgctgtcatcaagtttccgctgaccacggagtcggccgtgaagaggacagaagaaaacaacacgcttttgttcactgtggatgttaaagccaacaagcaccagatcaaacaggctgtgaagaagctctatgacggtgatgtggccgaggtcaccaccctgattccgcctgatggagagaagaaggcatgtgttcgactggctcctgattacgatgcgttggatgttgccaacaaaattgggatcatctaaactgagtccagctgcctaattctaaatatatatatatatatatcttgtcaccataaaaaaaaaaattgtagccaagcatggtggcatgtgtgtctgtagtcccagctactccacagcctgaggcaggaagatcccttgagcccaggaggtcaaggctgcagtgagccaagatcgcaccactgcactccagcctgggtgactgagcgagaccccatctcaaaaataaataaattaactaattaaatcattcaagggctggggacggtggctcacacctgtaatcccaacactttgggaggcagaggcgggtggatcacaaggtcaggagttcaagaccagcctggctaatatggtgaaaactgtctctactaaaaatacaaaaaactggcacgcacctgtagtcccagctacttgggaggctgaggcaggagaatcgcttgaacccgagaggtggaggttgcagtgagccaagatcacatcactgcactccagcctgggtgacagagcaagactccgtctaaaaaaaaaaaaaaaaaaaaaaaggaaaggtcatttcccaatccaaaaaagtaggaagtatgtaccctttttgaaggggatctgctcctccacacctgtgggtatttctcgtcaggtgggacaagagactgagaaaagaaataagacacagagacaaagtatagagaaggaaaggggggcccaggggaccggcgcactcagcctgagaggacctgcaggggcgctggtctctgagttccctcagtatttattgatcattatttttactatcttagcgaggggagtgtagcaggccaacagatggagagaaggtcagcagggaaacatgtgagcaaaggaatctgtatcatgagtgagttctaggaaaggtactgtgccgggatgtgcacataggccagatttatgtttcactttacataaacatttcagtgtagcgaagagtaacagagcagtattgctgccagcatatctcgccaccagccacagggcggttttctcctatctcagaatagaacgaatggtcggctttacaccgagacattccattcccagggacaagcaggagacagaagccttcctcttatctcagctgcaaagaggcctctctccttcactgctcctccttagcacagacctttttacgggtgtggagctgggggatggtaaggtctttccctccccacgaggccatatctcaggctgtctcagtgcggggaaaccttggacaactcccaggctttcttgggcagaggtccctgcggctttccgcagtgcactgtgtccctgattaatcgagaacggagaatggcgatgacttttaccaagcacactgcctgcaaacaaattgttcacaaggcacatcctgcacagccctgaacctattaaaccttgattcaacacagcacatgtttctgtgagcacaggtttctgttaaaattacaggttaacagcatctcaaagcagaaacaatgtttcttagtacagatcaaaatggagttttctacatagacacagtaacaatctcatctctcttcttttccccacacttttttttttcttttgagacgaagtctcactcttgtcccccaggttggagtgcaatggcgcgatctcagctcactgcaacctccgcctcccaggttcaagcgattctcctgcctcagcctcctgagtagccgggattacaggtggacaccatcatgccccgctaatttttgtattttttagtagagatggggtttcatcatgttggccaggatggtcttgatctcctgacctcaggtgatccgcccgcctcggcctcccaaagtgctgggaatgacagttcagttttttgttgttttacattcagtccagctttttgttgttgttttacgttcagcggatggcagtagacgggtttttctttttcctttttttttttttttattgagacagggtcttgctgtgtcgcccaggctggagtgtagtgggaacatggtggctccctgcagcaatggcctcctgggatcaaaggatccccctgcctcagtctcccaggtgattacaggccagcaccagcacgcccagcagtggttcttatttatccccattttgtctgagcaaatgaatgcctgtcctgggtgtgggtgcgagtgagctggaagatgaagggcatgggcagtgaccgcacagcgctcagcctgcagggagcctggggtgagtccagcagcactggagcgcggaaccacagcagatgtccttgtcccttccaaggggtgggaacaaaggtgacagggacagagatggctgccggggtaggaggcccaagagttgctctctgctgagaaggctccccttggtgtccctcagaagtgtacctgggcgggccgatgggactgggactgaggctgtgctcctcctacaaggaggggcccactcttcctggatctccctgcagtgacctcagcagaggtgaaagaggtctagccgggcacagtggctcacgcctgtaatcccagcactttgggaggctgaggcaggcggatcacctgaggtcaggagatcgagaccatggtgaaaccccgtcgctacttaaaatacaaaaaaaattagcaaggcgcagtggtgggcacctgtagtcccagctactcgggaggctgaggcaggagaatggcgtgaaccggggaggtggagcttgcagtgagctgagatcccgccactgcactccagcctgggcgacagagtgagactccgtctcaaaaaaaaaaaaaagaaaagaaaaagaaagaggtctagcctgtgtacacgtggaaatccaagaggacagggaagacaaactgagacagaaaaaaaatatgtgaagaaataccccaaattctaaaattcggtgaaaggcattcatttacagattcaagcagcttagtgaagcttaacaagaatcaatgcaaagaaaaccatagccaattacatcatagtcaaactgctggaaaacgaacttatagagaaaatattgaaagcagacagagaaagataacacattatagtccagggaacaattgaatggcataacttcccattagaaacaatggggtccagggccgagggctgtggccacgcctgtaatcccagcactgtgggaggccaagatgggaggatcaacaacagcttcatggtttctaacgggagttcaggcgcgcaccactacacccacctaatttttaaaatttttttgggccgggcgcggtggctctcgcctgtaatcccagcactttgggaggccaaggcaggcagatcacgaggtcaggagatcgagaccatcctggctaacacggtgaaaccccatctctactaaaaatagaaaaaattagccgggcatggtggcgggcgcctgtagtcccagctactccagagactgaggcaggagaatggtgtgaacctgggaggcggagcttgcaatgaggcgagattgcgccactgcactccagcctgggcgacagagcgagactccgtctcaaaaaaagaaattttttttgtagagacagggttttgccatgttgcccaaactggtctccaactcctggcctcaagggatccacctgcctcggcctcccaaagtgctgggattacaggcgtgagccaccgcgctcagccagaataaacatttttttcaagcgcacacaatttgttttccaatacagatcacatgctgggccataaaccaagtctcaattaatttaaaatagtttaagtggtagagaatatgtcctctttcattaattaatttatttatttatttattttgagacggagttttgcccttgttgcccaggctggagtgcaatggctcaatcttggcttgctgcaacctccgcctcccgggttcaaatgattctcctgcctctgcctcccgagtagctgggattacaggtgcctgccaccatgcccagctaagttttgtatttttagtagagacggggtttcactggttggccgggctgatctcgaactcctgacctcatgacccgcccaccttggcctcccaaagggaatatgttctctgaccacagtggaattaagttagaaacctgtaacaataagatatcaggctgggcacggtggctcacgcctgtcatcccagcactgtgggaggctgaggcaggcggattacgaggtcaggagattgagaccatcctggctaacacggtgaaaccccgtctctactaaaaatacaaaaaattagccggatgtggtggcgggcgccgatagtccccgctactggggaggctgaggcaggagaatcatttgaacctaggaggcagagctcgcaataagccaagatcatgccattgcactccagcctgggcgacagagcgagactccgtccaaataaataaataaataaataaatatttaaaaaaataaaacaggtgagagacctccatgtagggcaatgccctccctacatgggtgtaacagtcgtagggctgggacagaattcagctgtcctgatccccccgctgtcccaccctgcaggtatctttttgagcaccttctacaaggaccatccagcacatccataggaatgttccagaaatccacggccgtgctcagccctgattcctcactccacctcatcctcagtcaggctctggggccctctgagtggtgccactccaagagtgaaaccagataggcagtccatgctttggatggcagtgagacccagacgcagttccagcgctggcctctgagcggcagtacagccccatggaccaccagagcccctgaagcccagctctggttggaggtgatgccactctgcacctccctggctgctgtttgtattagtcatctatgctgcataacaaataccccacaacttcatgatgtaagcagcacacgttcattatcttccagattctgtggacaggaggctgggtggggcttagcagggagcctctgagtcagaggctctcacaggctgtggtcaaggtgtcagccacgctgaggttaccccaaggcttgactaaggggggatgtacttgtttttttttccagaccgggtctcgccctgttgcccagcctggagtgcagttgaacagtctcagctcactgttccctctgcttcccaagttcaagcgattctagtgcctcagcctcccgagtagctgggactacaggcgtgtcacatcccaccaggctaatttttgtatttttggtagagacggggtttcatcatgttggctgggctggtctcaaactcctgacctcaagtgatctgcccaccttggcctagctaggtgctgggattacaggtgtgagccactgcaccacgcccactttttttttttttttttaagagatgggatctcgctctgttgtccagcctggagtgcagtggcacaatcactgctcactgcagcatcaacctcctgggctccagcaatcctcctgcctcagcctcctgcagattcacttctaagcccacctatgttgcttttggccagaaacatcagttccttgtcatgggggcctccgcacagggctgctcacaacaggggagctgcttctcccaggaggtggcggagcagcagcagctgcagtctttggtgaccagattgtgaaagtgacactccgtctcttttgctgtgtcagaagtcagtcaccaggcatggtccacactcaaggggtaggcattacacaaggaaatgaactgggttttgcttttcttgttgagttacgagagttcttttttgttttgttttgagacagggtctcattctgttgcccaggctgagtgcagtggtgcgatcacagctcaatccagcctggacctcttgggctcaagcaatcttcccacctcagccttcccggtagctggaaatacaggcgcacaccaacacgccccgctaattttttatttttttgtagagacaggtttcactatgtttcccaggctggtctcaaactcctggcctcaagtgatcctccaacctctgcctcccacagtgctaagagtacaggtgtgaaccatcccatcacgcctggccaagagagttatttatttatttatttattgagacagagtcttgctctgtctaccagcctgcagtgccataacacaatctcagctcacagcaacctccgcctcccagggtcaagcaattctcctgcctcagcctcccaagtagctcggattacaggcacctgccaccaggcccggctaattttatatttttagtagagacagggtttctccatgttggtcaggctggtctcaaactcccaacctcaggtgatccacccgcctcagcctcccaaagtgctgcgatgacaggcatgagccacctcgtccggcccagcataattttttttttctttttttaagatggagtcttgttctgtcacccaggctggagtgcaagggcacgatctcagctcactgcaacctctgcctcccgggttcaagggattctcctgcctcagcctcccgagtagctgggattacaggtgcatgccaccacacccagctaattttttgtatttttagtatagacagggtttcgccatgtcggccagtctggtctcgaactcctgacctcaggcgatacacccaccgcagcttcctaaagtgctgggatgacaggcgcgagccactgcgcccagtctcagcatgtttttaatgtgcaaaataaaatacaaggaaataaaaatataaaaaactatactgaaataaattatcaaaatattgtaggccaggccgggcgcagtggctcacacctgtaatcccagcactttaggaagctgcggtgggtgtatcgcctgaggtcaggagttcgagaccagactggccaacatggcgaaaccctgtctatactaagaatacaaaaaattagctgggtgtggtggcgagcacctgtaatcccagctactcgggaggctgaggcaggagaattgcttgaacccaggaggtgggggttgcagtgagctgagatcatgcccttgcactccagcctgggcaacagagtaagacgatgtctcaccaacaaacaaacaaaatattttaggcagcggggcgtggtggctcacacccgtaatcccatcactttgggaggccaaggcgggttgatcacaaggtcaagagatcgagaccatcctggccaacatggtgaaaccccatctctactaaaaaacaaaaattagccgggtgtggtggcgcgtgcctgtaatctcagctactcaggaggctgaggcaggagaatcgcttgaattgggaggcggaggttgcagtgagccaggattacaccactgcactccagcctggcaacagagtgagactccatctcaaaaacaaaaacaaaaacaaaaacaaaatattttaggccaagtgcggtggctcaggcctgttttcctagttactggggaggctgaggcaggaggatcgcttgaggctgggaggtgaaggctgcagttgagctatgactgcaccactgcactccagcccaggtgacagaacgagaccctgttgctaaaaaaacaaaaataaaacattaaaaaatgtacgatatagtggccgggcgcggtggctcatgcctgtaatcccagcactttgggaggctgaggcgggcagatcacaaggtcaggagatcgagaccatcctggctaacatggtgaaaccccgtctctactaaaaatacaaaaaaaaaaaaaaattagccaggcgtggtggcaggcgcctatagtcccagctggaggctgaggcaggaggatggcgtgaacccgggaggcggagcttgcagtgagccgagatcgcgccactgcactccaacctgggtgacagagtgagacttcgtctcaaaaaaaaaacagagtacgctatagtaatatctgctttttcctttttgcaatagctttattgggatacaattgacatactatacacttcactcatatattttttgtttatttactattttttttcaagagacagggtcttgctatattgccctggctagtctcaaactcctgggcttatgtgatcctcctgcctcagcttcccaaattgttgggataataggcctgagcaagagtccagcctctaaaaagaaagaaagtcacttctttataccatagtactgcaaattctagtcagagcaactagacaagaaaataaaataaaaggcattcagattggaaagaaagaactgaaaccgtctctattcccatatgacatgatgttttttcttttctttttttttttttttttgagacagagtcttgctctgttgcccaggctggagtgcagtggcatgctctcggctcattgtgagctccacctcctgggttcaagccattctcctgcctcagcctcctgagtagctgggattacaggcatgcaccaccatgtccagctaatttttgtatttttagtagagacggggtttcaccacgttgaccaggctggtcttgaactcctgacctcgtgatccgctcgcctcgggctcccaaagtgctgggattacagacatgagccagtgtgccccgctccatatgacacaatcttatacaaagaaattcccaaggaattaattaaaaactattagaactaataaatgcatttggaaggcttgcaggatacaagatcaatacacaaagctcaattgttggccaggcgtggtggctcacgcctgtaatcccagccctttgggaggccaaggcgggtggatcacctgaggccacgagtttgagaccagcctggccaacatggcgaaaccccgtctctactaaaaataaaaaaaaacaccagccaggtgtggtggcaagctcctgtaattccatctactcgggagcctgaggcaggataactgcttgaacctgggaggcggaggctgcagtgagcagagatatgccattattgcactccagcctgggcaacaagagcgacactctgtctgaaaacaaacaaacctcaattgtctgttatacacttgcaatggacaattcaaataagaaaacaattccattcacaatagcagcaaaaagaacaggctttttcaagactcattaagtaagttctagcagtgggagacctaaccatttcaaatagtagcatgctgtgctatctacccaaatattaccgtacctgtgaattctgttggtgacaaagtcacaggccctgcaactatgaatgtggcttcttccttatatccgcaattgaatgaattagaggaatgcagtcacatcagaggccatttgagaataaaggtcggatttttccccattcaaattcacagaccaggctcacatctgtaatcccagcaccttgggaagccaaggcaggaggatttcttgatcccaggagtttgagaccagcatgggcaacatagggaggccccatctctacaaaaaattaaaatattagctggttgtggtggcgcgggtctgtagtcccgcctactcgtcctggccgcagagtcagcgtctccggagcgcctccttctcccgccctggggctcacgtgggaatttcaccctccattggagggggctcagaccagggcttctagacctccttttggtccgtgaatttatttttgagacagagtcttgctctattgctcaggctggagtgcagcggtgcagtcacagctcactgcagcctcaatctcctgggctcacgcgatcctcctgcctcagcctcccgagtgggccttcctccgtgggaaagcgttaaaacgatagttaacggttgcgtcggtgtaaagacgaatgcaattcgagaaggattcattattattttgttttttcttctgatttttaacagaaattggcgttgaacatttcccccgtgagcgccgggccacgggggtccggggcggcggggggctccggggcggcggggggctcccgggcgggcgggggcgggtctcgggctggcaccgccctccgcgcccgctcctcgcgctcacagcggcccgcgggccgggcgtcatgggcggcctcttctggcgctccgcgctgcgggggctgcgctgcggcccgcgggccccgggcccgagcctgctagtgcgccacggctcgggtgagtggggccgcgcgccccggcggggacgcggaggggaggaaggggcgcgcgccgctcggcctttgtgcgcgcacgtgcgggctggggtccgactcccccagaggcctcggggcgcgggctgcggggtccgtccgagttggggaaggcgccggctcgcacccgcacgcccctccagtgcccgtccggctctgcggctccttctcgcctccccaggccccaggctgcaggcgcccggcgagttggcagcctgggcgggtccggggcgaccgagggcccgggagcgcaaggaaggcagaggccggctgcagcactgggcggggagggggtctcccggccggggtgggggtgggggtgtgggggggtgagggagtcggggggtgggggtgggggtgtgggggggtgagggagtcggggggtgggggtggggggagccgctccgctggggcgttcgctgaaggccaagttaggccagaatctgactgggacgtcaggccccaagtccccggccccgccgctgcccggcccccccagctgccacctcacaggacgatccatgtcccagggctccctccatcggctctgaaaagtgagccgccgcctgcaatgcccgcaccagccgcagcagagccccaggctacacaaggcgccctgcaaactgggttttgggggaacaaaccaaccagggggtcttcctcccgtgggcttcagccgcctgctggggttaacttttcctcctggcctggcggagcccctttggctctgtccagattctgtgggacatacagggtctgggctcctctggaaaccagggacccgatgccggagggtagcttggctctggagcagcctgggactataggaaggtgaggacgtcttctgtttccctggcagcgtcccctccagaggaggacggctggggcggagctcagcgctgaccctgggtctggaagcgacaggccttgaaactccacagcagcacaggccccgtctcctggctcggacagaaccctgctaccttccctcttcaatcttcaggcccctttttgtccgtgtttccagggctcacctggtggggaaagtgtgtttctccctggttccctgccactcattcacctcagacacagggtgggctctgggttcttcctcatgtggaaagtcggggcttcagaccatgtctgtcgtcatccagaagggatggagtcaaaagtgaggctggagttttgcaggatctccagacttccctgaggccactgagctgggctgtgcctctgtggacctcagggtggtcgctgagctgggctgtccctccctggaccttgaggtggtccctgagctggctctgcctctatggaccttgcggtggtggtccctgagctgggcagtgcctccctgaacctcggggcgatctcaggcagcctctgcctctgctgggaggagccatggcccctgggagaggctagaagccctggggacacattgccttgggtgtccctgacagggactatcatgggggtgtttgtggctgtgggcaccatccctgtcccttccagagtgccctgcatagaggcagacaccctgaagcctggtgacccctgggctctggctgggaaacccgggtcgtggggacgtgaaagggtgaggtggcagtgcctctgacctcttgccttttgaaggagggccctcctggacccgggagcggaccctggtggcggtgaagcccgatggcgtgcaacggcggctcgttggggacgtgatccagcgctttgagaggcggggcttcacgctggtggggatgaagatgctgcaggtagtgggactctgggcttgtgggtgtccctgtggggatggggttgggggatccttctcggcctttcacatcccagccagcgccggggcagggcctggctttggcagttgaaggggcaggagggatctattctgcggtgggggtgctgcccatgctggtgttatctgcaaggtgcctgaggtcagggcatcacagctgctgtgctagtgcccacgtttactgtctgcggctcctccttacctcaatgccacccaggcaccagagagcgtccttgccgagcactaccaggacctgcggaggaagcccttctaccctgccctcatccgctacatgagctctgggcctgtggtggccatggtacggcagggcaggggtggtggaagggcctgtgggtaaagggcgtgtgggtgtgtctttccccccagcaaagggaggggccctggattgagcccaggggcccttggtgttccccacttctccccaaccattatctctcgctgcaggtctgggaagggtacaatgtcgtccgcgcctcgagggccatgattggacacaccgactcggctgaggctgccccaggaaccataaggggtgacttcagcgtccacatcagcaggtacgggggtcctgatacaccaggctgctgctgggggcaaggagggccatcacttggggtggtggcagatccacgagacctggctgtcttgctgtgctaggatgaagccaggtcggacatgacagctcacactggtgagagccgtgttctcccagggcacacagggcaatgaggtgttccctttgtgttgtgtgtaccgtgccatcgttgcctgttacctgacaccccaaggggttggcacggggcaacttggggggaaatgaggctcccaaaagctggggcctgggcgggtccacgaggctgtaagaggccgaggccaggctggaacccggtttcccagctccactgttactccttccctgtctgcagtcacaggcttgctcccctagacagagggcaacgggagcagcagatggtccctgggattcctcagggtgcacatgaagcctgagcctcacattgctcctgtcctggcacaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacacccagttccataacgttgttggatgtatgagccaggcaggggtccagagaccaccagcctgcaatccggagaacccaagctaggcgcgagccggtgctgtgatcccgccaaaggagaagctgccttcccggggaaggggcagagaggggccggcgggctgaggccaaccagcgcagaaagggcctggcagccattactgtagcgctggcggctctgtcacgcccctgaagccgctggcccgcgggtgtgttcagctcaggagcggccctgcgtgtttttcccccgtggccgtcgcggacccccgtcttccaacagtggtgcgggcggggcgccccgtcctgggttcgcggcatagccccgcccgggcccccacgcggaacagaagtaacggacccttttttttttgtttttgtttttgaaacggagtgtcgctctgtcgcccaggatagagtgcagtggcgcgatctcggctcactgcaacctccgcctcccgggttcaagcgattctcctgcctcagcctcccgagtagatggaactacaggcacccgccacaatgcccggctaatttttgtatttttagtaaagagggggtttcgccatgttgtccaggatggtctcgaactcctgacctcgtgatccgcccgcctcggcctcccaaagtgttgggattacaggcgtgagccaccgcgcccggccccggacccttctttattggcctcaaaacgggtcattttgggaagcggcgcggggctggccgcgcttccctgggccccggccctccccatggtgtttacggggaggcgaacggggagcccagaggctgcgagcctggcctggacccaggagccaggggtatcccacaagtcctggaggctctgaacgcggcgctgacgccgaatacctgtgaaaaagactcggggaggagacccgcagaccgccgagcttctgccgcgggaaccgcgcccccggccccgcaatgcgcctgcgcctcgcgcgccgacttccagtcccagcaggccgcgggcgggggcggggcctccggggagaattcgggggaggggcggggcctccgggaagcaatcagggcaggggcggggcgtccggggagtggggcggggctcccggttccaggcgagttcgcagctgcgcgccgggtcctggaggccgaggccgctcccgcccgttgtccccgcagtccccgacgggagcgccatggcccagccgccgcccgacgtggagggggacgactgtctccccgcgtaccgccacctcttctgcccggacctgctgcggtgagcggggcctgggaagcgagcgcagccttggtgcggggtccggtccgcgggcgccggcgcccccacgtggtccccgagggctcgcgtgttaggaaacctgtcttgcctggctcctttctttcttttttctttctttttttttttttgagacggaatctcgctgtgtcgcccaggctggagtgcagtggcacgatctccgctcactgcaaactctgcctcccgggttcaagcgattctcctgcctcagcccggctaatttttatttttagtagagagggggtgtcaccgtgttggtcaggctcttttcgaactcctgacctcaggtgatccacccgcctcggcttcccaaagtgctgggatttacaggcgtgagccaccgcgcccggcccaacctggcctctttcttaacagaaaattttaggttgaaatcatttttccggaagacccagaaggcccaggaatgccaggttttgcccagcagctcttcattttcctgcaaacgccttggtgttcacaagagaaggcagcccgggcaaaggtcgatcctccccggtcacctgccctcactcggctaatgggcggatccttttttttttttccttttctttttttcaattggcaacattttcaagtttctattaaaattttgatcttttgccaggagcagtggctcacgcctgtaatcccagctctttgggaggccgaagcgggtagatcaccagaggtcaggagttcgagaccagcctggccaacatggtgaaaccccgtctctgctaaaaatacaaaaaattagccgggtgtggtggcgcacacctgtaatcccaactacttgggaggctgaggcaggagaatcacttgaactcgggaggtggaggttgcagtgagccgagatcgcaccattgcactgggcaacaagagtgaaactccatctcaaaaaaagaaaacaagttttaaattatgttctccaaggacaggtattgacaattctctctgagtgttctgcaggaaaaaaaaaaagttttttttcgaaacggagtctcattctgggttgaagcaattctcctgcctcagcctcccaattctcctgcttcagcctcagtgcgcccaagtgggactataggcacacaataccacgctgggctaattgtatttctagtagaggtgagtgtcaccatgttggtcaggctggtctggaactcctgacctcagatgatccacctgcctcggcctcccaaagtgctgggatgacaggagtgagacgctgcacctggcccaaaattaatctttaataattaagaataggaaaggcaacttggagatcagcaaaagtttgccatccatctggtacagtttgtgccagtcataccgatcagtacacatttaatgcgtacaagaaaatctctaataaataaaaaagccatattatcccgacgtagcttgctgaatctcaggtatcatatttgatattagtgccatgcagggcttaggagagaggaaattataacctctatcttgtttaagccagggtatttttctctcttgtatctacttctgtccatttctgtcaaaagacacagaaataccctttcccccactgcactttgcaagtttgtgtcagcacaagttcaggaccagcctgagcaacaaaacgatacccctctctagaaaaactagatgaaaaattagctgggcactctggcatgcacctgtagtcccagctactggggaggctgaagcaggaggatccttctagcccaagaggtcaaggcggcagtgagccgtgatggtgccactgcactccaacctggatgacgtagcaagaacctgtctcaaaataaataaataggcccggtgtggtggctcatgcctgtaatcccagcactttgggaggccgaggtgggtggatcacaaggtcaggagatcgagaccatcctggctaacacggtgaaacctcatctctactaaaaatacaaaaaattagctgggcgtggtggcaggtgcctgtagtcccagctactctggaggctgaggcaggagaatggtgtgaacctgggaggaggagtttgcagtgagcctagatcatgccactgcactccagcctgggcgacagagcgagactccatctcaaaaaaaataaaaaataaataaataaattaaataaaatactataattttatgaattttcattttatttatttatttattttttaagaccatgtttcgctcttgttgcccaggctggagtgcaatggcgcaattttggctcaccacaacctccgcctcctgggttcaagtgattctcctgcctcagcctcccaagtagctgggattacaggcatgcaccaccacacccggctaattttttatatttttagtagagacggggtttctccatgttggtcaggctggtctcgaactcccgacctcaggtgatccgcccgccttggcctcctaaagtgctgtgattagaggtgtgagccaaggcacctggccgaattttcattttaaatcattgccgtatagcaatatgggaggtgtattttaacagggctcttttattttttatttatttttattttattttatttatacatattttttgagacggagtcttgctcttttgcccaggctggagtgcagtggtgcgatctcggctcactgcaacatctgcctcccgggttcaagctattctcctgcctcagcctcccaagtagctaggactacaggcacccaccaccacgcccagctgatttttgtatttttagtagagacgaggttttaccatattgtccaagctggtctcgatctcctgaccttgtggcccacccaccttggccttccaaagtgctgggagccaccggcccggcccaatagggctcttttaaaagagcctccttttttattctcagggacaaagtggccttcatcacaggaggcggctctgggattgggttccggattgctgagattttcatgcggtgagactgctctgtgtcccttccctgctcctcgcttctccctgcccgggccctgctggatgcccgacccctggaaagatgttggtgggaggtagatgtcccctgctcacctacccgacaggatccaggtgcctgccagagggactggggagcggtcgaggattgccctggggggagtcaggacttcaaggcccctacaggtcagtggagattgtgtggctctggtctggggcctgctgggacctcgagagtcagggctgtgtcgggccccagtgctggcgccctgcagagcacattttctcctgggacacaattctgtggcttcaggccagggtcagcaacttatcccacctgacagtggctagagttaggctggggtgggggaaagggacccttcctcagttcccctgaggcccctgcttttcagaccaaaaaggtgagtcccacaggaagagatatggcctttccactggtggctttgtgctcagggcatctgaggaccagatgggacattgcagctccagtgggacctgcctagcaggggtagctacctttatggttattgtgggcaagcaacccccgaaccagaagagccgagaaaccaaagaacaaggcagacagatcccgtttgtctgtgtcaggtgattttaccagggaatttgtgggcagaagcgtagtcttgggtggctgtgagacgggcgtctccatgctgttacccccaggcccagggcttctataccacagggaaaggggtcctgcttcagagggagtgtgtaggaatttgtttaggataacatcaaggtggttttgacctaaaggcaggacttctttgtgctctttcgcaagaacagtagataagctggaaatcctagcggcattcctggaaccagggttcatagaggccaacgtggtggattcgcatccacgtggtcaggaaggggagcagggagcaccccgcttcagaacagtcctccacgccagccccacagggagaagggggtggagaatgtgggcccagcaggccccaggcagatgtgtgggctgggcgtctgtggctcacagctgtctctgtacctggtgtttggggcaggacccgcaggcctgtgcggtgggatgtcccatgccagaaaccccggggtgggcaccacctgaggtccctccagagtacctcagtcctgttcacgcccctgtgccctctgccagctgggccttcagcctggactggtacttccgcctgagagactcctgctcaggagctgggcagatgccccgggagtgcccctcgcccacactgccctcacacctgcttctggttttgcaggcacggctgccatacggtgattgccagtaggagcctgccgcgagtgctgacggtgagagggcctctcccatggtcccctgttcgggtggctgtgggggggctggggctgggcctgggccaggagagtccagaggctatggggatgttggcaccaaaactttttttttctgagacgggagtctcgctctgtcacccaggctgaagtgtggtggtgcgatctcggctcactgcagcctccacctcccaggatcaagcgattctcctgcctcagcctccggagtagctgggactacaggtgcccgccaccacgcctggctaatttttgcatttttttggtagagatgggttttcaccacgttgaccaggctggtctcgaattcctgacctcaggtgatccgcccacctcagcctcccaaagtgccaggattacaggtgtgaaccactgtgcccggccggcacctcagcctcccaaagtgccaggattacaggtgtgaatcactgtgcccggccggcacctcagcctcccaaagtgccaggattacaggtgtgaaccactgtgcccagccggcaccaaaacttgcacctatcctaaatatggagcttcagtgtaagtggcctcccagagacatctttgactttttaaaaaatctagttattgggttctgggagggaccttcctgtttgggggtaatgtggccccaagaaagacctctgggctcacctgggttatttaggtggtccgtgcgtcccacctactggagccctcgacctgggaggagagtctcacctgtgccacctctggtctgcagcaggggcaggacatgggtgacagtggcctggagggcgacgcagagggaggattctaggacaggtggcaggtggggggagagcgtggcaggttcccacaaacatccactggggtcgtgggcacttgcaggctgtgcttccccagagtggggtccagcagcaaacccagggtccccgaggaacccggaagcatcgtcctctgcagattccaaaggccttttctccaggccgaggctgcagggctgctgtctgcctctttacctggcttctaggccgccaggaagctggctggggccaccggccggcgctgcctccctctctctatggacgtccgagcgcccccagctgtcatggccgccgtggaccaggctctgaaggagtttggcagaatcgacattctcattaactgtgagtcggtgctgagtgaggttggtggcttctcacaggttggtggtaccatttggaggccctagaactctggtcatggggtggggaccatgccagggaacctagctgcctgtgctggggtgggctgcaccccatccaggtacctgaggccaagactcaggctccggccccctgtctccggccccatctccggccccctgtctccgggcccctgtctccgggcctctgtctccgggctctgtctccgggcctctgtcttcggccgcatctccggccccctgtctctgggcctctgtctccgggcgtctctctccggccccatctccggccccctgtctccgggcctctgtctccggccccatctccggccccctgtctccgggcccctgtctccaggcctctgtctccggccccctgtctccgggcccctgtctccgggcctctgtctccggccccctgtctccgggcccctgtctccgggcctctgtctccggccctctgtctccgggcccctgtctccgggcccctgtctccagccccctgtctccggacctctgtctccgggcccctgtctccgggcctctgtctccggccccctgtctccgggcctctgtctccgggcctctgtctccggccccctgtctccggccccctgtctccgggcctctgtctccgggcctctgtctccggccccctgtctctgggcctctgtctccggccccatctccggccccctgtctccgggcttctgtctctggccctctgtctctggccctctgtctccaggcctttgtgtcccgccttctgtctctggccctctgtctccggcctgactccgcttctctgggtggcagcaggtcagcacagctgcagcccaagtggacgccatgaacacagctcaatggtagagtcgggtgcccttgtgtcctgaaattccgtctttaaaaaaaaaagtaatagccttttttttttttttagacagcatctcactctgtcacccaggctggtgtgatcatggcttactgcagcctccaccttctgggctcaagccatcctcctgccccagcctcctgaggagctgggactacagacgtgtgccatcacgcctggctaatttttatattttttattttttgtagagacagggtcttagtgtgtgttgctcaggccagtctcaaactcctaggctcaagcaatcttcctgccttggcctcccaaaatgctgggattacaagcaagagtcatcaataaaatagaagctagcctggcctagctttttttttttttttagagggagtttcgctcttgttgcccaggctggagtaccatggtacaatctcagcttacagcaccctccgcctcccgggttcaagcaattctcccgtctcagcctcccaagtagctgggattacaggcgcccgctaccacacctggctaatttttgtatttttaatagagatggggtttcatcatattgtttagactggtctcgaactcttgatctcaggtgatccgcccgccttggcttccgaaagtgctgggattacaggcgtgagccgccgcgcctggcccccagcttttatttttatttctttattttttatttttattgatttttatttttattttttgagagagtcttgctgtgtcgcccaggctggagtgcagtggcgcaatcttggctcactgcaagctccgcctcccgggttcatgccattctcctgcctcagtcccccagtagctgggactacaggtgcctgccaccacgcctggctaactttttgtatttttactagagatggggtttcaccatgttagccaggatggtctcgatctcctgacctcgtgatccgcccgcctcagcctcccaaagtgctgggattacaggcgtgagccaccacgcctggccgatttttttttttaaatcacagttttaggtttatagaataattaatagtatatggaattccatactcccacctacagttttccctgttaacatcttgcgtttgttacaattgatgaaccaacactggtttcactctgcagaaattcccttttaaaaacatcctgtgtattagtttcctgggctaacagagtactacgacctgtgtgggtaaaacaaccgaaatataatctcccagttctggaggccagaacgtccaaggggaaggcgtcggcagagctatgctctctgaaggccccaggggagagcctcttcctgccttctgcgtggcttcgggtactgccatagcccttggccctcccgggctcggagaccgtcgctgcactgtctgccactgtcttcccgtggcgtgtgtctgtgtgtcctcttcccttgttataaggatgctggtcattggatttagggctcaccctaattcgttgtgacttcagtgtaattcgattatctctgcaacccaccccatttccaaacaaggccacagtcgcaggtacggagccagggcttcagcatgtcttctcttctcggggacacagtgcagccaggacgcccgtcttgctctggtcattttggaatttatcctagggcatgggtctcctccctgtgccacagggcacctgggctccctcctgcaccctccgctctgcccacctggccaccacccacttggcatccctctccccaggctccagcagctcctgcggtctcccattctgcaggtgcggccgggaacttcctgtgccccgctggcgccttgtccttcaacgccttcaagaccgtgatggacatcgataccagcggcaccttcaatgtgtctcgtgtgctctatgagaagttcttccgggtgggtgcctcgtgcgctctgtgagaagttcttccgggtgggtgcctcgtgcgctctgtgagaagttcttccgggtgggtgccttgtgcgctctgtgagaagttcttccgggtgggtgtactcccagcgggggcctccccctgacggccgcccgctccctgccctgggcctccccatgacggccgcccgctccctgccctgggcctccccctgacggccgcccgctccctgccccgggcctccccctgacagccacccgctcactgtcctgtgacctcccccgacacccgcccgctcactgccccgggccttgtgtgttgcaggaccacggaggggtgatcgtgaacatcactgccaccctggggaaccgggggcaggcgctccaggtgcatgcaggctccgccaaggccgctgtgggtatgaccacccccccccgcccaggtttgcccacgtgggtccccaatgggccgtctgcttccatcccaggaggccagcagtctccacttgaagctgagcccagctgcaggcagcgagacctggccttggccctgcgccctcgcagagggcagagcggccctttcatatccaactttcttctgtgcagacgcgatgacgcggcacttggctgtggagtggggtccccaaaacatccgcgtcaacagcctcgcccctggccccatcagtggcacagaggggctccggcgactgggtaaggctctcagggagcccaggcctcccacagatcctctcctggggcacagggtgcccatgaagcttccagaaccttggcagggtgtatgttgaaaagccctgtgctggttccatggtggcaactatgttctgtgcctggcctgatcctgctccatgctaggccttggtgacactgactgtgtccttgctgttcccagatgcctctcagggaatgagctgggggagaggggagggtgctgggtcttggggctcacggggcctgagccttctgctgccctccaggtggccctcaggccagcctgagcaccaaggtcactgccagcccgctgcagaggctggggaacaagaccgagatcgcccacagcgtgctctacctggccagccctctggcttcctacgtgacgggggccgtgctggtggccgatggcggggcatggttgacgttcccaaacggtgtcaaagggctgccggatttcgcatccttctctgctaagctctaggtgaggtactgctcccgcttcttggggtcatctgtgtccttggacgctggtcactgcatgggcaggtctctgcgggacccacggggctggcgtctcctttgtccccatcctcccggcccctgcgccagcctgcccacacatgggtgctgcccagtggggctgagcaggaggcgggcgctggtgtacttgctcttctgtagcggcctcggcctctgccggcatttctggcaggtgctgggtggccgaggcagccgaggtgttttagggggaagccgtcctcagccggctactaagttctgaaactcctgcaggaatcttccggccgctgcttcctgccgcctcactcagccaggtggagagcaccaatctgaaccagcaatgcctgcagcccagcccctcctctgaacactcagctattactgcgctttccctccccacggccccaactccagggcaggagcaactggacagtgggcctggcccgtggagctgccacgcaggtgcctgagggccaggtgccacgcaggtgtctgaggaccaggtgccacgcaggtggtgggggtacagacaagatgctgggatgtcccctgccccatggtcaagggtgtcctgcctgcctgggtccagggcctgagggagccacatggatcccgagacttgtgttctcttggctgaaaacactgaggtgctcccatctgtgcgtggcccatgagctgggatggtcctccagctgcccacaaggtccgcccctctgtctctgcaccacctgtttgcataaacacactttgctacaatcttgctagtgcgttttcttaaaagataatctatttactgtaaaaataaattggactttgcaaaagcttttagaaggaaaagaaagaggattaaagagaattgctggtgatcctatcgtttaggggttgtgtttcctttctgtcttttctgtgatgtttacttattattagtagtagttttgttttctttcttttttttttttttttgagacggcgtctcgctctgtcgcccaggctggagagcagtggcgcagtctcggctcactgcaagctccgcctcccgggttcacgccgttctcctgccgcagcctccggagtagctgggactacaggtgcccaccaccacgcctggctaatttttgtatttttagtagagatgggttttcaccttgttagccaggatggtctcgatctcctgacctcatgatctgcccgctttggcctcccaaagtgctgggattacaggcgtgagccactgcacctggctttattttttatttttaattttaatttttatttttttattttttgagatggagtctcgctctgttgcccaggctggagtgcagtggtgcgatcttggctcactgcaagctccacctcccgggttcacgctattctcctgcctcagcctccctagtagctgggactacaggcgcccgcccccacgcccggctaattttttgtatttttagtagagacggggtttcaccataatagccaggatggtctcaatctcctgaccttgtgatccgcctgcctcggcctcccaaagtgctgggattacaggcgtgagccaccgcatctggcctattattttttttgagagtgtttcgctcttgttgcccaggcgggagtgcagtggtgcgatctcagctcactgcaacctccgcctcccaggttcaagcgattctcctgcctcagcttctcgagtagctgggattacaggcgcccgccaccatgaccggctaattttgtatttttagtagagacggggtttcaccatgttagcccaggctggtcttgaactcccaacctcaggtgatccgcccgcctcagcctcccaaagtgctgggatcacaggcgtgagccaccacgccaggccttctgtgacgtttagaacactcttcctgcctcatgctggaagccccagtctacaggcagggtgctgctctcttggcagaggccgcgtgctcagatgcagccgacactgaatgttgggcccaggaccagccaggccactggttgcctctctcctgggtttggtcactgccacagctttcctcctctgtcgacatggcccccagccctgctgcacgtgggaggtgctgagcagcaggaggctggagggaggtgtgtggctgtgcccaccagggcccccatggctgccctcacaggaggggagcagctcccatcaggtatgcccctcagccctgcggtccccactctgttcctccgagctcccagctcactgtcacaccagaccctgaatgtattcaggcttttacttcctgacaaggaggaaaaaagatttgttttttgttttgttttgtttttgtcagagacagggtctggctctgtcagccaggctggagtgcagtggcacaaacataactcactgcaccctccaaactcctgggctaaagcgatcctcccacctcagcctcctgggtacctgggaccacaggcacacaccgccatgcctggatgttttttgtattttttgtagagacaaggtcttgccatgttgcccaggctggtcttgttttttttttttttttttgagatggagtctcgctctgtcacccaggctggagtgcagtggcgccatctcagctcactgcaccctctgcctcctgggttcaagtgattctcctgcctcagcctcccaagtagctgggcctacaggtgcatgccaccacacccagctaattttttgtattttactagagacgaggtttcacagtgttgcccaggctggtctcaaactcctgagctcaggcaatccacctacctcgtcctcctaaagtgctggaattacaggcgtaagccaccacgcccggctgcccaggctggtcttgaactcctggcctcgtgtgatctgcccgcctcaggactgcaggcgtgagccacggcgcctggccgaggtggagagaagatctgtatattgtagttgactcctgccccgtttggaaaatacagtgtggagcttataactgctgagttggctttttaggtggctgagggttggcctcaccttatgaatgtggccactcccacagctgccgtggcctgggagaggggctgcttccagaaaatgtgtcagcagaccatccattgtgggttcctgactggcaccgaccagcatggccacgacccacacacaccctgtgtgctaagtgctcagcgaattccttccagtgactgcatgggcttcgggaccccctctggtgccagggaacctggggaacctcaaaggcagatcctgggtccctccacaggctctgagggagggatgtggtggagctcagcgaggaagctgggatgcggggccctgggccgggagtatcttccctccttcccttccctccaccagcctctgtgagcctgggcctgccctgctgcctccagatcccagccccagcagccgcctccacaagtcgtggcccagccactgaagagagggacagcattccttctgctggcctcacatccacattcctgaggaaagatgcaagttcacctttggggctagaaatctggctcttgtgcaatgaactgtggtagggccgggcatggtggctcacgcctgtaatcccagcaatttgggaggctgaggctggcaaaacacttgagcccaggagttcaagaccagcctgggcaacaaaatgagactccatcttaatgaataaataaataaataaataaataaataaataaataatgccaggcatggtggctcacacctgtaatcccagcattttgggaggccaagacgggtggatcaggagtttgagagcagcctggccaatacagtgaaacaatatagtgaaaccctctctctactaaaaatacaaaaattagctgggtgtggtggcactcgcctgtaatcccagctacttgggaggctgaggcgggagaattgcttgaacctgggaggcggagcttgcagtgagctgagatggcaggactgcactccaccctgggtgacagagcaagactccatctcaaaaaaaaaaattaaaaaaagccaggcatggtggttcaggcctgtaatcctagcactttggaaggtcaaggtcagtggatcacttgagcctagaattcaagagcagcctgggcaacatagcaagaccttgtctctataaaaataaataaataaaaacaaaaaccaggctgggcatggtggctcacgcctgtaatcccaatgctttgggaggccaaggcgggcagatcacctgaggtcaggaatttgagaccagcctggccaacatggcgaaaaccccatctctactaaaaaaatataaaaattagctgggcatggtggcacgtgcctgtagtcccagctactcacgagaattgtttgaacccgggaggcagaggttgtggtgaacggagattgcaccactgcactccagcctgggtgacagagcgagactgtgtctcaaaataaataaatacaaaatagtgcgtcggccaggtgcggtggctcatgcctgtaatccaagcactttggaaggccgaggcgggcagatcacccgaggtcaggagttcgagaccagcctgacggaggcagaggttgcggtgagccaagatcacgccattgtactctagcctgggtgacaagagtgaaactccgtctcaaaaaataataataattaaataattaaaaaataaagaataaacagtggctgaaggttggcctcaccttatgaatgtggccactccaacagacgctgtgggctgggagagaggcttcttctagaaaatgtgtcagcagaccatccatcacgggtttctggctggcactgaccagtgttgccatgacccacacacacaccctgctactaagttctcagtgagttcccgagttccttccagtgaccgcatgggtctcagggccgctctctggtgccagggaacctgggaaacctcaaaggcagctgggaggtgccagactgcacctgacaggtgtttgtccaagcaagaatgagaaatattcgccagaaataagaagaattacctttcagctcttcgaccatcacgtgtaacttggaaaactgttacacagggaagaggagagtgatgagaactagcccttcgctgctgctttggaaaatgtagaggggctgagaaacgaagctctgcatagcctctcctgctggctcctcagggcccctctgcaggctgcggtttggcctcagggagcactgagggtgcagaacgggggctctggagggctccaggcctggtgggagccagggcagccaggccatcccaggaagacagagcaggcaccgtagcctcatagtgaggtgttaaaataagaaaaccatcaaaacttgggctgagtcaggaggaattcagttgtgccttatacactcatgttccatttttactctaagacatgtactttaccaaatttgaaggtgagaatacaaattctcccccactgaataaaatatcagtaaacacaagtgaggctctgtgctctcaactgctggaggccacaagggagagtgagacctggtcctaaaggtgacttcgctctaagtttatttactgaatataaaatgttaatgtagttttcacagttgtctggccaggtgcagtggctcatacctataattccagcacttttggaggccaaggcggtggatcacttgaggtcaggagttcgcgaccagcctgaccaacatggtgaaactccatctctactaacaatacaaaaattagtcgggcgtggtggtggacacctgtagtcccagctactcaggaggctgaggcaggaggatcgcttgaacccaggaggcgtaggttgcagtgagccaagatcgcgccagtgcactccagcctgggcaacagagcgagactccatcccaaaaaaaaaaaaaagttgtcagttaaaaatagtttgcaggcagtttttgttgatagctttatggatacacagttgacacaaggcaaaccgcacataggtagagtgtgtaatttgatgaggctgatgcgtctacgtcgtgaagccctcagcactatccaggctgcacgtgtacctggtaatccctccctctcacccatccctaccccttatttcccaagcgactgctgatttgctctctgttgctatttatgttttttatttttattttttgagatggagtctctgtcacccaggctggagtgccgtggtgtgatctcagctcactgaaatctctgcctcccaggttgcctcagcctcccgagtagctgggactacaggcgtgtgccaccacgccagggtaatttttgtatttttagtagagatggggttttgccatgttggccaggcgggtctcatattcctgacttcaagtgatgtgcctgcctcggcctcccgaagtgcggggattacagcggtgagccaccgcgcctgcctggtgtttgtattttctaggattttatgtaagtggagtcataaggtacgcactcttttttgtccggcttctctcactgaacctgattgctcccagagtcacctgtgatgtcgtgtgtgtcagtagtgaaatcctcttcagggttgagccgggctccgcgccgggtcctcctgggggttgagccgtgttccgcagtgtggatgtgccagtttgtttattcacctgctgatgagtacttgggttgcttgcaggtttgggctataacaagtaaagctgctatgaacatttgtacagaagtgggtgcatggacacgtactttcatttctcctaggtactaggagtggaatggctgggtcatataaacaatgtatatttagttttatttttttaatttttttttttgagatggagtctcgctctgtcacccaggctagagtgcagtggcgcgatcttggctcactgcaacctccgcctcctgggttccagtgattctcctgccttagcctcctgagtagctgggattacaggcgtgcaccaccacgccccgctaagttttgtatttttagtagagacggggtttcaccactttggtcaggccggtctcaaactcctgacctcgtgatccacctgcctcagcctcccaaggtgctgggattacaggcgtgagccaccgcgcccggcctgtatatttagttatgtaaggtatttgccttattattcagccttaaaaaaaaggagacattgaggctaggcacggtggctcacacctgtaatcccagctgtttgagaggccaagacggggcggatcacctgaggtcaggagttcgagaccagcctgaccaatatgatgaaaccctgtctctactaaaaatacaaaaattagctgggcgtggtagcaggtgcctgtaatcccagctactcgggaggctgagacaggagaatctcttgaacccaggaggcggaggtttcggtgagccgggatcacaccattgcattccagcccgggaaacgagcgaaactgccatttgtgacaacgtggatgaacctggaggacattatactaagtttttttttgagacagagtcttgctctgttgcccaggctggagtgcagtagcgccaccttggctcactgcaacctctgccttccaggttcaagtgattctcctgcctcagcctcccaagtagctgggactacaggcacccaccaccacacctggctaattttttctatttttagtagagacagggtttcgctgtgttagccaggatggtcttgatctcctgacctcatgatccacccgcctcggcctcccaaagtgctaggattacaggtgtgagccacagcgcccagctgcacccagctaatttttgtagttttagtagagatggggtttcaccatattggccaggctggtcttgatctcctgacctcgtgatccacccaccttggcctcccaaagtgctgggattacaggcgtgagccaccgcacccggcctatgctaagtttttaaacgttttcttactttagagagggagttttgccccgttgcccaggctggagtgcagggctattcacaggcacaatcacagctcactacagcttcaaattactggactccagcattatgctaagtgaaataagccagtcagagaaagaagacttcatggtctcatttatatgtggaatccagaaaaacctctgggtcttaagagctcctcccacctcagtctcttgagtagccgggactacaggtgtgcaccaccacacctggctaatgtttttttgtttgttttttgaactcctgggcttaagtgatcctcctgcctcagcctcccaaagtgctgggattacaggcatgacccactgtgcccagtggaaatgaatgttatagatatagtcaaagttgtacttcaccctttctcttctgtctgtcctcttgaatataattcttttttctttctttctttttttttttttttttgagacagagtctcgctctgttacccaggctggagtgcaatggtgtgatctcagctcactgcaacctccgtctccggggttctagcaattctcctgcctcagcctccccagtagctgggattacaggcatgcgccaccatgcctggctaattttttgtatttttgtagagacaggtttcagtattttggccaggctggtcttgaactcctgacctcaagtgatccaccccattggcctcccaaagttgggattacaggtgtgagccaccgcacacggcctcaatgtaattctcaagtatgtttaggtattttttactacaaacgaaagcatttgaaaacaagataggtcattgatcatgtgtttttaaacttaacaaaaattggctaggcacgttggctcacgcctgtaatcctagcactttgggaagccaaggcgggcagatcacctgaggtcaggagttccagatcagcctggccgagatggtgcaaccccgtctctacgaaaaatacaaaaattagctgggtgtggtggcgggcacctgtaatcccagctactcgggaggctgaggcaggagaatcgcttgaacccaggagatggaggctgccgtgagctgagaccgtgccactgcactccggcctgggcaacaagaacagaattctgtctaaaaaaataaatgaaaaatggtattacatagcatgtactatcaattgtgcagatgtggtgcactcacttaaactgctacacttcacaacagacaacaggctccactgaagccgttcggctcttcttccagagaagtacaaatccccgaaggaaacaaggtctttccatctccctgcggacatgtgcagtttctccggcaggtactggaaggcggatcccacactggagtattccgaccttcagctgcacgactggtgccaaatccccactccctggtgtccccagacttactctgattggtgtcaagggctacactcacacattttcctggtgaccagtgaagatgagcatctttttcatgtgtttaccggccacctgaatttcctcttctggagctgcttattcatattctttcctcgtttttctatcgggttgctgttcgtttactgttttttgagaaattcttttgtgtattctagaaatgaatattttgtccattaaatccattctaactctctcttcccagttgctaccccaaaatttatatattggagtcctaacgccaacgggatggtatttggagatgaggtctttgggaggtataacttagggttagggccgggcgcggtggctcacgcctgtaatcccagcactttgggatgccgaggcgggtggatcatgagctcaggagatcgagaccatcctggttaacacggtgaaaccccggctctagtaaaaatacaaaacaattagccaggcatggtggcgggtgcctgtggtcccagctactggggaggctgaggcaggagaatggcatgaatccgggaggcagagattgcagtgagctgagatggcgccattgcacttcagcctggacgacagagcaagactccgtctcaaaaaaaaataataataataataattagggttagatacggtcagcaaggtggggccctcacgatgggaacagtgcccttattagaagagacagtctttttttttcttttttctttttttgagacggagtttcactcttgctgcccaggctggagtgccatggcacaatctcgattcactgcaacctccgcctcccaggttctagtgattctcctgcctcagcctcccaagtagctgggattacaggcatgcaccaccatgcctggctaattttttgtatttttagtagagatggggtttcaccatggcaagcctggtcttgaactcctgacctcaggtaatccacccgcatcggtctcccagagtgctgggattacaggcgtgaggcaccgtgcccagccttatttttattttattgttttccttgagatggagtttccctcttgttgcccaggctggagtgcaatggtgggatcttggctcactgcaacctccacctcccgggttcaagtattctcctgcctcagcctcccaggtagctgggattacaggacacgccaccacgctcagctagtttttgtatttttagtagagacagggttttaccatgttggccaggctagtctcgaactcctgacctcaggttatccacccgccttggcctcctaaagtgttgggattacaggcgtgagccattacgcccgccttttttttttttttgagatagtctcgctctgttgcccaggctggagtgtagtggctggatctcagctcattgcaacctctgcctcccaggctcaagtgattaccctgttcagcctcctgagtagctgggattacacgcacccgccaccgcccccggataattttttttctttttttttgagacagagtctcactccatcacccaggctgcagtacagtggtgtgatcttgactcactgcaacctccacctcccgggttcaagcaattctttgcctcagcctcctgagtagctgggattacaggtgcccgccaccacggccggctaatatatacatatattttttaggtggagtctcgctctgtcgccaggctggagtgcagtggtgcgatcttcgctcactgcaacctctgcctcccaggttcaagcgattctcctccctcaggctcccgagtagctgggactacaggtgggtgccaccacacccggctaatttttgtatttttagtagagacagggtttcaccatgtttgccaggatgttttcgatctcttgaccttgtgatccgcccaccttgcctcccaaagtgctgggattataggctgagcaaccgcgcccggcctaaattttctattttttagtagatacggggtttcaccatcttggccaggctggtcttgaactcctgacctcgtgatccacccgcctcggcctcccaaagtgctggaattacaggcatgagctcccacgcccagcccaaaagagacaatctttctccaacatgtgaggacagagtgagaagatggaggctatgctttgaatgtttataccctccaaaacgcatgttgaggccaagtgtggtgactcatgccaataatcccagcactttgggaggccgaggtgggcggatcacttgaggtcaggagtttgagaccagcttgaccaacatggtgaaaccccggtctctactaaaaatacaaaaaattagccggccttggtggcatacgcctgtaatcccagctactcaggaggctgaggtaggggaatcacttgaacccgggaggcggaggttgcagtgaccagagatcgcgccattgcactccagcctgggcgacagagtgagactccatatcaaaaaaaaaaaaaagataataaggtgctgcagatctgtggtctcagctactggagaggctgaggtgggaggatctctcttctatttttattttttattttggagacggagtcttgctctatcatccaggctggagtgcaatggtgcaatcttggctcgctgcaagctctgcctcccgggttcacgcctttctcctgcctcagcctcccaaatagctgggactacaggtgcctgccaccacacctggctaatttttgtttttttgtatttttagtagagacggggtttcaccgtgttagccaggatggtctccattttctgacctcgtgatccgcccgcctcagcctcccacagtcctgggattacaggcatgagctaccacacctggcctaaggtgggaggatctcttgagcctaggaggttgaggctgccgtgagctatggtcgcaccactgcactgcagcctgggcaacagagcaaaaccctgtctcggggaaaaaaaagaaaagaaaagaaaagaaggaactgctacagcccacagcctacaaaggggacacagatagtagctctgaacagcagacggatagacgggaacttgtccctttagtctttcatgaacagcctctaactggtccaggcagggaggtgcaggcttccaggctgtggttccatggaggacaccagccgggcacgcaatggacgttttccagccctagcacagacagagcgtgcgggcccctgctctcagaaagccagccttctgcctctggcagcgccggcacataaaagcagagggagcctgctgtctctgcctcgcccacactaacacccctatttagaaaggttgacacatcactatcactgcttctgaaaattttatccggccgaaggcatcagcccaaatttgaattcttgccaaagctgctggtgatttcgttctttgaatgcagtatcttcctcatgaacacgtacagctcttacaagaaaatgagaatacggtttggggaggaggatccctcacattccttttcctaatgccagcctcgcgaagtctggtcccatgtaccctgggattctgccacggaagatgactcacttaattaacacgctgctcctgaccgtacacttggaagcagaggttccgttcctttggttcttgccaaagctgcttacgaaaccatatcttgtgttggtgcccatggtgtgtaaaaatacaagttcatcatttccctgatacaaattatgacaggctaaatttagtgcctcacctgtcctaactagctttcccaccatcatgcctgccgccgggctgtggtcctttctgaggtcccgtgtccctctgaggacagggacacccagacacagaggtcagttgtcagacgcggccacggtgctcgggaggctggctgcagacgggcgattcaccctgggtgtcttcttgagtcttattttttgtagagacgaggtctcgctttggtgctcaggctggtctcaatctcctgggcgcaagcgatcctcccgcttgggcgtgggccagcgcgcccgtcccaacgctgggagtcccggagatcttggtcacaggcttaagggaaaggcctagcgcgtggccgcgcgtgcctctggtttcaagggacatggactgcgtgtctggggcccctccgcactccgtgtcagaccctgcgtcccccgggtccgcgcgggacccgggcagggcgtcgccctctgcggcgtctgcgccccgcgaaccctggggcacctgcaacccctgggccgcggagccaggcgtgcgccgcctcctggtctcatcaacgtgagaacgctttacccccgaagagctcagctcctagggggctatgtccctttgcgtctctcgctcgccaggcggtgccgtttactcgaccgcaccatgcgtgggtagcggtcgcgcccgctggtagctgtgcggcgggaacacgttctaagtaaggcctgactccgcgcgcctcttgccagggacgtcacgtcacgcctccactcgcagcctcggagcacccccgcgtcccgcgcccgaagctcgggacccccgctctggcgaaacgaggaatatgacatacagcaaaacaccccttcgcggccgctgcactgccgcgacacacccggcgcctgcctctacagcaagccggcgaggggctgggaccccgccgggacgtgctgacgtcaggcccgacggggggcggggcctgggcggcggcggcgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgcccttccgcaccactagcctctcgggagcatggcgtcggccccgccggcctcgcccccgggctcggagccgccggggcccgacccggagccgggcgggccggacgggccgggggcggcacaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtacggagcggcccgggccggggcgtgggaactgggcaggtgcgcgctggccggcggggttgatgtgggaccggtcgacgctgcccctggagtcgggaaaggcactgtcaagacctgacggtcctgctttttctgcttattcaccacttcggccctggatttctggttgaattgcgctggagtccctcttcccttcttaaaaggaggttctattctggggagtcagtttcttcccctccccccagcgcctcgtcagctggatcttaccgaggtcagctcctcgcctggggacacccccccagggggcctgatcgccacccccccagggtgcctgatcgacgtgcccctgaatgaagaagttccccgcgattcccccacccgagggcccagatactgctcggctgaattcacccaagttctagccgcagaggccaggctgcccagacgccttgagatcctactgatagacacctattttgagtacaattactttactgtgtgtggttgacatcttttctacttagatttcatcttttatttgggagacagtcaatgcttgtagagagtcctggaattaagaatttttactttggtgcctttggggaggaaggcaatgagcctcggagcttgttggcaaatgcagaagtctagcagaactccgttagggccacgtccactctcgtaggagaggtgaaatgcgtggacaggcactacgcacagtacagtgtggaaggggtccacgcggtcctcagggcacctgctcctgggggaaaggtgggccccaagatgcagttgttcctgtctacctcagcacttaataaagtttaagtggagataacagcagggccgtgtgtgttctgccaataacccggtggacatcaaataataccagtgctcacttttaaatattttacttagcaggaaatccctaaggtgcatctgtcaattttttgtattttgacttctcacacatgcagacatctggtaagtgggtgttcaagtacatatgcatgtttaagccaagaggtctgtaagaaaagaggtaaaattggcacactgctatttagggtgtcagtcataacattaagaaccttgatggtcgggcgcggtggctcatgcctgtaatcccagcactttaggaggccgaggcgggcggatcacgaggtcaggagattgagaccatcctggctaatatggtgaaaccccgtctccactaaaaaatacaaaaaaattagtcgggcgtggtggcgggcacctgtactcctagctactcgggaggctgaggcaggagaatggcgtgaacccgggaggcggagcttgcagtgagcggagatcgcgccactgcactccagcctgggcgacagagcgagacttcgtctcaaaaaaaaaaaacagcaacaaaacaaaaaacacagggtcctgataaatcagggttccttgctgagttcacattaagaagatgtgcagacaggtgcgtgcggggcagcctgcaatgctcgcaagcttagctccggttgggatattgtcagggtagttttccacctacactaatgggcagtgaaatatgtgactgatactttcctgtatggtcagcgtggatggtggttgctggtccaggtgttttgctgcgtttccttcttgcccctgggctggagagcaccttgagctcccttggttgctgttggctactgcgctgtctcttctcccaaacatactcttgcttcagtacagcaaagaagttaggagagtaccacatttgctccttgttaccataacccaactcttgatagagaacttctgtgaggctcaggatgtttccactggatcataccacagttctctgagatagtaggtaagcaggattcatccccactttacaggtaagaaactggaaacccagaaaggtcagatagctctcccaaggtctcacaggagtagaactaggtcttttggcccttagaccttagatgcctcttcttagatgtggtggctcacaatatccctattgtgataatatcttactgactttcatacaattctttttatttgagaaacatcttttgtcataacctcccttaatgatcacaatgggaaaaactttgtgttgctatttggggctgagctttcttgtcatcacaaagtagaaatgagacaaaattcttcactctgaattccaagagctcttgatgaaattcgaaggttgggggcaagggctggatgacttgggatttggtgaggatggggaagtggaagggatctcctgtggtattactccttgtctgttcttctagacggcttaggaagaagcaatgttgggtgtgatctgagtgcctggacttgggccggcttcctgggatggaggagagctcttgatttcttaaagctaagttactgtttggcaacagataatttacagggtaaagaaaggttgattttcatgttatgtaaccctgtagccattgctcagttttagcagtcttggttcatctgtaaactcaccactcactacccccagatgatttttgaagtgggttcctgacattatatcatttcttccataaatgcttcagtatatatttccaaaagataccgattcttttaaagacattaatgatttttttaaaaacgctagggaacagttcagattaactggataacagcaataaaggtcataagtttttgtactttctaccttgagatttcaaaatattgagcacatgagagactcttagtccagtcacattactgtccttgatgataacaactagattatcttaatttttttttttttttgagatggagtctcgcctgctctgtcgcccaggctggagtgcaatggtgtgatctcggctcactgcaacctctgcctcccgggttcaagcgattctcctgcttcagcctcccgagtagctgggattaccggtgcccgtcaccacacctggctattttttgtatttttagtagagacggttttgccatgttggccaggctggtcttgaactcttgacctcaggtgatccacccgcctcggcctcccaaagtgctgggattacaggcatgagccactgtgcccggccaagtatcttaatttttatcaaattttcagaggtagcatattgagtatcttctatgtaatctgtttatgaaggtagcattttaaattatttaaatggattatctgaatttttaatagaagcagctcctgtttataatacagatggcttttgtgtccctgtttctttagcaatgtcatggtgtgtttggatctaattacgtcatctggtgatagatcaggtgtagtgtaatataacacagtgttgtgttagcagaaatcagcacatgaaaggagcaagtggagctttctggttatatttttttgaaacaggaatttatagtcagatgtgtccaggaattaggtatgaagttggaataggtgatttttaaggcttcaaccatctctggagattgacatgaccccttcatactgagaggactgatgcttttgtatttactgccacctatcatgaagcagagattgtaaaataaattctaagagtgttgtgagaaaggattactttaattttgttttgtttttaaagattataactgtaatttacatgttatttttacagtcacttaagcagttgcgttttaatagccactgattcttttcagagaatgtccttcagtaaccttggtaggcattgtctgtcttcagtacttgcagaaataggctgccgaaggaagtgtcgatgctcagatctccctacgtttttttattcctgcaccgctaatggtggcagtaggaagttcctagggacatttgactgcacctttttgttcgtttgttttgagacaggatctcactctgtcacccagtctgaagtgcagtggcaagatctcagctcactgcaacctccacctcctgggctcaagcagtcctctcatcttagcctcctgagtagctgggactataggcaggcatgaccatgctccgctaatttaaaaaaattggctgggtgcagtggctcacgcctgtaatcccagcattttgggaggctgaggcgggcagatcatgaggtcaggagacggtgaaaccccgtctctactaaaaatacaaacatttttaaaaattatttttgtagagatgaagtatagtatagtgatactgcccaggcatattattgaactcccaggctcaagcgaccgtcctcgggcctcagcctctcaaagttctgggattgcaggcatgagccgtagcgcccagcctggcatcgccttttatttgccctgtatcatttccagtctcttagccttgaatttgagtgaaagtgtgtgtgaatgagagtgagcatgtgtgtgtgtgagcagttacatatgtgagctggtgtgtgtgtgtgtaatatgtgtgtgcggtgagatgtgtgggagcatgtgtctgcaggatcagggatgtgtgtatgtgggagtgggatatttgtgtgtaagtggcatattatgtatgtgtgtgagcaggtgagtgtatgtattctgggtctacatgctgactgaattgctgaaaggcaaatgaagcttgggttgtataaaacagaaaatgaccaataatcccactatcctgagaaaaataacattcccattattttactacatttcttttcagactttttttttttttttgaaatagagtcttgctctcttgcccatgctggagtgcagtggcacaatctcagttcactgcaacctccaccacgtgggttcaagcgattgtcttgcctgagtctcctgagtagcttggactacaggcgtgcaacgcctggctaatttttatatttttagtagagacggggtttcgccgtgttgactaggctggtctcgaacaccagacctcaagtgatccacctgcctcagcctcccaaagtgttgggattacagatgtgagccaccgcacctggcccagaccttttttaacacagacatagacacacaggtgactgtctataaaagtacacaattgagatcatattggggtagaagctaaatttttttttttttttgagatggagtctcgctctgtcacccaggctggagtgcagtggcgtgatcttggctcgctgcaagctccgcctcccgggtttatgccattctcctgcctcagcctcctgagtagctgggactacaggcgcccgccacccctcccggctaatttttttgtatttttattagagatgaggtttcaccgtgttagccagtatggtcttgatctcctgaccgcatgatccgcccacctcggcctcccaaagtgctgggatgataggcatgagctatggcgcccagtgaagctaaattatttttatagatgttcattgttttaaaagaaactggcctggcgcggtaactcacacctgtcatcccaacactttgggaggccaaggcgggtggatcatctgagatcaggagaccagcctggccaacatggtgaaaccccatctctactaaaaatacaaaaattagctgggtgtggtggtaggcgcctataatcccaggtacttcagaggtcgaggcaggagaatcgcttgaacctgggaggcagaggttgcagtgagctgagatcttgccattgcactccagcctggacgacaagggtgaaactgtctcgaaaaactaaaaagaaactaaaactagtaggtaaaatactagtagataaaataagaaaaataaggagcccttgtaatccccccatccattaatatcattaagagataattaaatatttaatatgtaaattaaaatgtatgtaatacatacttgattatagataaatgttataatttgcatgcatgttgctttgaatctgctttttgacctggttttttttttttttttgtgtgtgtgtgtgtgtgacagggtctcgctctgtggcccaggctggagttcagtggtacgatctcggctcagtgcagtctctgcctcccgggttcaagcaattctcctgcctcagactccctcagccacttagctgggattacaggcgcctgccaccactccggctaaatttttgtatttttaatagagatggggttttgtcacgttggccaggctggtctcaaactcttgacctcgtgatccacccgccttggcctcccaaagtgctgggattacaggcatgagccattgcccctagcctgagctgtttctttttaattgatagaaatatttgtacatattcatgggatgggtacatgtggtattttgttacaggcatacactgtaatgatcaagttggggtgtctgtcacctccatatttatctttttttttttttttttttttttgagacatagtctctgtctcttgcccaggctggagtgcagtggcgcgatctcagctcgctgcaagctctgcctcccgggttgatgccattctcctgcctcagcctcctgatagctgggattacaggtacatgccagcatgcccagctaatttttgtatttttactagagacagggtttcaccatgttggccaggctggtctcgaactcctgacctggtgatccgcccacctgggcctcccaaagtactgggattacaggcgtgagccaccgctcattgcatatttctaaccattaaccgtgctctttaccctcctgatgcttcccagcctctgatatcaatcgctctattctctacctccattagatccacttttctagctcccacataagagtaaaaacgtgatatttgtctttctctgcctgtcttacttgacttcacataatgacctccatttccttccacgttgctgcaaatgacatgatttcatttttttacgtggccaaatagtactccaggccggatgcggtggctcacgcctgtaatctcagcactttggaaggccaaggcgggcggatcacgaggtcaggagatcgagaccatcctagctaacacggtgaaaccctgtctctactaaaaatacaaaaaaaaaaaaaattagctgggtgtggttgcgggcgcctgtagacccacctacttgggaggctgaggcaggagaatggcgtgaacctgggaggtggagcttgcagtgagccgagatcgtgccactgcactccagtctgggtgacagagcgagactctgtctcaaaaaaaaaaaaaaaaagtactccattgtgtatctatattacattttctttatccattcaactgttgatggacacttagattgattccatatctttgctattgagaacagtgctgcagtaaacatggggtgcaggcatccctgtggtatatggatttcctttcctttggataaatctcagtagtgggattgctggattgtatagtagttgacctaaattttttgaaattgaaggtctctgatatcagatgtatatttatttatttaaaaatttctttattttttgagacagagttcactattgttggctaggctggagtgcaatggcacgattttaggtcactgcaaccttcgcctcctgggttcaagcaattctcctgcctcagcctccttagtagctgggattacaagcatgtgccaccatgctcggctaattttttgtatttttagtagaggcggggtttcgccatgttagcccaggctggtctcgcgctcctgacctcaagtgatctgcgtgccgcagcctcccaaagtgctgggattacaagcgtgagccactgcaccctgccagatgtatactttatttttttgatatagagtctcactctgttgcccaggctggagtgcagtggtgcaatcactggtcactgcagccttgacctcccaggctcaggtggtcctcccatctcagcctcccaggtagctgggactacaggtacgtgttaccacacctgcctaatttttctattttttatagagacagggttttgccatgttgatctccaactcctgggctcaagtgatcttcccaccttggcctcccaaagtgctaggattacaagcatgagccactggcctggcagatgtatactttaatggaaacctaaggtttacttgtccccaggaagattcagaattgttaaggatggccggacgcagtggctcacacctgtaatcccagcactttgggaagccgaggtgggcagatcacttgatgtcaggagtttaagaccagctggccaacatggtaaaatctaaagtctactgtctactaaaaatacaagaattagaccaggcgcggtggctcacgcctgtaatcccagcactttgggaggccaaggcaggtggatcacgaggtcaagagatcgagactagcctaaccaacatggtgaaaccccgtctctacgaaaaatacaaaaaattagccgggcgtagtggcgggtgcctatagtcccagctactcgggaggctgaggcaggagaattgcttgaagctcagaggtggaggttgcagtgagtcgagatcttgccactgcactccagcctgggcgacagagcgagactccgtctcaaaaaaaaaaaaaaaaagttaaggactattctggttccagtttaggatctaacatacaggaagagtttagttctgtgtagatggtgcagacaaggttgttaagggcaccaggcttatggattgcttctcttccaagcacttattttgtttaaattctggaaacattcaatgtaaacattagttatatcagacaaaaggattaggcatccacttaagtctattatgtagctcataaaagtggtaattataaaggctccaaatttacttagattagcacttctaagttattatgatagagtgatgtactaaatatacatcacacttacaaccaggtagaattgaaagaagttttgaagaaatattaaaagtgcttttagttttgtgttgggagatatgagtgtgtaggagagggcgtatggtgggaagggttttatttgaggtattggctatatttcctgttgtgttactgattttgattattttgaaaagtagtgcctttgcacatagcatagagttcaaacagtacagaagggaatctagtaaaaaaaatcattacagttggtagaaataaaaaaatttaagtaaaccctaaagataaaatatttacatactttgacttcattaaggttcatataaaatatacaaaatacatctaaagaaacttggattttctagtaaattaaagaactagatagaacattgaatttgcatctgcagatgctttatgaagatgggctatttttactgatatttggagaaatgcatattagaaaatgcctgtaattcctgcttcttggagaaggaaaaaaagagatgggatcattggccaggcacggtgactcacacctgtaatcccagcactttgggaggccgacgccggcgactcacaaggtcaggagttcgagaccagcctggctaacatggtgaaaccctgtccctgctaaaagtacaaaaaattagccgggcgtggtggcaggcgcctgtaattccagctactcgggggttgaggcaggagaattgcttgaatccgagaggcggaggttacagtgagccaagatcgcgccaccgcactccagcccaggcgaaagtgcaagactgtgtctcaaagaagaagaaaagagatgggatctcaatttgttgtctaggctggagtgcagtggtgtgatcatggttcactgcagccttgaagtcctggggtgggttcaagggattctcccacctcagcctccaggggcatgcccccacacccagccaatgtttcatttatttatttatttatttgtttatttatttttgagacagggtttggccctgttgcccagggtggagtgcagtggcatgatctgagctcactgcaagctccacctcccaggttcaagagattctcctgcctcagcctcctgagtagctgggactataaatgcctgccagcacacccagctaacttttgtgttttttgtagaggcgaggttttgccatgttgttagcctgctaagctcaaaggatctgcccacctcggcgtccgaaagtgctgggattacagatatgagctaccgcgcccagccttatttttatttttcgtagagacgagttctcactgttacccggatgaacccctggcctcaagcagtcctcctagtgttgagattatgggcgtaaccatcttgctaggccaacaaattcttagtgacagaattatagctagataggaagaataagtcctagtgttctatatcactgtaggatgactgtagttaataatctgtttttcctaatagctagaaggaggagtcgggtgcagtggctcacacttgtaatcccagcactttgagaggctggggagggtgaatcacctgaggtcaggagttggagaccagcctggacaacatgatacaaaaccctgtccctactaaaaatacaaaaattagctgggtgtggtggcgggcacctatagtcccagctactggggaggctaaggcaggagaatcgtttgaacctgggaggcgggggttgcagtgaggcaagatcgcgccactgcactccagcctgggcgacagagggagactctgtctcagaaaaaaaggctagatgtggtggctcatgcctgtaatcctagcactttgggaggccgaggcgggcggatcacctgaggtcaggatttctagaccagtgtggccaacatggtgaaaccccatctctaataaaaatacaaaaaattagccaggtgtggtggtgcgtgcctgtagtcccagctactcaggaggctgaggcaggagaatcacttgaacctgggaggcggaggttgcagtgagctgagatagtgccattgcgctccagcctggacaacaagggtgaaactccatctcaaaaaaaaaaaaaaaaaaaaaagtcagatggatattgaatctcccaacccaaagaagtgataaatgttgaagatgagagacgtgccaagtacactgaactgataactatatgttatagacatcagaacatcactgtgcagccacgagcgcgcaagactgttatgtcatttaatcaaataaagtgaaaaattcttaatgaaaagaattgtactaattgcattgtaattattattattttttgagacagtgtctcgctctgttgcccaggctggagtgcaatggcacgatcttggctcattcttggcccatacccactgcaacctctgcctcctgggttcaagtgattctcctgccttagtctcccgagtagctgggattaaaggctcgtgccagcacacctgcttaatttttatatttttagtagagatggggtttcacatattggccaggctggccttgaactcctgaccttaagtgatccacccaccttggcctcccaaagtgctgggattacaggcatcagccactgcgcctggccttcccccacctcctcctgagatggagtcttcctctgtcacccaggctggagtgtagtggtgtgatatccacttactgcaacctccgcctctcaggttcaagcaattctcctgccttagcctcctgagtagctgggattacaggcacgtaccaccatgcccggctactttttgtattcttagtagagatggggtttcactatgttggccaggctggtcttgaactgttgacctagtgatctgcccacctcggcctcccagagggctgggattacaggcatgagccgctgcgtccggctttttttttttttttttttgagacagagtcttgttctgtcacccaggctggagtgcagtggcactatctcagctcactgcaacctccgcttccagggttcaagtaattctcctgcctcagcctcacgagtagctgggactacaggtgcacgccaccacgcctggctaatttttgtatgttcatattggccaggctggtctggaactcctgaccttgggatctgtctgccttgggctcccaaactgctgggattacaggcatgagccaatgtgtctggccttttaaatttttttttttttttcctgagatggaatttcgctctaacaccaggctggagtgcggtggcgcgatctcagctcactgcaacctccgcctcccaggttcaagtgattctcctgtcttagcctcccaagtagctgggactactggcacgcgccaccacgcccagctaatttttgtatttttagcagagacggggtttcactatattggccaggatggtctccatgtcttgaccttgtgatccgcccgccttggcacccaaagtgctgggattataggcgtgaaccgccgcgcccggctaaaacattctttaaagagatagggccttgctctgtcacccaggtaggagtgcactggtgccatcacaactcactgcagccttgaactcctgggctcaagtgatcctcccgccttagcctcctcttcgtagctggcactacaggtgtgcaccactgtacttggctttcaaaagttcttgagactaacaggctaggaaaaatggattcagtgtcatgattagggaggaaaataaattctttaagtaggtacagttctatttttgtgtccagatatttcatgcttgtatctgtccgtctgtctttctgtctgttcatggctagtcaagtgaagcagtgggaatggagaaggaccaaagcaacccgtaacgattgtgatcagttagttgtaaacaccactgcactaggaccagctcatcttgttttagcaaattggtattactctggttaccatcttgtgatattcttgtgtttatcataagtttcaaaacagggctcatgttgagccagtgtcctgtgtgtgccactaaaaccggcgtcctagctcttcagcctttaggtctcctgatggctgtggacccacaaaatctgagacagatctcagttagtttagaatgtttattttgccatggttgaggatgcacacccgtgacacagcctcaggtactcctgatgacatgtgcccaaggtgactggggcacagcttggttttatgcattttagggagacatgagacatcaatcaatatatgaaagaagtacattggttcattctggaaaggtgggacaactccaagcaaaggcaggaagacatgaagcagggaggggcttccaggtcacagataggtgagagacaaacagttgcattcttttttttttttgagacggggtctcgctctgttgcccagctggagtgtggtggtgcaatcgcggatcagtgcaccctctgcctcctggtttcaagcaattctcctgcctcagcctcctgagtagctgggactacaggtgcctgcctcgtctggctaattttttgtatttttagtagacacggggtttcactgtgttagccaggatggtctcgatctcctgacctcatgatccgccccccccatcggcctcccaaagtgctgggattacaggcgtgagccaccgcgcccggccttcttggttgattaatatttatttctttacttttattttcttttgagacagggtctcattctgtgccttatagttgcataaaatggaaatgtttctggacatttctggacaataaatttctgtgttcctttttctttttattaaagatttactaatttttgtatttttagtagagatggggtttcgccatgtttcccaggttgttctccaactcctgagctcaagtgatccgcccaccttggccttccaaagtgctgggattacaggcatgagccacctcgctcagcccctctgctgtcgtcccttccctgggatcagtggcccaaagtccaagggaggctcttgctctgcctaccttcccccttttctcctacctggtgggcattctcagctaggcctggccagctggcatcttaatttcctgaagggattttctctttgctgaaagatccccttgctttgctggccgtgtcctgcctactgtttcttaggtcagtgatgcatcttcctcacaaagatgttcaaaatacacagatgcttttatcccttatgggaaggaagacttctgaaaatgctgtgtgatgaatctgggaatgttagttctggagaccagccatgctgggggatcaggaaggcatccctgccatccctgctggttcagctgcagctgtgcctgcgggcaggaagtgaagaggtgagaacaggtgctggcacaggcccgcctggctgccctcttcccaccctcttgctccttcagccctcctccagaacacaggaaggtcagctgagtccatttttcttttttttttttttattgagacggagtctcgctttgtcgcccagggtggagtgcattggtgcaatctcggctcactgcaacctccagctcccaggttcaagcgattctcccgcgtctgcctcccgagtagctgggatgacaggtacctgccaccacgcctggctaatttttttgtatttttattagagacgggtttcaccatgttggtcaggctggtcttgaacttcttacctcaggtgatccacctgcctcagcctcgcagagtgctgggattataggccaccgtcgccatcgcgcctggccctatttttcttcaagcctgttcctgatcactcagtaacctggtattcccactcactcagtagcctgatgttcctgatccctaagtcgtgcgtatccacgattaaacaaacccatgctctaggagtacacagcaggggacatgaggtcttcccatcactgtcgacctctggcatgttctcacggggggtgagttttcccctctgtgtcaccctccagtaagtcctgccgattcattcaaagccccacctgtagaccagtgatgaaaattaattatttgaagtatcctgtaacagtcataaaataatcgctatgctgggtactctgtcgttgcctctctaaattgatctcacgcacgcggaccctaatgtgcacagggactagcctggagttggtgccagctgctcctctggctggagccctctgccccatgctgctcctttcttggtcatgcagcaaacacacatttgtgttcccacaccaggcacccttccttctgtgacataataacagcctttgagtgactgatacttttgatttgtctgcctagagaaggaattccacaactcttgaactatgaagttctctaatcatgcttttttgtttgtttgttttgagacggagtctcgctctctcgtccaggctggagtgcagtggcaccatgttggctcactgtaagcgccacctcccaggttcacgccattctcctgcctcagcctcccgagtagctgggactacaggcacccgccaccacgcctggctaattttttgtatttttagtagagacggggtttcaccgtgttagccagggtggtctcgtctcctgacctcgtgatccgcccacttcggcctcccaaagtgctgggattacaggcatgagccaccgcgcctggcctcatgctgtttttttaagaaacggggtctcactgtgttgcccaggccggagcgcagtggctgtttataggctctgtcacagtcactgcaccctccagctcctgggcagtcctcctgcctcagcttcctgcgtaggtgggactcctggcccatgccactgcacccagcttatgatgctggtttttgaaatggggttgctattcccatggtgagtgtcttgggggagtttgggcatggtagttggagttataaattcaactgaggtcttttgtttcattctggagcgttattagaaccctcgtgaagggggttgctatttcaggaggagctgcaatggccaaccaggagtgtgctggtctcctttctggtcttcctcccgctcagccgggctgccgcttctggtgtctggttgcttccatggttctctacttctgaagtggcaatccagggtggtcaggcaggggtgaattgtctttcggtgtcatgctactttttttctgacgtagtggcagtgtctgctgagtcgtcccaaagcacagagatgtgatttgcagaaggtatgttgtgtcttcgtgggcaggagctggagctccaccctgttgctttagcaggcggcctttgaccaattaagagagcaggtctttcttgttggcgtaactctcctgagggtcacaacaggctccgtgctagagcggtcatctctgcagatgtttcttcctctcttctaccactctcaccccttatttttttcccgcttgtttacaaagttttatttcattccaacatcgggtgggttggtttactttactaaaatccaagaaaaacaaggctgacgtttttgctgttggaaatgaaaagcccttttatgagaaagtccatccccgtcagcatggcttattctgtctggtgaggagagaagaagccatgaagacatttcctcttggtgatttaatttttaagaaccctcttcaggaagccagccctgtgatgcattttaagagaaataccagttagtgaggtttcatcagcactgaggaacacttggctctctcttgcagactaagaaataccaagcaggaggagtcttggcatttggaacgggtaaatcaagaacctgctcttgttggcttgcgagtgcctttaaagcgaaagcaagaagcttagaaggaaaacgtcacagatcatgcacgcttaaaataaaaacatgcaaaagaagtaaataaaaataataacttgcaaataaaggagaaaataaaaaccccatccagcaccgtgaatcttttcagccttctggcttttaaatttttctttgtataggacagttaaacaaaaccagagtcataattgaccattttaacctagtttaagtcaacatattgttaccacctctcgatatcagtacatctgcttctgcagcatgatctttggtggtggtggttgttgttgttgagagggagtctcgctctgtcgcccaggctggagtgcagtggcgcgatcttggctcactgcaacctctgcctcccaggttcaagcgattctcctgcctcagcctcccgaatagctgggactacaggcgcccgctaccacgcccggctaatttttgtacttttagtagagacggggtttcaccatgttagccaggatgatctagatctcctgaccttgtgatccgcccgccttggcctcccaaagtgctgggattacaggcatgagccatcgcgcccggcctggatatgtagggtttaaagcatttaagaaaatattttccgtcaccaaattgtcttccagaaaagtattgccaatctgatacaggaagaatggcatatcaacggagtttcagtttgtatttcctggagtgtatttgagctgatgttcctctgcatgttaataaacaagtgttttcgttcttgtgcgtgtctgtgttgtggtgtgggtgttctccaccctgaggcctctctttctcaacctgtgcatggaggttggccgaggcagcctctgaagtacatggagccctggacagcgccctgagtttctgtagggtttctttcttttgtggtattatcctttcttacgagtttcagatataggccatcagtctgcgtcattcagtaaggaataaagaacatggaaatgcctacttttcactacctttgttccggtgtgacgttctccttgtaaagggcagagggtagtagactaaggcaggcagcagcaggacggtgctgagaacggctctgaagagtctctcttttgtgctgacttaaaagttttctctactgttggatgatctcttgataattaaaaaagaaattatgatactgatagctgttcggcctgcagaataaagctgcagttacttcattcagcaaggtctcaggctcctaattttagagctcctagaattttgtagtcctctcaagattgggttctggccaggtgccatggctcacgcctataatcccagcactctgggaggctgaggcaggtgttttacttgaggtcaggagttcgaaaccagcctgggcaacacagcgagaccctgtctctattaaaaaagattgggttcaggccgggtgcagtggctcatgcatgtaatccaagcactttgggagacccaggcaggcagatcacttgaggtcaggagttcgagaccagcctggccaacatagcgagactatctctattaaaaaagactggagcctggtgcggtggctcacgcctgtaatcccagcacttcgggaggccaaggcaggtggaatacgaagtcaggggaccgagcccatgctggctaacatggtgaaaccctgtctctactaaaaatacaaaaaattagccaggcatcatggtgggtacctgtagtcccagctactcgggaggctgaggcaggagaatggcgtgaacccgggaggcagagcttgcagtgagccgagatctcaccactgcactccagcctgggtgacagagcgagactctgtctcaaaaaaaaaaaaaaaaaagaaaaaaagattgggttcaggctgggtgcggtggctcacacatgtaatccaagcactttaggaggccaaggcaggcagatcacttgaggtcaggagttggagaccagcctggccaacatggtgaaaccccgaatctactaaaaatacaaaaaaaaaaatcagccaggcctggtggcaagtgcctgtagtttcagctacttgggaggctgaggcacgagaatcgcttgaacccaggaggcggagtttacagtgagctgagatcttgccactgcattccagcctgggtgacagagcaagactcttgtctcaaaataaaaataaaaataaaaaaagattgggttttaggtactatgccaatatgggagctcttttaaatttaaagcaaatctcaaaataaaaaaatggacattctataatctcccccttgcccacccaagggagtgactctggtctggtatggggggatgagaatctgaggctgacaccctcaggcaggtggctgaatctcaggcccacagagactgggttgctgttggctcctgtagcggctccactgtggagagaaaggttctgccagaaaatctgggagccacagattagaaccttcctccaggcactcaccatttctccccatctgtgctctcggcgggaggtgctttgtgcccacttggcccaggtgcagggacccagcaagaatgggacagacctggctgctccctgggggaggcagatgggcaaaaggacgttatggcctgagcacctagcagcctccaggtacaggtgttctctggatgcagtcctgaggctcaggtgtaggcccctgtgtgaggtgggggtaggtggggctggaaagtgttctagacacagagacgagggtgcatcatagaatttggggacgttgggtcctacttgctcttggggaatgggagctttgcatcctgtcatctttgtttccctaaagatcaccctgggtgctgggcatgggggtgcgtgtctcaactactcgggaggctgaagtgggaagattactggagcccaagagtttgaagctgcagtgagccatgatcactcctgtgactaaccactgcactccagcctgggcagcatagtgaaaccccgtgtctttgaaataataaaataaagatcaccctggcctctttctgacccgtatctgaaattggttgtctatgtgaagcagaacagtggtacccagagaggcagggcactgaggcttgttttattttaggggacgacattgcaggtgggctttccttgggagcagatatttccttcagagggacataaagagtgctccttggcaggctgtcttccaggtggcctttggcactgcctgcagatcgggtgggcagtgcagctggggagctctgtgcactggcagggtcacctgcacgtggtctcatccttcacagtagaagtttgtggcatctgctgctctagcctggtgtccagatgtgtcctacagagacatgttgacctgttttccaagcacacttcagtgtgaggacttatttccatatagtcctttttattcatatatctcaaacttttttgttttttttttgagacgcactctcgctctgtcgcccaggctggagtgcagtggcgtgatctcagctcactgcaacctccgcctcctagtcctggttcacgcaattctcctgcctcagcctcccgagtagctgggattacaggcacatgcctccgtgcccagctaatttttgtatttttagtagattcggggtttcaccatgttggccaggctggtcttgaactcctgacctcatgatctgcctgcctcggcctcccaaagtgctgggattacaggcgtgagccaccatgcccggctttaaaaacatttttttaagagacgggctgggtgtgatggctcacagctatagtcccaacactttgagaggctgaggcaggaggatcacttgaggccaggagttcaagaccagcctgaacaatatagtgagactctgtttctacaaaaaatataaaaattagccaagtgtgatggtttacccctgtagttccagctacttgggaggctgaggcaggaggatcacttgaggccaggaatttgaggcttcagtgagctatgattgtgccagtgcactctagcctgggcagtagagtaagaccctgtctccaaaaaggaaaaaagagagtcagagagagagagatggcgtctcgctctgtcactcaggctggagttcagtggcacagtggcagcctcctgagtagctgggactacaggtgtgcaccactgcacctggctaattaaaaatatatatatattgtggccgggcgcagtggctcacacctgtaatcccagcactttgggaggccgaggcggtggatcacgatgtcaggagatcgagaccatcctggctaacacggtgaaacctcgtctctcctaatagtacaaaaaaattagccgggcgtggtggcaggcacctatagtcccagctactcagtgggctaaggcaggagaatggtgtgaacccggggggcagaggttgcagtgagccgagatcgcgccactgcgctccagcctgggcaacagagcgagactccatctccaaaaaagaaaagaagactaaaacgtataaattatacctgtctccctacagaaattcattaagagactcatgctcagactgttgtctggttaatgtgaacaacatgagcacatctgaagaaagggtgagaacaaagggttacattcagctttcaggtcaactaatttaaaacaacaggacgggccaggcacaatgaattgtgaaaaataacgctgacaatttaaaatagtggaacaaaattaaaaaaggaaaaagaaaaaaaactgtaaagaaaatttgacatatgaaaaagcgtattgtccaggcgcagtggctcacacctgtaatcctagcattttgggaggccgaggtgggcggatcatgtgaggtcaggagtttgagaccagcctggccaacatggtgaaaccaatctctactaaaaatacaaaaattagccgagcgtggtggcgcgcatctgtagtcccagctacttgggaggctgaggcaggagaatcacttgaaaccatgaggcagaggttgcagtgagtcgagattgcgccattgcactctagcctgggcaatgagggaaactgtctcaaaaaaatagccgggcgcagtggctcatgcctgtaatcctagcactttgggaggccgaggtgggcagatcacctgaggtcaggagtttgagaccagcctgatcaacatggagaaacgccgtctactaaaaatacaaaattaggccgggcgcggtggctcatgcctgtaatcccagcactttgggaggccgaggcaggtggatcacgaggtcaggagatcgagaccatcctggctaacacggtgaaaccccttctctaataaaaatacaaaatattagccgggcatggtggcgggcgcctgtagtcccagctactcgggaggctgaggcaggagaatggcgtgaacccaggaggcggagcttgcagtgagccgagatggtgccactgcactccagcctgggcagcagaacgagactccgtctcaagaaaaaaaaaaaaaaaaaaaatacaaaattagccgggcgtggtggtgcatgcctgtaatcccagctactcgggaggctgaagcaggagaatcacttgaacctgggaggtgggggttgcggtgagccaagatcgcaccactgcactccagcctgggcaacaagagtgaaactctgtctaaaaaaaaattgaataacataaataagtaaataaataagtaaataaaaacaggatggaaattatacctgaaatttaaaaagtaagatggctgtggtaggccaaataatggctcccaaagatagctaggtcctgctctgtccgctgagaccaccacactctacacagtagagtcctcctcatgctatgctctggccctcttgcccctccaacctcacttccagctgccggccccctgctcactctgctcctgacactccacaggcacacatcctcctccaggcctgtgcagtagctattccctctgcctggaatatgcagtcctgtatatctccagctcagtgtctcacagcgctgtcaccaggcgggacagagtgtcgggctcattcaggtgctcagcagaattcagctccttgaggttatagaactgaggaccctgtttgctggttggtcgtttgccagaaatggttcttaggtcctggagaaccctcaggttcaaccacatggtcctcccaggtatggcagcttacttcttctttgagaccaggaggctgctacgatggagtcttaagttaacataaatcacagctaggtgtggtggctcacacctgtagtcccagctactcaggaggctgaggtgggaggatcgcttgagcctaggatcttgaggctgcagtgagctgtgtttaccacaccactgcactccagcctgggtgacagggagaccctatctcaaaaaaaaaaaaaaaaagttttaggccgggtgcagtggctcacagctataatcccagcactttgggaggctgagttgggtggatcacttgaggtcaggagtttgagacccgcctggccaacatcgtgaaaccctgtctctactaaaaatacaaaattagccgtgcgtgatggcgggcatctgtaatcccagctgttgcgtagactgaggcaggagaattgtttgaacccgggaagcagaggttgcagtgagccaaggtcgtgccactgcactctagcctgggcgacagagtgaggctccatctcaaaaaaaaattttgttttaaagattaagttaacctcgtcacagtgactgtgccaccacatgcacaggccttgcccacactcaagagagggggtcttagaattctgcctgctaccatggtctagtcttggcacaccttccttgacaacatggaagccaggtcactacccaggccacctacaaggaagttcaccatttgacctgccgaacgtgcacaacaaactttttttctctttcttgagacagggtctcactctgtcgcccaggctggagtgcagtggaacaatcttggtatactgcaacctctgcctcccgggctcaagcgatccttctgtctcaccctcccgagtagctgggaccacaagcatgcaccaccatgcccagctctggctaattttttgtatttttggtagatatttttgtatttttgtttcactgtggtgcccaggtcagtttcgaactcctgacctcaagtgatcccctggcctccaaaagtgctgggatgacagatgtgacccaccacgcccaaccaagtattggataactttttagtttctttttcttcctcctttacttccgctcaggggtctaggtctgagtcagggcttgagggtgtccccatgggggctggtgttacccaggacactgcagcggctagcagggcttggctgggctggcgaatgagggccccacttctcttttttgtacagggaagggaccgaggatctgagtgacatctgtaggtcagagggcatgctgaccttgaaagcaaggtgggaatggagttctatgagctgaggagtcccagctggctcgcattctagagaagcgccataaagggagtctattcattagccccagggagagagcctcccgctccctccctccccgccccccaccccaccccacccttaggagctgctcaccttcccctcgcctggggcacacacctgcttctccagggaccagacctgaagtgcaggaaggagccccgcggccttctgttaccgcagcgctctgcctgccatcgttgaatgtgtggactctttggttgctttcataaattctgttttatttcctcatcatgtttgctgaaagcttgaatgtatccacttggctgttttccaagtattctcatgtgcattttaagagtctcctgtctttaaaataatgtggaggcagctctgaatatactaaaaccattgaattgtacccttcagatgggtgattttgtggtatgtgaattttatttcaatgaagctgttaacagaaatagtacagagtccgtactgttgtgttttctggagcacctggagtcccctctgtccctggccatccctccttccccacacctcacccctgtacctcaccttccccacccccctgcctcacccctgcacctcaccctccccacgcttcccgtatcagggagcttcttaaacacagaatggggtgttaagatgattggagggcagcagcctattggaatcccgatgaacgtggaaaggtgtcagggaggggtagctgtggtgtggaggagccccacattttcgtccctgtcttgtcacaaagaaggagcccatcgctgtgattagaaggacttaggccgggcatggtggctcacacctgtaatcccagcactttggcaggctgaggcaggtggattacctgaggtcaggagttcaagaccagctggccaacatggagaaaccccgtctctactaaaaatacaaaaaattagccaggcatggtggtgtgtgcctataatcctagctccttgggaggctgaggcaggagaattgtttgaaccagggaagcggaggttacagtgacccgagatcacaccattgcactccagtctgggcgacagagcaagactctctctcaaaaacaaacaaaggaaaaaaacaaacaaaaaggccggggctcggtggctcatgcctgtaatcccagcactttgggaggccgaggcggtggattgcctgaggtcaggagttggagaccagcctggctaagatagtgaaaccccatctttactaaaaatacaaaaattagctgggcgtgatggcaggcgcctgtaatcccagctactcgggaggctgatgagggagaatcatttgaacctcgggagggcagatgttgcagtgagttgagatcgcgccactgtactccagcctgggcgacaagagtgaaactccttaaaaaaataaaaaggaaacaaacaaacaaacaaaaaatcagctgggcatagtggtgggggcctgtagtcccaggtacttgggaggctgaggcaggagaattgcttgaacctgggtggctgatattgcagtgaggcaagatcatgccactgcactccagcctgggtgatagagtgagactccatcttaaaaaaggaaacaaaaaaaagccacaaagaaggacttagaattgggtgctaagcaggcctcttcctactgataggtggacacatctatttctttattattattattattattatttttgagacagagtcttgctctgttgcccaggctggagtgcggtggcatgatctcggctcactgcaagctccgcctcccctgttcacgccattctcctgcctcagcatcccgagtagttgggactacaggcgcccgccaccacgcccggctaattttttgtatttttagtagagatggggtttcaccatgttagccaggatggtctcgatctcctgacctcgtgatctgcccgcctcggcctcccaaagtgctgggattacaggcgtgagccaccgcgcctggcctatttctttattttttaatttttttttattttttatttttgagacggagtctcgctctgttgcccaggctagagtgcagtgagcgatcttggctcactgcaagctccacctcccgggttcaagtgattctcgtgcctcagcatcccgagtagttgggactacaggcgcccgccaccacgcccggctaattttttgtatttttagtagagatggggtttcaccatgttagccaggatggtctcgatctcctgacctcgtgatctgcccgcctcggcctcccaaagtgctgggattacaggcgtgagccaccgcgcctggcctatttctttattttttaatttttttttattttttatttttgagacggagtctcgctctgttgcccaggctagagtgcagtgagcgatcttggctcactgcaagctccacctcccgggttcaagtgattctcgtgcctcagccttctgagtcgctgggactacaggtgcccgccaccacgcctggctaaatttttgtatttttagtagagacagggtttctccgtgttagccaggatggtctcaatctcctgacttcgtgatccactcgccttggcctcccaaagtgttgggattacaggtgtgagccaccatgcccggcctggccacatctatttctgatggataaaagtggattcctgaatatgtgatatgcctctctggggacctgtggaatgacattttgcatgtcagaccagcacagtgcttttattctagacttttctaaaccttcccctctaaaccagggaaagcgagtcggttccccggttcctcatcatgggtaatcagaacagatctctgatttaggaagttggtttttttttttttttttttttgaagcagagttttgctcttgttgcccaggctggagtgcagtggcgcgatcttggctcactgcaacctctgccccctgggttcaagcgattcttctgcctcagcctccccagtagctgggattacaggcgcctgccaccacgcccagctaattttgtatttttttttaagtagaggcggggtttcaccatgttagccaggctggtctcgaactccagagctcaggcaatctgctcacctcggcctttcaaagttctgggattacagacgtgagccaccacacccggccaaggaagctatttttgtacttcaaacagaaaaactgagctgccagtgagcacatttcagagtaggaaaactcatattattcagcctacctgtctttcttccaaatttcaatttagagataaacacaccgtagcttttaagttgccaagaaaagagacatgagatgtactcaaatgccttcattttcccagtaggacctcatcattccaggtggttgaagcatccagtaggcgggtctttgttccttgctcacacacccagttaaaagcaaaggcctcccctcatctagagccaactctgagcagggtcgttaagcatcaactgccaagcataaccccctataaagttgcttgctatagtagttggtgcaaagctgactaaatgggaattaaaaactgtctctagccaggcacagtggctcatccctgtagttccagctactctggaggtcagttggaggattgctggagtccaggagtttgagaccagcctgagcaacatagcgagatcgcctccctacaaaaaatacaaaaattagctgggtttggtgacactcacctctagtcccagctactcaggaggctgaggcaagaggattggccgagtctagtcgttcacatctagcgtgggaaacatgttgtagacctcatctcatattgtatacctcctcaaaaccaaaaccaaaaaaccccaaaagcaaaaaccaaaaaaacccacaaaaccaaccatgaaaacacccctgtctctggaactccttgtccaaggtccctgaggctaatgtgatttggaacagaagccaactttcctgcaggtttagaaagtgtcacatacaggctctttctcattcaagcgtataagaacaggctttcttggccgggcgcagtggctcacacctgtaatcccagtactttggaaggctgaggcagtaggcagatcacctgaggtcaggagttccagaccagcttggctaacatggcaaaacgacgtctctactaaaaattcaaaagttagcgaggcgtggtggtacgtgcctgtaatcccagttacttgggaggctgaggcacgagaattgcttgaacccgggaggtggaggttgcagtgagccgagattgcactactgcactccagcctgggtgacagagcgaaactccgtctcaaaaaaaaaaacaaaaaaactaggctttctttcttttttttttttttcttggccacatgcaccagattgaagaataagctttcttgtctgttctctatacagtgatatgtaaaaatcaccactcagatcaaagaattgagaactgcgcagccaggcgccatggctcacgccggtaatcccagcactttgggaggccaaggtgggcggatcacctgaggtcaggagttcaagaccagcctggccaacatggcgaaaccccgtctctactacaaaaatcagccgggcgtggtggcacgtgcctgtcatgccatctacaaaggaggctgaggcaggagaattgcttgaacccgggaggtggaggctgcagtgagctgagatcacaccactgcactccagcctgggtaacagaggcgactctgtctcaaaaaaaaaaaaaaaagaattgagaaccgcgcacactctcacaagcactcagcagtggtcagtccattcttgggtgggtgatcggatatgactggagcaggtgctccctgtcactgtttttgttgttgttgttgttttttgggagatagggtctcactctgtcgcccacgtggaatgcagtgacgcaatcatggctcgctgcagcctcaacctcccaggctcaggcaatcctcccacctcagccttccaagtagctggaactactggcacgtggaccgacgaattttttggaattttttgtagagatgaggtttcaccatgttgcccaggctagtctggaactcttgggctcaagtgatccatccgccttggcatttcaaaatgctggaaagccaggtgtgagccattatgcctggccttagtttggttcaggctttatactaagtgcatctcaaatattttattgaacatcctttcatttctaagagtacttcagttatctctgttaaaatgaaccaaccagaaagattcccactcaagtgcaggacaacagatattagtatcaagaattaaggccgggcacggtggctcgctcacacctgtaaccccagcactttgggaggccaaggcggatggatcacctgaggtcaggagttcaagaccagcctggccaacatggtgaaaccccatctgtaaggtgggctgagtggctcacacctgtaattccagcactttgggaggccaaggtgggcggatcacttgaagtcaggagttcgagaccagcctgggcaacatggcaaaacattgtctctaccaaaaatacaaaaatgagccgggtgtggcggcacacacagctacttgggaggctgaggtgggagaatcgcttgaacctgggaggcagaggttgcagtgagttgagattgtgccactgcaccctagcctgagtgacagagtgagaccctgtctcaaaaaaaaaaaaagaaaaagaaaaagaaaaacaaggctgggcacggtggctcatgcctgtaatcccagcaatttgggaggccgaggtgggcagatcacttggggtcaggagttcaagaccagcctgcccaacatggtgaaaccctgtctctactaaaaatactaaaaaattgattgggcatggtggaaggtagctgtaatcgcaactacttgggaggctgaggcaggagaatcatccaaaccagaaggcggaggttgtagtgagctgaggccgcaccactgcactccatcctgggcgacggagtgagactccatctcaacaacaaacaaaaaaaccaacaaaaaaacaacaacaaatcaaaacaaaacgagcacttgttgggaacagcagggaaagccctttgtgtatatgtttagctgcttcgcgtctgcttttagaaagaagtgtccgtgccatcggcaggtgagccgcaggcttcagtgccattgggagatactgtatagccaggcttccagagccgcctctctccctgcccacgctggcccatgtgctgatctagtgtgaagtttacagatagcttcgggaactcctaggaacattttgcttattattgctgtggtttctgataagataagctttgttgaaaacagtataattcaagtatgatagtaacaacaagatgcagaaaggcggtttctcgttctgaaaggtgctttgctgtgaagccataatacagtgtgttattcgagaatcctgggaggagtctctgggatcctagttgactgtggtgggagaacttgttctgctttcctttctttcagattagtggatcatgtttctacatccatagtaggaacaatgcaatttgtcagtaagtttttcatactgcagtcaccctggagccagtgactgagtggattctccaccatggtgtttctgtaacttattgtccgtctgctggagcggtgctggctggctttggccactctggtttatgtctcttggctcggttttctgccactactggattttgcagggaagggcaggctgtctcatttttcacagtttcacctttttttttttttttgaaagcctctgaattgagtattttggacttggagaattagaactatccccaaatcatcaattacatgaaatccatctgttctacagattataaagaaaatataattaaaatggagttttaaaaatgtatactttgattcactcttgttcattctaacatggtaacatgtaaaaggggcctattctagttaatgatttgtttaaaaaatatttggttaatgtttcagaataaacaacttggtactttgtgttcaattagtagcttcagtgtggaaattcttaggaatcttcaggacagattggccagtctggactccggattaggtaactctcaggtacccagcaagactctcacattcttaggaatgagcttaggaatgaggacttttgtgagataagtggggagatgttttataaactccagttgtctccaggaagttggttgatgatggacttccgaggctagagtcacgctagcacacagagccctaggattggggcgatggccccggcctcttccgttgtgaaggggaagcggaaactcagtctctggctcaggaattccacactgtggggtcccttagctggggctggccctgtttgagcctgactttatgaggcatgttggctgacagtggcgagagggccagccacgggggcccgggccttgctctggtgccctgtgtgcttcgggctctctggattgcctcctgggcgatgctatagccttgctgaccacgtgctacaccccccatccttttcctgaaacagagcagctgtgtcctggcatctccagcagggctgcccttgagggttctgtgcttgctgcttggtagcagccccggcatctggacttcaccacagggcctagggggccttcctcgggttcaccgatgcccacagggcctggggggccttcctcgggttcaccgatgcccacagggcctggggggccttcctcgggttcaccgatgcccacagggcctggggggccttcctcgggttcaccgatgcccacagggcctggggggccttcctcgggttcaccgatgcccacagggcctggggggccttcctcgggttcaccgatgctcatctgccgtaacctgcctgaggccctagggttttgtcagttaatggatgtggctacagccagggctcctgccagcctgttgcctctccctgtccctgagcattttcacagtccagcccgccacccaagaggggctttcttcaggagtctgccccctctgtggctgaatgctgcctcctttttcctttctccctggcccacacttctttcttctttgctctctttttctcttttgctgttcttgaagttttcattatggaagagttcaaacccatatgaaagtggagagtagtgaaatggtgcactggtacccatccccagtcacagcaacgtgcaggcatgcctctggtgacatctgtgcctcaccccagattctagaggtatttctaagtatttcagtacatgtgtctaaaaagcagtgctctttaaaaaattatgaaaatgtcatcacacctacaaaaatgaacagttccttaatatcatcaaatatttatcagtgttcaaactttttttttttttttttttgagacagagtttcgctgtttttgcccaggctggagtgcagtggcacgatctcagctcactacaacctccacctcccggattcaagcaattctcccgcctcagcctcccgagtagctggggttacaggttcccaccaccacgcccagctaattttgtatttttagtagagatggggtttctccacgttggtgaggctggtctcgaactccggacctcaggtgatccgcctgcttcagcctcccaaagtgctgggattataggcgtgaaccaccacacccagcttcaaactttttttttttttttttttttagcagacaaattctcattttgtagcccaggctggagtgcagtggcacaatcttggctcactgcaacctccgcctcccgggttcaagcgattctccagcttcagcctcctgagtagctgggattacaggcgagcgccaccacacctggttaatttttgtatttttagtagagatggggttttgccatgttggccaggctggtctggaacccctgaccttcggtgatcccatctcagcctctcaaagtgctgggaatacaggcgtgagccacaaggcacctggctgcaatgtggttttaatttaatttgcatttctttaaggactaattgagcattttttcatgtggttatcaaccattcacacatattttctgatgaaatttctatttaagttttttgcccacttaaaaaaaaattgagttgtcttttttttttttttttttttgagacagagtctcattcaatcacctaggctggagtgcaatggcgcaatctctgctcacggcaacttctgccttccgggtttaagcaatttacctgtctcagcctcctgagtagctgggattacaggcatgcgccaccacgcctggctgattttgtatttttagtagagatggggtttctccacgttggtcaggatgatctggaactcccagcctcaggtgatccactcacctcggtttctcacagtgctggggattacaggtgtgagccaccgcacctggcctgagttgtcttcttaattataagatttccttatatattctggacacaagtcatttaacagatatatgatttgcaaatactttctcccagtcagtgtcatttttttgcttttattaatgtcttttgagtatgaaagttttaaatttttatttttaagttttggggtacatgtgtaggatgtacaggtttgttacataggcaaacgtgtgccatggtgatttgctgcacctgtcagcccatcagctgagtattaagcccaggtattttctgtaatactctcccccctcccaccccatcccctgaaaatttttaaatttttatgaaatccaatttacacttggcagaataaacctgcattctttctgaagagtttcattttgtgttacgtccatgtgtgagtcaccctacttagcgtttatgatttttgatatcaagggtctttttccctgagttattcgctaccaaggactctgcagagccaggaaggcatttctgaatgggcggtgtgtgcttatctatgttatctatgtaacatatctatgttggcatgctggatccttgccggaacaatacctaaaacttcagaactgatctccccacgtaagaccctggctgctggcgttcagtggccagggtcctactcctgtggttcatcacgccaggtgctgctggcagcccatttacagggtgctgcctgtcctgtggctgtgaccgtctgcagtggcccatggaggccgtgctgcctcctgcacgtgaggagtcagaggctgtcactgtcagcaccgcccctgttggcggcttctttgcatgtggtgaaaaagccaagctcgcgatacagcctaatcccgattccctaaagcggcccgcagccttcttggcaccagggattggtttcatagaagacgcctttccacagacgggcagggcgttggggtggtttcaggatgatactgttcagatcatccggcgttagagtctcataaggagcgcgcaacctggacccctcgcatgcggagcacacagtaggctttgcgctcctgtgagaagaacctgatgctcctgctgatctgacaggaggggagctcaggcggtaatgctccctcacctcctgctgtgcttccccgttcccagcaggccacacaccagatctctcccagtccgaggtccagggttggggacccctgctgtaaaggcttagggtaacctagtctcatttggcaattacaggtgaaggacttaactaagtacttggatcccagtgggctcggcgtgatcagctttgaagacttctaccaagggatcacagccatcagaaacggaggtcagtcatccccgccatgagctcccacctcctctcccgttcctcagccaccctctcagccacctgcacatcaccaggctcctcgtgctgactctaacatctttccttctccttgaagcccccaacataccccaggtttccaggtggtctctttcctttcttgttaccttctcctcacataccctgttttccagaatttgctgcgttaactacttttccataatgctagaaagcaactgcccccttcctcaaagatttcatgatgacaatttgagaattttcaaaatattgaaagaatgattccatggccacccaagtgggtgttcatcacccgtgctctgcaggcagcacttcgtcgcactctctccccacgtctctgtccatctccagtctgtcccccagcccctcttgaatgggatgtgtttgtaatcagcatgcttccgcgcacaccgccctgaacactgcagcccgtaccaccatcgttccctagagctcagtgtttgtttccagtcttcctttgagtaaaaatttacctgcagtgaaatgtacagctcacacctgctcctctgtgagctccgacagagtcctgtgcctggcagtgcggagcctgtcacgcacatcactgtccccatgtgggtgccgcatacccctcgccctcaggcagtgccttccctcctgctggcaccattgctgatttctgtcaccatggattagttttgcctatctctcttttttttctttgagactgagtttcactcttgtcacccaggctggagtgcaatggcccgatctcggcttactgcaacctccaccttccgggttcaagcgattctcctgcctgagctgggattataggcacccaccaccatgctcacctctactaaaaatacaaaacatataaaaatttttgtatttttagtagagacggggtttcaccatgttggcggggctggtcttgaactcctgacctcaggtgatccgcctgcctcagcctcccaaggctgaggtgctgggattacaggcatgaaccaccgtgcctggccagtttcacctgtcttgagggttcgcgtgctctcacttggcttctttcctcagcacgatcccttccccagcacgatcccttccccagcaccatcccttccccagcaccatcccttccgcagcaccgtcccttccccggcaccgtcccttccccagtcccccggcaccgtcccttccccagtcccttccccagcaccatcccttccccagcaccgcaccatcccttccccagcaccgtcccttccccagcaccatcccttccccagcaccgtcccttccccagcacgatcccttccccagcaccatcccttccccagcaccatcccttcctcagcacaatgtcttccccagcacaatgtcttccccagcaccatccctttcccagcacgatccgttgcgtgcttgtgccgtatttcgtttcttcattctcctggtgatgggcacgtttgtgtacaactctttgtgtggatgcgtgtcttcaagtccttggggcctgtatctaggagtgggtcatgtgctggggtaaactcggttcttcacagtggccgtgccttttcacactctcaccagtccccatactatacactgtccgtcttacgtcaagttctgaagctctgaacaggccatctcacttcctcatgtttggccaggcggtgtaggggtgacggtggcgggtcctttccctccttcatgcacgtgcaggataagtagaccttggctggggccctcagagtcagcaggtgcagtgagggagacggatgcccttggacctcgacctcaggtcttgtctgtctcctccacagaattattgcctgacagtgtctctaagggttttctcagatgccaagtctttagatggctctggggaaacgtgctgtgtgttgttccccggtttttttttttttttttttttttttgagacagagttttgctcttgttgcccaagctgaagtgcaatggcatgatttcgtctcactgcaacctccgcctctcgggttcaagcgattctcctgcctcagcctcccgagtacctgggattacaggcatgtgccattgcgcccagctaattttgtatttttagtagagacagggtttctccgttttggccaggctggtctcgaactcctgacctcaggtgatccacccaccttggcctcccaaagtgctggggttacagacatgagccactgcgcccggcctgttccccatttgttactctttatttgactgtctgttcttccacccatgaacatgttgtgggaccagcacggcctctgcgctgggcttggccccggggcctctgtggtgaaccagcaccagagcaaggccagcgggctgcggcaggacaaatgggtgaggtgctgctgctgtcagcgtagcaggccgggggtgagatgggaactaggcaggcagccctctctgaggaggggtggaggggagaaaggacaccctgacaaccaggtaaagaccatctggcccaggtgaggaagcagtcctgaggtggggcgaggggcccaggacgaggatggagagatactgcaggctctgcaggctgagaggagcgtgcaggcaagctctgggtcaagggggcctgcagagcaatgggcagagtgggtggccacagaccctcaggaggcagcattggcaggagaagggggaggaagaggacagtcaggaggcctcagagtctgcaggctgagcaccagcaggttgaggctgatggggccgtgtctcagtctaactgataagctgcaacccttaagtaacatcttaagaggataggtgtgtactttatacatttatttaacgtttgtccttctgtacaaagctttcagtagcggctttgtgagaattttggcgtctcacatactgtgccttgaggcttgctgcatggcgtgctgcaggtcctccctccaggccttctggaaagtctggttctcctcaggttactcctgggacatggcagctgtgcccatgaccctcgggatgagtttgttctctaactgattcaccggttagctctggggagattctaggtgtaaattttttcctcttagtttgaaaaatccattatgggccaggcacagtggctcatacctgtaatcccagcactttgggagactgaggtgagaggatcagttgatcccaggagggtgagaccagcctgggcaacatagtgagaccttggctgtgcaaaaaaataaagtagttgagcattgtggcgtatgcctgtagtcccagctacttgggaggttgaggtgggagcatcccaggaggtggaggctgcagtgagctgtgtttgtgccactgcactccatgcactccagcctggtgacagaccctgtctcaaaaacaaacaaaacaaaaaaaacttgccattaattccaaacagaattttgtgtgtaatagagaatgcgatctttatgacactgatgctttggtacttgctgggccggctgggtggtttttatgcatgtgatgggtacgcctgagaggatgcttcttttctaatcattggtcccctgagttcatggaggtgcgagctggagactcacgttagcttggtctcagtcgcagggaggagaaaagccgctcatgaagctggtagctgtgtcgtttttgttttgtatagctgtgtttcgtcttcactcttaagtcaagaattactggatgcaggcttctaggttgatggtgagggagcccggggacccccagaactggttgtcatcggagaggcctcagtgtttggggctgagatgggtgcatggaggccaagcacaagaccccaggaggcagttaccacttccatgaaaaacaagaagtggaataagacagcctgtacttcttggtccagtaacaagccatattttacatagccataatagttaaattgaatattgatgtaactgaagatggcgatgtaaccattttggaagattggaggagggaaaatggggcagggtgcagtgtggcagggcatctcatggggactgtttggcaaaacagagggaagtagatgcgagcttagaggggagtgtgggcggcctgtcagtagccacggcctctcagcactggctcctttttcttttgagatggagtctcgctctgtcggccaggctagagtgcagtggtgtgatctcggctcactgcaacttgcgtctcccaggttcaagcgattctcctgcctcagcctcccgagtagctgagaccacaggctcgcgctgccacacctggccaattttttgtgttagagatggggttttgccatgttggccaggctggtcgtgaactcctgacctcaggtgatccacccacctcggcctcccaaagtgctgggattacagacgtgagccaccgcgcccggccagcagtggttcattttctagtgacaggcacgtgtatgaaatcacagggaacaggactgtaactccacgcattttgaataaaaccaggaattctttgttgtgactgctggtcttgttataaatgttacaacccatttcctcggtgccacaaagactcagagcactcagggccctggccagtcactggctgtgctggtctcggcttgtcatagggtaaacttgctctgcacaatgtggctggcagagcgtgttcctgggcctgtgactgagggcagcctgcaggagatttgggctggagatgtgttccctcgggagtcagggacacagcctgtcatggagagttaagacgggtcttttgtaggtttggacaggtgaagtgctcagatccctctgcagggtcaaggctgggaacagcagtggccccgggtaccatgacatgggcaggagggagccacctgggtccacgattctgtcgtcagggtaggggttggtttgttcctgtggaccatggctaacgtgaaatggggcaagctcagctctaggggttcctgggaggccttggcttggaaggtgcccactctcagctcaggagtcagggtgtgggagatgcccaccaagcaaaatgaagcctctagcctggcctgctgccctcggaggagcccgatgctctgtctgggaagcctgggggctgccagctgtggactgtggctgcctgtggttgccggtgtcttggcttagtgactgaaggggtgagagagtgatcgtccaaggacagcccatctccagatgtttcttagtggttgcccagccacctgacacgccaagctggggccttctcccagacaccgtccccttctctctttgctgtcacctgggccaatcccacagcagctggggcaccccgttctccttcccagcagctgacagatgggcctgggagggctcctgcgcctgtctgcttgagagggcggtgagctagtcatcgtgagccggccagggctctcctatctcactgcattagagcttgagccaggctggtggaggtggctgcagccgagggagagcacggctggcacctgtgaggaccatggatggggacacatggggcaacgggcccgtgagtgctgtcgaaccagcctgttccaggctctgggacgtagcacgaaacggcagtgcagaacccctgcccttgggagctggctttctagtgggagacagaccacaaagtaaggcaggagctagggaggcagaggagtggggaggcctccctgagaacgtctgggatgggaaggcagcatcccagcagggctgcacctggcatgtttggaggccacagggaggcagggtcagaaggagcaggtgagaggcaggcctcacaattctgtctccagctccaggctcctgaagaggatggtggggcatccctgagagctggtgtgaggggtgggacactgagctgactgcagagctgactgcagagtggagtgggcgtcagggaggaggtgcagtagcctcagggaggaggtgctgggacgtcagggaggaggtgcaggggcctcagggaggaggtgctgggacgtcagggaggaggtgcaggggcgtcagggaggaggtgcgggggcgtcagggaggaggtgcaggggcctcagggaggaggtgctgggacgtcagggaggaggtgctggggcctcagggaggaggtgctggggcgtcagggaggaggtgctggggcctcagggaggaggtgctggggcctcagggaggaggtgcaggggcgtcagggaggaggtgcaggggcgtcagggaggaggtgctggggcctcagggaggaggtgcaggggcctcagggaggaggtgcaggggcgtcagggaggaggtgctggggcctcagggaggaggtgctgggacgtcagggaggaggtgcaggggcctcagggaggaggtgctggggcctcagggaggaggtgctgggacgtcagggaggaggtgcaggggcctcagggaggaggtgcaggggcgtcagggaggaggtgcaggggcgtcagggaggaggtgctggggcgtcagggaggaggtgctggggcctcagggaggaggtgcaggggcgttggaggaggtgcagggaagtcagggaggaggtgcaggggcgttggaggaggtgcagggaagtgagggaggaggtgcaggggcgtcagggaggaggtgctggggcctcagggaggaggtgcaggggcctcagggaggaggtgcaggggcctcagggaggaggtgcaggggcgtcagggaggaggtgcagggaagtcagggaggaggtgctggggcgtcagggaggaggtgctggggcgtcagggaggaggtgcagggaagtcagggaggaggtgcaggggcgtcagggaggaggaggtcctggggcgtcagggaggcggtgctgccatggcattggacacatggcctctggggctgcggggtctgctttacttttgagtaatttgatgtcatgatttatgtttcgttcggaaggagagtgaaactagaataaaacgaagtcgaagatgattttggaattatttcatagcatttagaagaaaggaaaatgtgatcatccaaaccgcacttcagccaaagttcacttcaggtgttagctccatcgtggctgcagcagcctgtgttgtctgtcagccctgtctgcgtcgaggagtgaccagcaggatgtgctggcctagtttgctgggaagcacaaggaggctttcctgtcacagccacaggccttgtttcaggaatagaatgagatagagagggattgttccaaataggccattgctgtgtctcacacaccctcacgctttggaagaataagggaaacgcacgtgaaaaattcctaattaattgaaaattgttttagtttttataaggaaaactaatatgagaatggtatttaggtcctaccaagaatataaaaatgccatctgtgttcatatcccctgctccgccctctggggcaagaccctcagattgtttgcccactgtcagaacctgagctgtcatgcgctgtgtccaaaatgcttcgctgtatattgaaagtttttagttctgtgtttcagtgtttataagcgcaggcaagactgttagcattttaaaatgtaatttaatttttaatttattattattattattattattttgagacagactctcgctgtagcccaggctggagtgcagtggcgcgatcttggttcactgcaacctctgcctcccgggtcccggttcaagctattctcctgcctcagcctccctcccaagtagctgggattacaggcacataccaccatgcccagctaatttttgtatttttagtacagacgggttttcaccatgttggccactatggtctcgaactcctgaactcgtgatctgcccacctcagcctcccaaagtgctgggattgtaggcgtgagccaccatgcccggcctattttttattattttaaatgtattatttatgtatttatgagacagggactcactttgtcacccaggttggagtatagtggcatgatctcagctcactgcagcctccacctcccaggctcaagtgattcttgtgcctcagcctcccgagtagatgggactacaggcatgcccccaccacacctggctaattgtttttgtggagatggggtttcactgtgttggctgggatggtctagaactcctgaccttaagtgatccgcccgcctcggcctcccaaagtgctaggattacaggcgtgagccaccacacccggccttatctttattttttgtagacataggatctttgctatattgcccaggccagtcttgaactcctggacttaagcaatcctctagtgtcagtcttccaaagtgctgggattacaggtgtgagccaccatgcctggtctccacttttcttttttcttcgagacagggtcttgctctgtcactcaggctggaatgtagtggtgcagtcttggccaactgcatcctctgcctccctggctcaagccttcagagtagctaagactacaggtgtgtcccacaatgtccagctgatttttttcttttcttttctttctttcttttttttttgagatggagtcttgctctgtcgcccaggctggagtgcagagtggtgtgatttcggctccctgaaacatccgcctcccaggttcaagtgattctcctgcctcagcctcccaattagctgaaattacaggtgttcgccactatgcccagctaatttttactatttttagtagagatggggtttcaccatgttggtcaggctggtcttgaactcctgacctcaaatgatcctcctgcctcagcctgccaaagtgctgggattacgagtgtgagccactgcacccgacctaatttttgtatttttgtggagatggggtttcaccatgttgcccaggctggtctcaatcacctgggctgaagcaatccacctgcctcagcctcccaaagtgctgggattacaggcataggccaccgtgcctggccccaaccttcacttttaaaataagtgattgacattagaatagattgtgttaaaggtattaagtaatgctattttataagtagctggtctattttaggcaagtagttgaattaatagtgagacagtgtgaagacacctaagtgtcttctgtcactcacaggccctggaaggtgctttgacctgtgaatatcactgagacgctggaagccagtgccttttcctacaggaggagaggcaggtgctgcgggattggttgtgtttgcaaagtgatgactgtagctgacgtaagaattatagcctgtctctcatgagaagatagcttttcctttaaagtttttctcatagaacattgattatagaagataagcaaaaaaagaaaataaaatgaaaactgcgcgtgaacccagcacccaggaaaagatgttgtttttgtattatttcatcatacctacaccttctcatgtaaatgtttttaaaggtttaaatctgattggtacctaacactttttaaaggccatggacagttttatggagctcaatgtcttgctctttttttttttgcagtgctgtctgcttcttttaagaaataaaaagtttatctcctacctctgcatctcctcctcagaattctctccagaagccttgttcctgtgggcaacgcatctctgacccgttggcaaggctgttttctctccctggatttctcatgctcactcccttgcttgtcttgaccccccccagggcccccaactcccacacatctgtccctgggggcctccttcccagggagtcccgaggccgccaggggtcccgtcactgggtggctatgggtggcctgttgagcacgaggtcttctccctgcagatcctgatggccagtgctacggtggtgtcgcttctgcccaagatgaggagcccctggcctgcccggacgagttcgatgacttcgtcacctatgaggcaagtggttttcacccaggagcttgggggaagtctggcatccacctcttcctttatgccctacagctcgtgcctcctgcctccgggctgtcttccgtagaagctggcgtgaaggaagggcctcccgccctgtgtgcaccgtggggctctgtggctgtgacgggaggcccacagttgtctgtcccacacgccctgtcagcctgggcaggaatcctcccccagggcctgtcgccagcagaagtggggtgggcagtgatgtcatgaccacccgctgccaggctggcaggcacaggcggagcagagggcttgggaggattccttttgtcaacttgcaaatgattttctgtgtttggggatgcctgactaatgcctgcccctgcttggctgtcctccaccctgctcccagatgcagccagggttgtcatggtgacgtggcgtctcctgtgtctcctgtcactgtgggtcccttgttctcaacatagctggggagagggtcttcgagcacagccgtggtcgacagagcgtaaccatgtccgccggtctggagggttagattccaggagagccacgtggctgcagcagaaaatgcatgaagttgaacttgagcccttgggggccgccgggaaggtggaggtggcagccgccagtcctggtcagcctgctgccgagcaagggtaccagaagtggggctgagctgctggccggtagggcctgggcttctcatgtcagtcctctgagccctgactcctcgaaagctgaggctggcacagggtagtttttgagttgcttttggacgccactgtaccgtgggagccatggtattatactcagttccctgttccgagaagctgccccagggattagtcaccctcacccttgggtgggcagcttaacttctgcccacacagaccctgggggtggttctgccttacggcggtgtcccagttatcagctgggctgcagcttctggggccagggcgcccaccgtgggtcccatgtttggccttggtgtgctctttctgcacgtgaggcagcagtgaggtgctggctaagagggcgtgtggtgggagttggaccctctcgcatggctgcagtgtgcagaacgtgctgggagaccccaggactacagacggtggctcctgtgccctgagaaggacccggcttcttcacgaggagatgcccaaggctctgcagggtaacccagagcccttggtctgcaacgtccggggaactgtgtgttcctgggcgttcatgtgcctgtgcactctttctcacgtgtatccgtctttttgttcccctctcatgtttgttagggcattgttgattgtttatatcctatgtatggtgcagtggctgaagagtggcctctcaaaagatatgtccacccagcagctgtggatgtggccttatttggaaaaagggtctttgcggatgtagttcattaaggatctcaaggtgatatcatgctggtttgggccctaaatccagtgacaggtgtccctggaagacgggagagacacacagggggaagaccataggaagacagggcagagactgaccagagccagggaactcctggggctcccagaagccagcagaggcaaagatgcatcctctccgagagccttaggcaggagccagccctgctcacaccttggctttggacttcgggcctccagaactgagaggataaactggtgtttcttcacgccccgtggtctgtgctagttcgttatggcagccctgggcagggaaaccttgagtgacgttactcgaggcaccaaaggcaccagtgcattttatccttaaaggcccacgtggtctgaagggtgtggccgagcctcacgcttgtcacttcagaagggtgggaacctgacatgtcagagctaatccttctcatatttttagatcctgatttcttttttagaatggaagaaagttttttgacttaaaaaaatgaatatgcttcatgttttagagcaattttaggtttacagaaaatggaacatagtgtagagcattccgggatcacgttacatgattatttgttttgttttgtttgagacggtctgctctattactcaggctggagtgtggtggtacagtctcgatcttggctcaccacaaccttcgcctcctgcgctcaagtgttcttctttctcagcctttccagtggctgggaccacactcagtaaccaccacgcccagctgattttttgtattttttttttgtagagatggggtttcaccgtgttgcctaggctgctctcaaactcctgagttcaagcgatccacccgtcttggcctcctaaagtgctggtattacaggcgtgagccaccgcacccagcctgatatgttagtattagccaaagtccgtagttgagggttcactcttggtggtgtgtattccgtgttttgacaggtccacgattatagtgtcacagagtcgattcagtgccggctcatccctcacaccagcccccacaaccaccgatcctccgtgtctccacagctctgcctcttccagaacgccacggagctagaaccatctggcatgcagccttttcagatgcgcctctttcccttagtgaatacgcagttacctctcctccatgtcttgctttgctttttaagggtgggatgtaattttccacaaagtggagttcgatactgtgaaacttatggaaaatttgctcttttaaaaaacagcttgcacatcatgtcatcttaaaaaaaaaaagtctaataaagatatgagtagggagtatgtgttccatccagataccctattcggggaccctccactggtagtcttcaggtaaataaacctttgattgattggttgattggttgattgattgatattctgaatggttccagtcagacccatttctctttactgggagcatcgcagtgctcacaccggggtggtcgggtaaaatgtgcagttagtcatggccgagctagtgggtctgctggctcgcactgttttcccagggatcctttcagcaggcagcttataacgggaaagttgctgctatggtgtctgagtaagtggggagagtagaaggggatggactgtggcgccgctgagttcctgggcatggtgatgtctgaggatctgagcaggtggagcccagggggtggtggggctgtttgtcgggtttctggaagagcgaagggaaagtcagggagtgtaaggcgcatctcacagaatcgtcgggccgcgctctctcccgtcctccctccttctcccactactggcgatgtctggagcaaagagctgccttagtgaaatgatagtgaaatgtgtcttttgtgcaaaccattatcagcttaggaagccaaaaacaaaagccactctgttttcagccctgactgactaaccgttttttaaaccagcaaggacacttcctgaactttgccttcccctccctgggcaacaccagcaggaggtttattagagcgtgtctgggagcaggttaaactttctcctaggtggtgatgtgcctccaggtgagcgcacaggctttgcagaaaccccagcatgacaagcaagtaggaaggtgacattgttgtttgagaaaagccagtgacccggttgggacggagacacgatggggagccggtctccaacagcatgcccttcctgaaggtgtgtacagagccaggcccagcctgtgaggccacccgggccagcatctgagggtaagaggaggcagtagtgtgcactgtgcccagtattcctatttctgtggtggagagaggctcagggaagaaggaactgtgacggggacagtgttggccccacttgagttactgatggccctgaacgggctttttctctgtccgctggtgatttaggggacttgttaattagtgaatgtaacgtttcaacatagcgacgttttccaagatgcactttgattttcaagcgagttcatcttaacattggtaatttgtaaaaatgttaaaaagttggtagcatagacttgatggcttctgggcaaggccaggtcctggctggctggcaaataaaataaactgccggggccggtgtgagctgttactgcattttatccaggaggccgggagtgagcaggcaccgtgctctgaggtacatttttgtctctggaaaggcaggtgatggctgccctggaaaactccatgtagggaggccttgaactgcagaaaccaacccgcagggctgaattgggaagtgagcaggtggggtggctcctgtgagcctcatgagctgtctggaacccccagggcatccagccggccaggggctctgagtatcgatggcgatggcatggaagtggacgtccacaaccccagagcaaataaaggggtgggtgcagtcaccgaagccgctgaggagtggaactgttcatctctgtgggatctacagtgcacggagccactctgcaatggcagggaggcccggcttactttattttttattttttaaattgttttttgagatggagtctcactctgtcacccaggctggagtgcagtggtgcgatcttggctcactgcaacctccacctcccagattcaagtgattccatgcctcagcctcctgagtagctgggattacaggcgcccgccaccacacccagctaatttttgtatttttaggagaaacagggtttcaccatattggccaggctggtctcgaactcctggcctcaagtgattcacccaccttggcctcccaaagtgctgggattacagtgagccactgcgtctggccctcaggcttactttagaaatgagaaggtgaaggtgggtccagagcggagcgtgtgagttccaggcttggcagggtgccctggcatccagcttacagggagtctgagtttgtgtagaatctgcctcattgttcctgtgtccgtggagaattctttccatcccaaaccatcctgtctaagctctgaggaggcacaggtggctctaaggcggcactggcttttgcctgcaggggcaccatcctcagctacaggtctaacaggaacttggtgaaataagcaggccccactgcccggacctccctcccttcgtaggacagatgctctgctcagggctccatgagctgtttgagagaaggtgtgggtttgttcttagaaacatcatgctttctgttggggacttagggtccacactggccagggaagggcatcgggcatctgtcagaagtaccagtccattgactttttaaaagctggtccaaggtcaggtgcggtggctcatgtctgtaatcccagcactttgggaggctgaggcaggagaattgcttgaacccgggaggtggagtttgcagtgagccgagattgcgccactgcactccagcctgggcgacagagcaagactctgtctcaaaaaaaaaaaaaaaagaaagaaaaaattttaggctgggcatggtggctcaggcctgtaatcccagcactttgggaggccaaggtgggcagatcacaaggtcaggagttcgagaccagcctgaccaacacggtgaaaccctgtctctactaaaaatacaaaaattagttgggtgtggtggcgtgtgcctgtaatctcagctactcaggaggctgaggcagaatcacttgaacctgggaggtagaggctgcagtgagctgaggtcacaccattgcactccagcctgggtgacagagcaagactccgtctcaaaaaaaaaaaaaaaaaaattagtcaggcattgtggcaggcgcctgtaatccctgctacttgggaggctgaggcaggagaatcgcttggacctgggaggcagaggttgcagtgagccaagatggcgccactgcactccagcctcggcgacaagagcgagactctatcaaaaaaaagaaaaaagaaattttaggctacgtactgaaccactgaacctgatgttgtaataaccacactttttagagtcagcagcgggtcttcctggtgcccctggggtgagtctttgtcactgatgactctggggcagtgtggcccctgtgagtgtgcaatcctgttggggtagctggcaactgccctcaaaccgtctcggacctgtgcgctgggcttcgcatcctgccccgtcatgccttccccacaggcccagcctctgacagacatcctgggcctgcctgctttcctggccactcccgccttttcctgcctggcgtcccgcaggcccagcacaggccagccctgtcctgagtgggccctgggccctgccgtcctgcaggagtgggagctgcccagggacggtgagtagcacgagagctggggtttcttacagtgctctcctggttctggatgttacagtggatgctcttgaggaatgacttagtttttatgaattacttccttagattgtaggggagattataattggacacccagagtaggtacacttcacagcactccctgttcccttgtggctttagaagcagctggcagggatttcccacccaccagtgacactcgcaccctgcagtccttgtttctgtgctttgaaaagcaccttcctgggttgtctttcttggttccatgaggtggccaccttgtgagacgagaatttataacccccgtttgcggcagggctccaggtggttgagtcacacgtctgaggtcacacggcttttaataaaggggccaaagatggaactgcggcctcccgcaagtgcgccaggctcctggcagctcggcctggcccttcacgtctcttccagtgaggctcaggtgggtgcagcctggggtgggaccctctggtagccctcgcaggtcttagcacactgtctacttcttttttttttttttttgagatggagtcttgctctgttgccaggctggagtgcagtggcatgatcttggctcactgcagcctctgcctcctgggttcaagcgattctcctgtctcagccccccgagtagctgggactgcaggcacgtgccaccacgcctggctaatttttgtattttcagtagagatggggtttcaccatattggctaggctggtctcgaactcctgaccttgtgatccacccgcctcggccttccaaagtgctgggattacaggcattaaccacggcgcccagccactttgtctgcttcttacgatactagaactagagtgcaaagggcatctttttctgctgggactgcagcttttctgagatcttgtttatttgcaaattgttaacctcagagtcttctgagcatgaaatgttggccacttttcctaaccagcaatttcattttcattaaggttgaaattataaattgaaaatgttggctgggcacggtggctcacgcctataatcccagcactttgggaggctgaggtgggcagatctcttgaggccaggagttcaagaccagcctgggcaacatagcaaaacctcgtctctacaaaaaatacaaaaattagctgggcacagtggtgcatgcctgtaatcccagctactttggtggctgagacacaagaatcacttgaatccggaggcagaggttgcagtgagctgagatggtgccactgcactccagcctgggtgacagagtgagaccctgtctcaaaaaacaagaacaattagaaaaagaaaaaaaaagttctgtttaatagttctttagttttgtgttcatttgtatgatccacaaatatttactatctacctatacctggtcctatgctagatgctagatacttaagagtaaaaacaagttgggtgtggtggcttatgcctataatcccagcacttcgggaggctaaggcaggcagatcacttgagctcaggagtttgggactagcctgagcaacatggcaaaaccccatctctacaaaaaaatacaaaatcagcgaggtgtggtggctcacacctatagtcccagctactcaggaggctgaggtaggaggattgcttgagcccaggagtttgaagctgcagtgagccaagaccgcacgactgcactccaacctgggtgtcacagtgagactctatctcaaaaaaaacacagcagtaaaaacagtaaaaacaattggttgcgatggctcacacctgtaatctgagcagtgtggaggatcacttgaggtgcggagtggatgaccagcctgggcaacagagtgagaccctgattcaaaataaataaatcaacaaacaaacaaacaactgagccaggtgtggtggcacctgtagttcccagctacagctagatcctgtctctattttattaaaataaaaaagaaattactctgccaggctcagtagctcacacccatagttctagcactttgagaggccaaggctggtggatcacttgagcacaggagttcaagacagcctggaaaacaaggcaaaactccatttctacaaaatttcaaaaaattaggcatggtggcttttacctgtggtctcagctactcaggaggctgaggtgggaggatcacttgagcccaggagatcaaggctgcagtgagctgagattacaccattgcactccagcctgggtctcaaagagagacactgtctcaaacaacaacaacaaaaattactcagagtaccttgttttctgctctcagacatgtacctatttttcatttaaaaaaaagttgaattcagccaggcacggtggctcacgcctgtaatcccagcactttgggaggccgaggcaggtggatcacctgaggttaggagttcgagactggcctggccaacgtggtgaaaccccatctctactaaaaacccaaaaattagtggcgtggtggcacgcatctataatcccagctactcaggagcctgaggcaggagaatcttttgaacccgggaggtgtaggttgcagtgactggagattgcaccactgcactccagcctgggcaggaagagtaaaactccttctccaaaaaaaaaaaaaaaaaaaagttgaattgtgttttattcattttattttcatttttgaaatagaggctcactctgtcgcccaagctggagcttaatggcatgatatcagctcactgcaaaatctgcgtcccaggttcaagccattctcctgcttcagcctcctgagtagttgggattacaggcatgtgccaccacacttggctaattatatttatttatttatttatttttgagacggagtcttgctctgtcgcccaggctggagtgcagtggcgtgatctcaattcactgcaacctccacctcccgggttcaagcgattcttctgcctcagtctcccgagtagctgggactacaggtgcccgccaccacacctggctaatttttgtatttttagtagggacagggtttcaccattttggccagactggtctcgaactcctgaccttgtgatctgcctgccttggcttcccaaagtgctgggattacaggcgtgagccactgcgcccggcctgtatttatttattttaattttttttttttcagacagagttttgctcttgttgcccaggctcgagtgcaatggagtgatctcagctcaccacaacatccacctccctggttcaagcaatttgcctgcctcagcctcctgagtagctgggatacaggagttcgccaccacacccggctaattttgtattttcagtagagacggggtttttccatattggtcaggctggtctcgaactcccaacctcaggtgatccttctgcctcggcctcccaaagtgctgggattacagtcgtgagccattgcggccagctgttatatttatttttaattaattaatttttttgagatgggtctttatcactcaggttggagcacagtggtgtgatcacatctcactgcagcctcgaccttttgggctcaaatggtcctcctggctggcgctgtggctcactcttgtaatcccagcactttggaaggctgaggtgggtggatcacctgaggtaaggagtttgagaccagcctggccaacatggtgaaaccccgtctctactagaaatacaaaacttagctaggcatgatggtacatgcttgtcttcccagctactcaggaggctgaggcaggagaatcacttgaacacaggccacgtaggttgcagtgagctgagatcatgccactgcgttccagtctgggcgataagagtgagaccctgtctcaaaaaaaaacccccaaaaaacaaaaagcaagctcctccgtcagtctcttgagtagctgggacctacaggcaggtgccaccacacctgggcaagctcctccgtcagtctcttgagtagctgggacctacaggcaggtgccaccacacctgggcaagctcctccgtcagtctcttgagtagctgggacctacaggcaggtgccaccacacctgggcaagctcctccgtcagtctcttgagtagctgggacctacaggcaggtgccaccacacctgggcaagctcctccgtcagtctcttgagtagctgggacctacaggcaggtgccaccacacctgggcaagctcctccgtcagtctcttgagtagctgggacctgcaggccggtgccaccgcacctgggcaagctcctccgtcagtctcttgagtagctgggacctgcaggcaggtgccaccgcacctgggcaagctcctccgtcagtctcttgagtagctgggacctgcaggcaggtgccaccgcacctgggcaagctcctccgtcagtctcttgagtagctgggacctgcaggcaggtgccaccgcacctgggcaagctcctccatcagtctcttgagtagctgggacctgcaggcaggtgccaccgcacctgggcaagctcctccgtcagtctcttgagtagctgggacctacaggcaggtgccaccacatctaggtaagttttgtatttttggtagagacaaatttcactttgttggccaggctggtcttgagctcctgggttcaagcgatccacccaccgaggcctccgaaagtactgggattacaggcgtgagtcaccgcgcccagcctgaattgtgttttataagtaatgtctctgcttagagacagttgggacttcaggcgtcagacccctccctccacactgccctctccagggccttgcagcagtgaggtgtggggcgttcgcagttcccctcccagcttgtgcccgctgactgctggcgcactctctcctaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggtctgtaccccgccacgggcctcctggagaggccttgggatgtggcaccctgtggaggtgtctgatgggcagactggggtcttggaggagtgcgtgctggttagcatccattatgtgggggtggggcttggccctgcagtagctcctgaccttcctgggatgagcccacaccgtcctgcccgccttgcccgagcagtctccctgttccagctgactttcctgtcaggacgactgtggtttcaaatgttgctcaacatctttagctgtagagatagaaattatagaagtgaatgtctcggcagggttttggaacccgttcacctttgcagcacccctgaggaggccatgttctctccccacctgtcccccaccctcaggatttctgtagcccccgtatttcgagctagttggggccggagtagagggacgggcagagtctgggagaaggtcagatgaaggaggtgtccagtggctcacgtggacctgctttccgtgttgcccctgctactggaaagtccgctcagcacgctgaagtgtaattgtgaagcaaaaattaaattctcagccttcagccaactgatggaccccctctctcagcctcaggcgttgctcagtcaacctgaaaatgtagttcaggccatggttagggaggtcaggcaggcctcattgggcccctccctttggaactgaggcccagctgaccagcattcacattaaacagactctgacaaaggcggactttttatagcagcgacagcacaccacattccagcctgactctagtgtagcatcacatgacaggtggcaggccctgaaagaaatccgagtattttaccccaaaatagatttctttgacatttttcagaatggctctacaggactgtgtcttgtggggaaagtctgcaccctgtagagaatctcctcccttcccaggtcttttccctggtgcaggagggaattaactcggagtctggcaccttgtgaggtctgctgcctgctgcctggaggcctcatctgcttgataaagccttggtctccacagccccttatcttaagccgaggcattcctttctattgattccaagtctttagataataactctttcaaacaaacaactgccagtcagaagatcttcgcatctgctttgacctggaagcccgcccgtcccccgcttagagccgtcccatgtttcctgactgaagcagcatcttgcatgtagggttgatgtcttctgtctccccaagatgcataaacccggcccttgggcacatgctctcagggcttcctggggcggcatcacgggctgttagtcactcttatctggctcagaataaacctcttcaaatattttacagagcttaagtctttttgccaacataatatacccacaagtaagtgcccatgttgtaagtgcacagccagcaggtttttcaaactgaccattcccacggcccttttctcaggcaagaacaaaacactcccgcacccagggtcctcccaggcccctgacagcagccagctctccaccggccctgcatcttccttaagttcccccacacagggaggtccttcctgtgcctggcttcttccacttgctgttgcgcttgtggatttagccatttttttttttttgagacggagtctcgctctgtcgcccaggctggagtgcagtggtgcgatctcagctcactgcagcctccgcctcccaggttccagcgattctcctgcctcagcctcccgggtagctgggattacaggcgcccgccaccacgcccggctaatatttgtattttttagtagagacggggtttcaccatgttggtcaggctggtctccaacccctggcctcaggcgatccgcccgcctcggcctcccgaagtgctgggatgagaggtgtgagccaccgcgtctggccgtattcagccctatttttgtgcattgctgtaaactgttgacttttatgattctattgcgagagcgtgctgcgactctagagttgactctcctgtcggcggcagcgggtagttcactgtcgttggctttgagggtgaaactgctgtagggattccatgtctttgggagcatggtacggccctaagcaggatggtcatcgggagcacgtcccttcagccttgcaagttcctgcaggggctgcagggtcaccagcctccggcatctgtggctcctgggctccctgacctcagcagcatgtggccatgtctgctctcctgctcaccttgtggggggcatgcagagaccctgccacatgctttttacttgcgcttcccgggtgactaataaggcatgcaccttttgtcagggtgggagctcctctgcctgctcactgcttgcgggaggggtctgcagactttttctctagaagagttgcaggccacgcagcccccgtggcaactgctcagcccggctgttgtgctgcagaagcagccaaaggcacgtgggtcagtgagcgtggctgtgtcccagtgaaacaattttcagaaacaggctgcgcaggattggcaggacttggcctgcccctggtctgttgggtcctctgtctttttctcactgattataggagtcctttcgatatgagtcccttatggggtgtgggtatcacagatcctttttgctgctctgtgggtctccttttcaccttttgaggaacagatttttgtttctgtttttttgtcaagatggagtctagctctgtcgcccaggctggagtgcagtggcgccatcttggctgactgcaacctctgcctcccaggctcaagtgattctcctgcctcagcctcccaggtagctgggattacaggcacctgccatggcgcccagctaatttttgtagttttagtagagacagtgtttcaccatcttgcccaggctggtctcgaactcctgaccttgtgatccacccacgttggcctcccaaagtgctgggattacaggcatgagccacagcccctggccagaacagatgtttttaattttgctatagttgagcttatccatttttcttttatgtttattagcacttttgtgtcccacttgataaatctttgcttactacacagtcactatgatgtttacttacgctttcttttaaaagtgttattgttttaccttcatattcagatctgtgatcgctacataatttttttattttgttttgctttgttttgagacagtcttgctgtgtcacccaggctgcagtgcagtggcacaatcttgggtcactgcagtctctgcctcccagattcaagtgattctcttgccttagcctcctgattagctgggactactggcgcccgccaccatgcctggctaatttttttgtatttttggtagagatagggtttcgccatattggccaggttgacctcaaactgccagcctcaagtgatctgccctccttggcctcccaaaatgctgggattacaggcgagtattttctcactagtttttaagcagtataactcttggtggggcatgcctgtaattccagccctttggggggccgaggcaggtggatcatgaggtcaggagtttgagaccagcctggccaacttggtaaaaccccgtctctactaaaaatacaaaaactagctgggcctggtggcacgcacctgtaatcccagctactcgggaggctgaggcaggagaatcgcttgaacccagagaggcagagtttgcagtgagccgagatggcaccactgcatttcagcctgggcgacagagcgagactctatctcaaaaatgaaaacaaaagtataactcttttgggggacacacattttgaacagctcatttgtggctggatctaactgctagctagcgcggctcatcttctgtggaccgtggaaagcacgttgggcgtctgggtgcagaccgtccggttcatacagtctctgccgtgtggcctgggcctcttggtcctcagtgtgacgttgcatgtgggccttctctgttcccgtcaagcatcaggaagaagtgtcctgaggagaggaggagatggggtggtgaggggtgctgagcccctcgtcattgcttctgagggagtagcaggtttcaccatggtggcccggggaggcggggaagggcctgctggccgatggaccagtgtgtgttttcctctcgctgattctcctcccctcagagggcagttttctgtcacagtatctgagcctgttggtaaaacaagcacccaatcataagaaacagaaaataaggtcttcctgtaacgtagcctaattttagatggcggctgtggaagggagccacacctccctgtcactgtgtaggaaggaaggggctgatgcagacaggcagcgccaagttgaagaccctattgggaggccatgaagtggcacaggcctcctggttttggtttctttttttttttttttttgagacggaatctggctctgtcgcccaggctggagtgcagtggcgcgatctcggctcactgccatctccgcctcccaggttcacaccattctcctgtctcagcctcccgagtagctgggactacaggcacccgccaccacccccaggtaattttttgtatttttagtagagacagggtttcaccgtgttagccaggatggtctcgatctcctgatctgcccgcctcggcctcccaaagtgctgggattacaggtgtgagccaccgcccccggccctggtttaagcctgcgtgtttgaggccatgggattcatcctgagctgtcccagcagtggtgcgtggtgggcatttctgcgggtgtgaaattggaactcctcacggctgagcacagtgggtccgggcggagcagagcgcgcggtcctcctgactctgcccccttctcctgggcacgaggagtcgcctcactctgccaggcccctttctttcctggagtggagcagcgccgggcctgcacagaaggttctcccgaggactcctgcgggagggtgggagtggggaccgctagggcacaggagccgctgaaggcacagctgtttcacatggcccccggccgctgtgttttccagaacttggctgtggaggagtcactcccttcagaaggagggtgggtatttggaagccccttcctttccctgtcgcagctgctgttacgttttagcttaaagtagagtttgaacggcgccccccagtggttgtgtgaggacagcagctccctagggaagaggcagaggtgcttgaacccagatgctgctttgtgtcgacctgtgctgtcctgtgtggggctgcggaacttgtgacgtgggagggcacacgagtgaggagtgtgaagaggctggaggttttgaaatgactgcgtgttgggctaagtaaaattttttgttaaaatatattcgggccaggcgtggtggctcacgcctgtaatcccaacactttgggaggccgaggtgggtggatcacgaggtcaggagatcgagaccatcctggctaacacggtgaaaccccgtctctactaaaaatacaaaaaattagccgggcgtggtggcgggcgcctgtagtcccagctactcgggaggtggaggcaggagaatgacgtgaacccgggaggcggagctggcagtgagccgatattgcacgactgcactccagcctgggcgatagagccagactctgtctcaaaaaaaaaggtaaagaaacagatttatttatttattttttttttttgagacagggccttgctctgtcacccaggctggagtgtagtggcatcatcactgctcactgcagccttggcctcccaggctcaagcgatcttcccacttcagcctcccgagtacctgggactacagtcgtgcgcatccatgcctgggtgatttaaaaatgttttttgcagttgaggcctccccctgttgcccaggctggtctcaaactcctgagctcaagccatctgctcgccttggcctcccaaagtgctgggattacatgtgtgagccaccgcatccagcccactttttttttttttttaaacgtggctcccaggactcacgtgtggcttgtagcacaccctatggaaagcaccttccacaccctcagctcgggggtgccctggccttcagtcagaagacatcatttctgttttactttgcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccaggtaatgacgccttgttccagcacaccctcctccctcttcttcccgtggttagtagtgggaagtttccctttttggttcgtgcattggtgagagaacttgctttccttgacgtcatgtgattaagtaaaccatattcaaacattttaaatttatacctggatttatgaaagttgggagaagtccctcttctccagccacatccccagatcactctacatttctgaggcttcagcaaaatcctgtggcacagagctgtgtttgcacacttggcttgcgggctcctttgctgtgggccgtggatcacatggtggtctgtgcaggcttttgagggaggcctcatgatcataagtgagtcttcagattcatttccttataaatatctgacatccccaaactggaaagctgtgactctgaataaatagaagcacaacacgcagtgggcgagatgcccactcacaaatgtccagagtcactctagggagtccagagtcctcttggcttggatccgaacatgggggtctgggtacgtacttctgagggctaggggctcccacgtgggagtcagtccctctaggacgctcctgacttcagggagaccctgggctggccgatggggttgttacttcaatcccttctcccctttgctactaggttgtcgtccatctttgccagcagtcaaggccgagcctctttaagcagccacaagagtcttcccttgcctgctgcccgcccgctgttactgaggcccagggaacctgggtggagggcggtgcaggaggggctgagcagctcgtctgcccatagggtccccctccttttgtttcccatgtgccctccttgaagccgcccgtcagccctgggtgtggggaccctgcacggatatcctgtgtgctctggtcccggcgagcgtcctgggagagctgtgcatgagtgaggcatcacagacggtcctcagaggcagtgtgcttgtcttaggcactttcctctcccagcgcgtggtggtgtcaagacaagggccagaggactggggcgtttctaaacttgggtctctgtgcttggtaatcacctcttcctacgtgtttagtttgtccctgtctcctgttcagtgttttcattgttacctgtttgaagtgtaatgtctatgctacattgtatgtttcacttttcacctttctttacttgagcttccaaatggtttcccacagcatgtgggtcccagcgcccgcgatgaggctgcctttgctcctttgccttcgcgtcgcagacgcagcacccctgccagtggcccagaagcccttggaggtgaagtcacagggaggttagctagcaccaccacaaaatctaacactgagtttcgacaggtcggtctttttgggggttttttgagacaggatctcactttattgcccaggctggagtggtgcaatcatggctcactgcagcctccacctccctcagcttcctgagtagctgggactacaggtatgagctactacgccgggctaattttgtattttttgtagagacgggttcaccatgttgcccaggctggtctcaaacgcctgagctcaagcgatccacccaaagtgctggaattagaagcaggagccaccatgcccggctttaacgcacatcttaaaaaatcacaaaactattgtagatttatcattcatgcatagtttttgctagaggtggtttttggagtaatcataaatatagtacagtaagtacaagtttacccggagacatggttcgctatcacattgatgtgtttttggcaaaagagaaagcagtatggttttttaccttcttgttaaagaagggcttttgctttgcaaggaggctctcaggctgcccctgctttcttctgggcacccgacccagaggagcaggtgtgtgcagggccccctgaggctcgagctggtgcctgtcctgggctcctggaggcagctgagggatgtgggctcactgcggtctaaaggcaagagccagaacattgcacagctcattctctctccacgtgcttttgttccacaccatgtcctgtcctgttcccctcggcccctcgtgcggagtcacagatgaccacacgggtcctcatcctctcctgaacggatgcttctgtctctctagcactgaccctcttgccgcaaagctgcacagcatcctcactgatgaggcgtttgagttttactgtagccagtgccacaaacaaatcaaccgccttgaggatctttctgcccgcctgagtgatcttgaaatgaataggtaactgaccagcgcctggccttgctgtctgttcccagggtgtgggggactccggatacccacagcccccttgagggcctgccccgaggcgaccaggagcctctcaggcagcgggactctccctggggccccgcctcccaccctgcacgctgtggggccaccagggccctgcctcctcccctgcatgcgcagcccaggccagtgcttgtcttggtgggaggaagtgatcggtctttgcaagctgtgctgtctgtcctgtgtgtgaaagaggatactttctgcattttactaaaagatttctttcattgagctcatgagacagaattgggaaagttaaagatttagtctttaagaacagatatgtaaacagctttcaggattgtcagtttaaatggagttttgaatactcacagtgagcgtgtgagggagctcactgtgtctcagcaggggagctcttgtggctggccctcatgtctaactcccagttacagaagacggttttgagtgctttgcacatattgacgtgcccgttgggcatcgtgttgatttcgcttgcggtgaagcccctgggtgggcagctctccagaagggtctggtgaagaaacgggccactttggagctttccacagcagccctagcctagcagaagaggtgagtgagcatacaggctcatgctggcaatctgggacggcttcctgaagaacgggacctggcctgtggggagggtttgtaaaggtggcagaaaggtgagttatcctgacggttctagcatgtttagaggtatctgtgaaactgcttacctgtcttgagcctgccctgtccctgccccagggggcttctgccgaggcacatccttgctggcgggcgctcactgcccacggccttattgaggcttctgtcctgcctctagttccatttccagggcacttaactcttcttatgttctgtgaaatgctgtgaagcacagggcccccagccagtgcccattcaggtggagaggatgggggtggggcccggcactgatggccattctggagcatcgggggtcttggcagcactggtgagaaagcagaagtgctctttgaagagggtcttcccgggagacccgaggccgcccagagccctccccgggagacccgaggccgcccagggccctccccgggagacccgaggccgcccagggcccttcccggggagacccgaggccgcccagggccctcccgggagacccgaggccgcccagggccctcccgggagacccgaggccgtccagaatcttggattccaaagatccgctaacctctgttttaggggaaatcagtttctgcctgcgtgtgtgttcagctaggggttcaaggcccggcgacgatggctcagcctgcttggggaggggccatttgttcttcccacgcagagacttgccctcccactcaccgataagttgagtgcaagcatgtcatctccgtacatgaaagtaagcctgaagactcaggtctcgtctctcattttctgaagatttttgacatagaactgattttttcccacattgagaactagctccaagatggccatggtcgcctctgctgggctttgtgggggcagagaagggactaggatgtagctaagtacaactagcaagtcctgtggagcctcacgtccaggttctgctaccccttttcctaagactctatgaagcgggccaggcgcagtgactcacgcctgtaatctcagcattttgggaggctgaggaggcaggcagatcacttgaggccaggagtttgagaccagcctggccaacatggcgaaaccctgtctctactaaaaacataaaaattagccaggcatggtggcacatgcctgtagttccagctacttgggaggctgagatgggaggttcacttgaacccaggaggtggaggctgtggtgagccaacatcctgccactgcactccagcctgggcaacagagccaaactctgactccaaaaaaaaaaaaaaaaaaaagactctaccaagtggttaatatgctattcaattcaacacaatcaggacacacaactgccagtcagaacatcctccccataacccttagtggaggagatctgaatcttgcgttttagtttccatggacttgcctgaaagtaagcttatttggtcatgctttgtgggtggcaacaggtgacttagtccagaccacctctggaagctttgatgtcagatacgatgtccagtcgcctcagaacaggccaatagctgttgcattttccaggtaccctgcagcctctaaatacatttcattttgtaggaactaagaagtgtgccttacctggaggtatattttcttttttcttttttttgagacagagtctcgctttgtgacccaggccggagtgcagtggtgcgatctcggctcactgcaacctctgcctcccgggttcactccattctcctgcctcagcctcccgagtagctgggactacaggcgcccatcaccacacctggctaacttttgtatttttagtagacacggggtttcaccatgtctcaatctccggacctcgtgatccgcccgccttgaccccccaaagtgctgggattacaggctgagccactgcacccagcctgcctggaggtatattatctttttcttttttgagacagagtctcgatctgtcacccaggctggagtgcggtggtgcgatctcggctcactgcaacctctgcctcccgggttcactccattctcctgcctcagcctcccgagtagctgggactacaggcgcccatcaccacacctggctaacttttgtatttttagtagacacagggtttcaccatgtctcaatctccggacctcgtgatccgcccgcctcggcctcccaaagtgctgggattacaggtgtgagccaccgcacctggccacctggaggtgtattttcaattataaatcctgttgctgggctgccagtccaggccctgaaaggtcagtaggtaaactgaacgatgagtctgtcctgtcctattagttctagggagtctcaacaataataagataaaattaaatttgtattaaggctgggtgcggtggctcatgcccgtaatcccagcactttgcgaggctgaggtgggcagatcacgaggtcaggagatcgagaccatcctggctaacacggtgaaaccccatctctactaaaaatataaaaaattagccgggcgtggtggcgggcgcctgtagtcccagctactcgggaggctgaggccggagaatggcgtgaacccgggaggtggaacttgcagtgagccgagatcatgccactgcactccagcctgggtgacacagtgagactccatcttaaaaaaaaaaacctgtattaaaatatacattattagtctccagtcgagaaaggagagccacacagtaatttgaacagggacagtttaatactacaaagaatgggctgagtgtgggctgaaatcgcagtgctttgggaggctgaggtgggaggatcacatgagccggggaggtcgaggctgcagaggtgggaggatcacatgagcctgggaggtcgaggctgcagaggtgggaggatcacatgagccggggaggtcgaggctgcagaggtgggaggatcacatgagccggggaggtcgaggctgctgaggtgggaggatcacatgagccggggaggtcgaggctgctgaggtgggaggatcacatgagccggggaggtcgaggctgcagaggtgggaggatcacatgagccggggaggtcgaggctgcagcgagctgtggttgcaccactgcacttcagcctgggccacagagtcataccttgcctctaagaaaagataatgcaaacaaacaaacaaaaaatttaaaaaatcattagggaaaggaaaagaatgtcacaggctatgggagtaatgaggcactggttgggatgagtaaaaagaactctgcagagtgtagggacagcaggcacaggagcagccgccacccagggccggggcagagccccccagctacagtcactgccacccagggctgaggtctgcaccagctgcaaacggcgtggtggggacaccaccgtgctgtcagggcttgtggggaacctgcctcctggctgccaggaaagctattctgttgcaggacacttggcagaggcacccctagagaacagctacccgaatggggtcggggaagcccctggctctggctacagtgggcaggatgctccctggagtaggtactggggagactgcaggtgtcggagggccctgcagagagtggtcagaaccaggaggcaaacctcttcctgctgtgttcactcctcggctccctctgctgatgacacgcagcattgtggaggaagagcctgctaagggcccagctctgtttctacagggcaagtaaaaaggatggacttagagctgaggggctctacgttaatacctggcacagcagctgattctcctccagtagatttctttttttctttgagacagagtttcactctttgttgcccaggctggagtgcagtggcgtgatctcggctgactgcaacctctgcctcccgggttcaagcgagtctcctgtcccagcctcccgagtagctgggattacaggcatgcgccaccattcccggttatttttgaatttttagtagagacagggtttctccacgttggccaggctggtctcgaactcccgacctctggagatccacccgcctcagcctcccaaagtgctcagattgtaggcatgagccaccacgcccggcccctccagtagacttttctgcctgaccctggaaagaaaatcagaggtgtttttgagacaggtaagctgaagagagacgtggctttgtgagttccaggaccgtgatggttcccaggccccaggggtgagggtgtcttcctgcaggctgaggctaatagttcagcagctagactgtaaaatacaactttggacctcagaaatgagggagaaggtaagtttggcccatgtgccactgcagatggttaaatcagacagctgatgtataattggctatatttactgccctgaaatggcaacgggaaaggtttccaaactgatgcctaggcaggcgttctgagcatgatgcatcagtgcctgagtcgaagccagcggcaaactctcctgtcacagcggggcctgggtcacttttcacttgggggcctccgaaggccaagcgtttgggggtaatttggcttcagaagcattgggacagtgcagccagcgggtgggaccaggtgtggcgctggcctctcagtcgtggtctggggtggctgcatctggaagcctctttgggggctggagtaacgagacgtatgcggcctcaccccagcactgccgtgtccttgctgttttgctgagtgagcatttgtgcatggacttgcctggggggccctgcatgccgggagcattgctgaaaggccgcccacctcgtatctccacagcctgagtttcctgcttcctcctgctcctctctgtctgttctaacaattttcctgtttattttgttttctgcacagtccgacaaagcggctctccagcaagaaggtggcaaggtaggtgggtctctggttcctgctgaaaaacgttctgaagtggataattaatcatagttttttaaaaaacattttaaaatgttcttttccaaggtattttttaaactcttgcaagttactttacatggtttggggctgaaggtatcctgaaggagtgttgggaaaggggtttccagggctgtgaatttggacctggatttgtgaccagggagggtacgtgtcagagcttttggtgctgggcctcttgtgtgttcactaaggtctggaaggggccgccatccccagatgtctgctctatgttagctctgaggtagcgagacccagtgaggagcctggcttctcagagccgggtctgggcagctccccaaggtgagtcgaaggtgagggatgggtctgactccaattcctaaagaccatttcttcattttccagcttcgtatagatctgttggcttcctgctgtgaaagatggcaacatacacttttatcttcctcccctgccagttcttaccgaaataaacatgcagggttaaggcccttcccagggagccactcagtgtggctgccgggtggcctctgctgccgtcagagtctgcctttgtgtctttatctgctttgccttcctagtccccgtcctgcttcgtggcccggcatctggcagggctgggagacgcctctccagcttcctctggagcatcccctctggagcctcctctctgccctgttgtgccgggcgttctccaggcctcgtggctgtggtcctggacaggtctccccacactggtgggttcctttgtttcgggggttggatcctctagctccctggccccgtcttccttctcatttgttttctctggtttttgtccagcgtatcttcctgtagcttcttgagaaaagaggtgctcaggagataaacttgagcttgggttggtttgtactgtgagagtgggatcattttcctgtaagatttttgacggcattgcttatcttctagagctaaagttgttaccatgaagtttaacctttctgactcggtttctttgggaccagcctgagcaacttagtgaaaccctgtctctacaaaaaaaaaaaaaaaattaaaaattaaaaattaaaaaaaaaaaaggaaaataggcaaggtctagctgcgttgcccaggctgtagtgcagtgagtggcaattcataggtgcaagcatagctcacaacagccccagactccctgggcttaagtaatctttccacctcagcctcccaaaattctcggattacagaggtaagccaccacacccagccaagaacagaaaccttttgttttccattttcttttattttgagacattgtcttgctctgtcacctgggctgaagtaccgtggtgcaatcacagctcactgcagcctggacctctcaggctcactccatcctcccacctcctcctcctgaggacctgggactacaggtgcgcattgccaatgcctggctagtcttttaatttttaatagagatggagtttcactacgttgcccagactgatcttgagctcctgggctgaagggatcctcccaccttggcctcccaaagtactgggatcacaggcatgagccgtcacacctggccatggatgaaaacttttttctttttgtttctcttctcttttcttggctttcttttctttttgagacagtcttgctctgtcttgctctgtgaagtgacatcatcacagctctcaatagttttcacttcccagacctcccaagctcaaatgatcctccctcctcagcctcccgagcagctgagaccacaggcgcatgccaccatacccagatgattttttaattttttgtagagacaggcccagactggtcttgaactcctgggctctagcagtcctcccacctcggtctcccagaatgttggaattacaggcaggagccaccgcgtcccacttgttttccattttctgtcattttaggggctaggggctaggggctagaggaagcagaggtgaacgtcatcatgcatctttttctaactgtcttcttgctcacccctttcagaaaagcattgagctggccgggcgtagtaggtcacgcctgtaatcccagcactttgggaggctgaggtgggtggatcacctgaggttgggagttcaagaccagcctggccaaaatggagaaaccccatctctactaaaaaaatacaagattagccaggtgtgttagcaggtgcctgtaatcccagctactcaggagactgaggcaggagaatcacctgaaccctggaggcggagcttggagtgagccgagattgtgccattgtactccagcctgggcaacaagagcgagactccatctcaaaaaaagaaagaaaaagagaagcattgagctcttaggaacgtgacgtgcatccccagctacacttctgttaccacttcagcatcaccttcctccccgcttcatcaagtcttttactccagacaggctgcagctggtgacatgaaagaccggtcaaggccagctaaggcatctgcttgaggcctcccgtgcctaggatggggcgcagcctgcagttggctgtcacagccttgtgtcagaaacaccctttaaaatttaatgtttccttcacgggtaccctttggcataaaaaaagcccaatctgagccggacgcagtggctcacgcctgtaatcccagcacattgggaagccaaggtgggtggatcacgaggtcaggagttcaagaacagcctgaccaacatggtgaaaccccgtctctactaaaaatacaaaaattagttaggcatggtggcacacatgcctgtaatcccagctactcaggagcctgaggtaggagaactgcttgaacccagaaggcagaggttacagtgagcccagatcacgccactgcactctagcctgggcgacagagcaagactgtctcaaaaaaaaaaaaaaaaaaaaaagctccatctgcagttatctgtcgttagagtttacaaaacagagacctcttctgcagtgtgtctatccacatgtaaatatatgtacacaagatttaatctgttgttttgccccaaatctgccacaagaggctaaggaagagcaaaataaacgtcgcgattcgcttctcacagttctcagcccttcgcgctgaactattgctgagatggtgggttttgccagcagccattgtagcccccgggcctggctgcattgctcacctccctcagccttgttctgtccctgtccatgagatggaagtggctttctccagtcagctgtgtgtgcagagaccgggggctccgggcagagccgagtccatcaggactggaggaagtgctcacagcaggcaggctccctgggccctgggtgggaggcctcagggatccccgtacctccttgctcaccagccaggctcgacctactgccctgtggggcaggtcaggctttttccacagctccctctctgggaggagggtccttccaagtgagggtgtggtgtagctggagaatccctctttctaggggatttaaataagcagccccagccggacgcggtggttcacgcctgtactcccagcactttggggggccgaggcgcacagatcacgaggtcaggagtttgagaccagcctggccaacatagtgaaaccccatctctactaaaaaaaacaatacaaaaagttagctgggcatggtggcaggtgcctgtaatcccagctacctgggaggctgaggcaggagaatggcttgaacccggaaggcagaggttgcagtgagctgagattgcaccactgcactccagcccaggtgacagtgcaagactctgtcgcaaaaaaaaaaaaaaaaaaaaaaaaaaaaattaaataagtaaataaataagcagccgcatgacccatgctgaggaccctctgcctcacgttggtggccacgtgtggtggctgcacgctgggtgcctggggatggctgtgtccccgagtcagccccagaagtgcctacgcctctaggacagctcagaagtgctgacaggtcgtggcctctcaggatgggctctgggttgcagcttcatgcctggagtggctcatgtttgggggcaaggtcatgggcgtttaagagcagcgactggccaagaacatgatctgtatcagcagcagcttttgagaatctgatgaaatccccagagccccagaagggcaccggtgtgttccagctggtgcacgttcacagggcttgtctcctcagagcgtttatggggaaaaagatggaaatgttcaagcccagtccgtactgagaagcaaatcgaacttcatacacttggtagacattttcagtggaaaaatattaacattttatggaattcttactctgctacgtccctagccaagctgtttgtatgcatgaccttggttaaacctcagttgcctctagacccccatttcataggcaaggaagctgggagagggtccccccatttcataggcaaggaaactcggagagggtccccccatttcataggcaaggaagctcggagagggtctcccatttcataggcaaggaagctgggagagggtccccccatttcataggcaaggaagctcggagaggatccccccatttcataggcaaggaagctgggagagggtccccccatttcataggcaaggaagctcggagagggtcccccatttcacaggcaaggaagctgggagagggtcccccatttcataggcaaggaagctgggagagggtccccccatttcacaggcaaggaagctgggagagggtccccccatttcacagacaagttcagagaggctccccccatttcataggcagggaagctgggagagggtccccccatttcacagacaagttcggagaaggtcccccatttcataggcaaggaagctgggagagggtccccccatttcacaggcaaggaagttcagagagggtccccccatttcacagacaaggaagttcggagaggatcccccatttcataggcaaggaagctgggagatggtccccccattttataggcaaggagtctgggagagtgtccccccatttcataggcaaggaggctgggagagggtccccccatttcataggcaaggaggctgggagagggtccccccatttcataggcaaggaagctcggagagggccagtgctttttaacggtcacgcagttctgagcatcaggctgtcagcctggagcctggcttggtactgaggttcccaggatgtataaagaactgaacacgcacctttgctgttggctcttctgtgcgagtgctctgagagttttctgtactcccggcaagtttgggttggtacagattcaccacagcgaatctgaccacgtggtgaccacaagcacgcgcttactgcgcgcctaagttcacactccctggagaagctcctgccccaaggccgcagcctatgggcctttgcgtctactcaggaccatgaggctgtgtccccgagcctggcccgggtagtaactggcatggcctgcggtgctgggggcgtgtccacaggagctggtgccacagaggacacgtgtgtctgctgtcttcctggactcggtcggaccagtttcccagtgtgtccgtgagggtgacactgagtgagacttctgggatccacacctttcctgggaccctcactcttcctgccacagaaagcacctgtgaaagtctgagatcaagaatgtgcacaggggaggtgtctgcaggtcaaggtcctgagctgatgtctcacaggcctctggtagagacgagattgttcgtgtctctgcgaagaagggcatgttttattgcagccaagtacaaagtcctctctgccactcgctggctgggactgaggtcatgttctgtcaggttccaaagagcgccaggaagactctgagaccacagagcacggcctgctttctcccagcccctggtaaagatgtccagcctgggacctccccctgtatatagtgctttaagtgggagaagaccaccacccagatcaggggaggacctgtcccctgcaatgctgctgcctgcttttcagattgacttgggagtgcttgtgctgacggagcatgtcctgtggtttttccctttcttccctctgttgttgtgccttttctgtaggtacctgcaccagtcaggggccctgaccatggaggccctggaggacccttcccccgagctcatggagggcccagaggaggacattgctgacaaggtaggccctggagggctgggtaggtggcaagtaggggatttagaacacagccacgcctaagggccgctgcagacaccccgggaggtggggacagcacagccggaggtgaccccatgtcctccagggctccccagactgtccatccagccccgatgctctttggcaggtttccccaaggggtctcgtggccatgtgagaaaaaggagtcttcctgttgtgcacgaagggccagctgggaggagtggactgggcagtgagtgagcaccctcgggtatcccacccccactgtgtctgagtcgggctgggggacacccagacattcagtccaccaggcccatggagacgcgacctggggcacccatgatttgggagaaaagggctggccctgcagttactgcagagccaacagcctgaggaacgggcttctcctggggccttgaatggaatgggtgacagcagccagggcaaggcagccttgccgtggtcaagacccgcttttcagccagatgtggtggctcacgcctggaatcccagcacattaggaggcctaggcgggcagatcacttgaggtcaggagtttgagatcagcctggccaacatagtgaaaacccgtctctactaaaaatacaaaagttagccacgcatggtggcgggcaactgtaatcccagctatttgggaggctgaggcaggagaatcacttgaacctgggaggtggaggttgcagtgagccgagattgcacgactgcactccagcctgggcgacagagggagactccgtctcaccttctgcaccccctcaccttctgtgaccccttcacttactcctgtaccccctcaattcctcctgtacccctcatctcctcctgtaccccctcaccacctcctgtaccccctcaccacctcctgtaccccctcactacctcctgtaccccctcactacctcctgtaccccctcacctcctcctgtaccccctcacctccttgtgtaccccctcacctcctgtaccccctcacctcctcctgtacccccccacctcctcctgtaccccctcacctcctcttgcactcccatctcctcctgtaccccctcacctccttgtgcaccccctcacctcctgtaccccctcacctcctcctgtaccccctcacctcctcctgtaccccctcacctcctcctgtacccccctcacctcctcctgtaccccctcacctcctcctgcactcccatctcctcctgtacccccttacctccttgtgcacccctcacctcctgtaccccctcacctcctcctgtacccccctcacctcttcctgcactcccatctcctcctgtaccccctcacctccttgtgcacccctcacctcctgtaccccctcacctcctcctgtacccccctcacctcttcctgtaccccctcacctcctcctgcactcccatctcctcctgtaccccctcacctccttgtgcacccctcacctcctgtaccccctcacctcctcctgtacccccctcacctcttcctgtacccttcacttcctcctgtaccccctcacctcctcctgcaccccccttacctcctgtaccccctcacctcctcctgtaccgcctcacctcctcctataccccctcacctcctcctataccccctcacctcttcctgcaccctcctcacctcctcctgcacccccatctcctcctgtacccccctcacctcctgtaccccctcatctcctgtacccccttacctcctcctgcacccctcacctcctgtaccccctcacctcctcctgctcccccacctcctcctatacccccatctcctcctgtactctctcacctcctcctgtacctcctcacctcctcctgtacttcacctcctcttgcatccccaccacctcctccctacaacttctctagcatctcaagtctgctgacccaggccaagtcctcctctgctcccttcactccttctcctacctccgcaggtgtctgattctcatcttggtgtgaactctctgagggagggaccgagacatggatctgtctgtcccttgcatccatgggcacctgggctgcctctgtgagctgcatctggctgagcagagacccaactgtgtgttggggggctgagtcttgctgcccaccagccagccagtccaaaggcacccctgggccccgagccctcagagctgcggcactgtgtgcatttgtgggtcgaatgacagtgctccccaagaccccggccccattaggagctgcacctttgtgggtttatgggacaagttggatccaacaccagcctagctaggtggatctgattctgtgctgagaaaatccccaggcggcctcccaggttgttcccttgggggtgcaggcccttctgcttctggctgcctgaccctgaagcctggtctcattgccaaggttgtcttcctggaaaggcgtgtgctggagctggaaaaggacacggcagccaccggtgagcaacacagccgcctgaggcaggagaacctgcagctggtgcacaggtgagcctgggccaggagacccgggcctctgcgtggcgcctcctgtgcccgcctgtcagcccccatttacttctctttacctcacacagcaggggcttggccacccgtccatccccgttggaagccggctgagggggtggtgccaggtggtcatctgagcctacccagtgggctgcaggcaggcgacccgaggctctgactggtgctctcatggaaccctagacacacagagggccagaggagggcactgcctccctctcgggagcgctgagacctgacccacacagaggaggaactgactgcgaacccacgcagtgctcagcctcaccagcaggcctggaggtgcagctctcccaccactctggtccatacggggtttgcccgtcctggaagaatgcaggttagagaagtcgctcagcagcagaaagcgaaatgagcagtgactgctgagtacgcgacaggacgcgcagtctcatcgctgtgggcaggagtgctggggaggaagcgaagtgtgacgccgtgtttgcagagaaagagtgggagctgcttgcctcactctggtttgcagacttttcttagaataccgtgtaattctcggtgtttttcacacgaggcacgccatgttgtctcatagccgatttgcaggactgtttccggtgcaaagtaagatgagcttgtcccaggagtcagctacccaggctatgacacctgtagctgggcaccggcagcctcttgtgggcagaggaggcagccaggaggcctatgaggcacctgtgggatctgcagaagaggttcttcctgtgagcttctgtccctgcccagctgcgcgggcacatcccggctcttccacatattctcagctcggccaagggccctgtcccttgaagcttcagtgtcttcatcaccactgagcaggtagattcagggctctgagcagcctgcacacacgtgtgttggcagcagggcatttgtggtcagcatccccaaagcccccaagccctcaccctcacggtactaacatttgtgaccatctgccctgtgagcgctgagaattggaatgcctcatgggattgtgggcataacttgcacatcattttaattctaacaaagcaaagcatgtgctcttgtggagtgaagaccctgggcttggcggctgcccgttctccaggattctcagcagaagagggcctgctaccagcccctgctgcagagtggagaggggccaggcatgctggtgaaggggctggactcccgtagtgcgctacacataagcagtgccaccaaagaccactgtctcctccttgtcaaggagaatccggggggctgccagatgcacttgttttgttttgttttttgagagacagggcctcgctctgttgctcaggctgagtgctgactacagcctccacctcccaggctcaagcgacccgcctccctcagccttcgatgtagctgggactacaggtgtgcaccaccacacccagcttttttttttttttttttgagacggggtctctctctgtctccaggctggagtgcagtggcgcaatcttggctcaccgcaacctccgcatcccaggttcaagcgattcttctgcctcagcctcctgagtagctgggacttgcaggcatgcaccaccacgctgggctaatttttgtatttttagtagagacggggtttcaccatattgaccaggctggtcttgaactcctgaccttgtgatctgcctgcctcagcctcccaaaatgctgggattacaggcgtgagccaccgtgcccggcctagtttttaatttttttatagagatgaggtcttgccatgttgcccatgctggtctcaaacgcctggcctcaagcgatcctcccaccttggccccccaaagtgctgaaatcagaggcgtgagccaccatgtccagcctagatgcctttgtcgagttgactgtggaggtttcatttgagtctggagtatgttcatctgttttccgtgtgtgtggtgtgaagtccacactgccgcctggcaccacccactgaccgtctgcagtgcagccccggccacattcagttcctgtggctgttccctgtggtgctcacctccaacgtcctaaacaacacgtttcccgttttcagtatcatctgcccgttctgagccatttgctctctagccctaccatacagctgccatcctaagagtacgtttcccgttttcagtatcatctgcccgttctgagccatttgctctctagccctaccatacagctgccatcctaagagtacgtttcccgttttcagtatcatctgcccgttctgagccatttgctctctagctgtgccgtacagctgccatcctaggaattccgagtgctttctcctgtgtttgattccttattttctgggtcccacgttttcttctgttttgccaactcattttctgagtatgtcactgatagttgcctggaaaagggagcacaggagccagatgctctgagaactgcttgtgtggaagtgctttttcctcccaccctgctccagtccatagtgtagctgggcataaaattctaggtcagagatcgaattccctgagaatgtgaagacctctgacccggtgctgtgactgaggaacctctggtgccgcagggccttgatgttctctgtaacttctgtttcccaccctacatacttggaggaggatcttgtattatttgccgtgctgtgcacctggttttcagcctttatttcgttttgttttgttttgttttgttttttgagacagagccttgctgtgtcacccaggctggagtgcaatggcacaatctccgctcacggcaacctccgcctcccgggttcaagtgattctcctgcctcagcctcccaagtagctgggattacaggcatgcgccactgtgcccggctgatttttgtatttttagtagagacggggtttcaccatgttggccaggccggtgttgaactcctgacctcaagtgatccatctgcctcggcctcccaaagtgctgggattacaggcatgagccaccgcgcctggcctaggttttcagcctttaaatctggaaaacgcgtcctttcgctgtgggaagacttctgaagttatttcaccatgcggcctctccctctcatctgtctgaacatctgctagtcacacagtgggccttctggatgtttcctctccttttttaaactttcctcgtctctaattttatctttctgttctttttttctatgtaatattctcagttttctccttcaactcttgatcagatcttttttttttttttgagacagagtctcactctgttgcccaggctgtagtgcagtggtgtgatctctgctcagtgcaacctctgcctcctgggttcaaatgattctcgtgcttcagcctcccgagtagctgggactacaggcacctgccaccacatccggctaatttttgtatttttagtagattcagggtttcaccatattggtcaggctggtctcgaactcctgatctcaggtgatctgcccgcctctgcctcccagagtgctgggattacaggcgtgagcccggcatctcaatcggacttttaaattgtccttcccacgctttcagttcctgggagctgttccttgttgtttgtctcttctgcagcaggctgccctgacgctgcagctttggctctctgctcgcggaggccgctggctcggggacctttccctgctgtctgctgcatcatgtgtctccctgggtcctcacttggtgtttgctttggccacttcctgttgaaagctttcctgttgtgtctggtgatctttggccatctgttcactcctgcgtgtgaggcaccacaaggatgagaggctctgtgcgaggcagggccagagggcgtgggctgtgctgtgtcagtgggcagggcctgtgcccttctctttgggatggttcagtcctgtctcctgcggatggttgtgaagatctcaggaaggccagggtctccctgccctgtgggaatattccctttcccctgtggtctagctgacacctgccctgcctctgctctgaggtgacctggatgggactggtctctatacccacttccccagcctggaggggactgggagcagagtgggccccccccccacttgtggcccctcacagcctctggggcccggatgtgcccagctgccagagccagactcgtcctggctcccatgtggacctggcatctcaggaagcctcgtgagcacctttgggtgatgtgccatgaactgactgtactgcagctgaaggcagactccgccagcacactcagttctctggtgttcagctgccgcggaccacgtgctcatcagacactcacttcctggaaatgctgtggcccttgggccctggcacctccacgccccgtcccgaggccccgtgcctctgggctctgagcgcacgcgttgtgtgtagtggccctggcacctccacgccccgtcccgagtccccgtgcctctgggctctgagcgcactcgttgtgtgtagtggccctggcacctccacgccccgtcccgagtccccgtgcctctgggctctgagcgcacgcgttgtgtgtagtggccctggcacctccacgccccgtcccgaggctccgtgcctctgggctctgagcgcacgcgttgtgtgtagtggctgcaggtggagcagctgcatgaacacagagtgcaccaggagaagttacctggcgggctcaggccctctgagtgctgcggtccacaggccacaagcgggcagtgcctgtgggtatcagctgggcctaggtgcagtggacactgctccggccaccccaggtgcctttagtgtgggaggcgaggccatctgggggtgtattcgctgcttcagaactgccttgaccagagctcggggatgcccttctcggtgccctactcccgagtggaggcaggttctctggaggtcctgaggcagcttctgggcatgggtggagccactgcacaccctgcctggagacagctcagctcctccctttgcctttcaagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggtaggcggttcccaacagcccatccaccccagaacctgcaggccaggtaggagacggtccccaacagcccgccagccccagaaactgcaggccaggtaggcgaggttcccgacagcccgccaaccccagaacctgcaggccaggtaggagaagttccccgaaagtccgccaaccccagaacctgcaggccaggtaggagaagttccccgaaagtccgccaaccccagaacctgccggccaggtaggagaagttccccgacggcccgccaaccccagaacctgcaggccaggtaggagaagttccccgacggcccgccaaccccagaacctgcaggccaggtaggagaagttccccgacggcccgccaaccccagaacctgcaggccaggtaggagaggttcccgacggcccgcccaccccagaaactgcaggccaggcaggagaggttcccgacagcctgcccaccccagaaactgcaggccaggtaggagaggttcttgacagcccgcccaccccagaaactgcaggccaggcaggagaggttcctgacggcccgcccaccccagaaactgcaggccaggtaggagaggttcccgacagcccgccaaccccagaacctgcaggccaggtaggagaagttccccgacagtccgccaaccccagaacctgccggctaggtaggagaagttccccgacggcccgccaaccccagaacctgcaggccaggtaggagaagttccccgacggcccgccaaccccagaacctgcaggccaggtaggagaagttccccgacggcccgccaaccccagaacctgcaggccaggtaggagaggttcccgacggcccgcccaccccagaaactgcaggccaggcaggagaggttcccgacagcccgcccaccccagaaactgcaggccaggtaggagaggttcttgacagaccgcccaccccagaaactgcaggccaggcaggagaggttcctgacggcccgcccaccccagaaactgcaggccaggtaggagaggttcctgacggcccgccaaccccagaacctgcaggccaggtaggagtagttccctgatggcccgcccaccccagaacctgcaggccaggtaggagaagttccccgacggcccgcccaccccagaacctgcaggccaggtaggagaggttcctgacagcccacccaccccagaaactgcaggccaggcaggagaggttccgacagcccgcccaccccagaaccggcagtggctaggaataacctgaaagtttagaaaaaggggcaaagctatgtggagaagactttgaaactctcccaaagaccacaagggatcggttcaaagactgaccctgacgctgtgcgggtgctggtttctgtaaatccatgtctaaccaacgtatccagtctttttaaaataccaatcttttttttttgggtgggggtgggtgggtttgagatggagtcttgctctgtcgcccaggctggagtgcagtggcgcgatctcggctcactgcaagctctgcctcccgggttcacgccattctcccgcctcagcctcccgagtagctgggactacaggtgcctgccaccacgcccggctaattttttgtaattttagtagagacggggtttcaccgtgttagccaggatggtcttgatctcctgacctcgtgatccacctgcctcggcctcccaaagtgctggggttacaggcatgagccatcgcgcccggccttttttttttttttttttttttgagaccaagtgtcaccctgtcgcccaggctagagtgcagtggggcgatcttggctcaccacaacctctgtctcctgcgttcaagcaattctgttgcctcagcctccctggtagctggggctagaggctcacaccactgcacccagctattttttgtatttttagcagagacgggtttcaccatgttggccaggatagtcttgaactcctgacctcaggtaatccacccgcctcagcctcccaaagtgctgggattagaggtgtgagccactgcacccagccaaaaaatcattattttaaatagagacaggggttcttgctgtgtggcccaggctggtcttgaactcctgggctcaagcattcctcccacctcggcctcccaaagcgctgggattaccagcgtgagccactgtgcccgccgaggcacaagcattaaagcagcatggtgcctcccttggttctccatctgggagctcatgctgtggattcctggtgtgtgtttagaaatacatttgcaagggacggttattgattttctgtaaaagttaaaagcatcaggtaacttaaaatatctataatcagaggactctagagttctctatccttcttgtgtgtctgggtagtgagggtggaggaagttgttttatacagttgtttgtttgtttgtttgtctgttttgagatggggtcttgctctgtgcccctggctggagtgcagtggccctgtcatggctcactgcagccttgaactcccgggctcaagcaatcctcctgcctcagcccctgagttgctggggctccaagtgtgctctatcatacctggctaacttttcttttttggtagagacgaggtcttgctgtgttgcccaggctggtcttgagctcttagctttaagtgattctcccaccttggcctctttttgttgttgttgttgggattttttgttgttgttgtttttcctctccatactctcagcagaagcacctcagcctcttaaagtgctgggattatgggcatgagccacctcacgtggcttttttaaactgagcatgtactacttttagattttgaaatacagtagttttaaatattcataagaggatttcaggttcttttgcttgtgttccttccagctcttaaagctaagatacttgccttatctaagaagagctcctaggcattttcaaaactggtggcaggaaggggcctgcactgagagagctgtgcgggacgccccacacagggaggcctccgtgcctgccattgcagtggggcgccgtcttctggggagcaaggtcagggcagccaggacagtgttttccccgggccttggcacagtgcagttgagtgggctcaaaattaaagtacgtttctcgtctgtgagcgccagggagcacctcccatgggacctttccgctggggctgaggttggggcacagccgtgtggacatcctgccgcctctgtgtgctctggtgtggaggggcacaagataggggtctcacgaggccctcagggagcaagcagggcccagtgtcactgcctcttgtgagcaagccgcctgcccaccctaagcgcttggggtcagtgccaccgtgttctgggcctcctgcagcttcctggagtggccaccaggaaccttgtggttctcagggctgctcaggccgtcagaggcccctgcagccccaggtcagcaacctgcggtcagcccagcacgaggcctctggcatcttggggacttccccagcctggcctctgcccatctggtgtacaggaagaccctggtcagtgcaaagacactgtctcagtccggggtcctcaggagcagaggatctggaggcaggactcccagcacctgcgtcggaacctcctgggaacagcaggggcgggtggctatgcagttgcagtgcctagaaaacagctggatttcaggagtggagcctcagtagagatgagagttaaagctgaaagggcatagagaagatggaggagtggagaggctggagctttggacatccttgtttagggaccgggaaaggagaatatgtgtcatcagcagaatggggctgtacgaaggtcacaggcagagatctgaatctcaggacacagggcccgggagaggttctaggaaaggccaggtacctctgggagtggggcccccaggggcttccagaaagtatgggagcccctggcaggctgcagagagctggagtgaaggctgatggggccacagtggcatgtccacagagaccggggcctgatttgcagcttgtggcacctgccgaacccccggcgttggggtacatggcccatcatcaggcacagagtgaactgggtgaacgtggccctggtgtgtggtgctttctagcagcacgtgagccaaggaagcccagggaagccttcgcttgtgccacgtagcatagctcgtccttccagaaaatgtgagtagactcccctgagcctgataatgaaaggagagaagtcagaaagactgaccccagcactgggcagagccgagtgtgtctgatggacagcgagaggctggggcaaggaggaaagaaagaggggtcaggcctcgggaaggcagtgctgctgtgtgtgaagctgtgcggctctttattttcttctctttgcttatctgtagttttgaaattcaatagaattaaaacataatttgctttcataattatgaacaaaacatgcaagtgttactttgaaaggagaaaatagctgtgggtagagccgtctggactccagggttagaggcggagagtggaacttagtatgctccactcagcaaaacaacaggaaaggcagatggcaaaggtgcagcccagaaagcacagctgcacacactcctaacgcaaacaacaccctgcgccagcagctacaccggtgtttgcatctcggagcagccacatggctgacacggaccggggttcgcatctcggagcagccacacgggcgacacgcaccggtgtttgcatcttggagcagccacacgggcgacacggaccggtgtttgcatctcggagcagccacacggctgacacggaccggggttcgcatctcggagcagccacacgggcgacacacaccggtgtttgcatctcggagcagccacacgggcgacacgcaccggtgtttgcatctcggagcagccacacggccgacacgtgttggggtttgcatctcggaacagccacacggccgacacggaccggggtttgcatcttggtacatgaaggctcagaagtgggtagcaccaggaaccgtggaagttggataaaggcgaggctcacacaggagggtccccacccacatacagctggatcacacccatccccaccctagaggaggaatcgggactgcagggcgccagcacacaccagagtggcaccaccgagcgcccgggtcctcctgacgaacacctgaggccaggggtctgaccagccccagacaagtcctgggagcgtgcctgtcccgggcaccccgtggcctccccggcagtgcagaggccggccggtgctctttggaaggggttgcatctgctttgcccctggtctcaatcatcagtttgcaaagcaagagcaagtcccctcctgggtagaggacaccttaagcccttcccgcccagccctgtgctgcccctgggtttccacttacaccaaattctgggtgttggtgcaggttggattgaattagaagggacggcagggtaacgggatggtgaggacaactggattatggagaagatccagggttccttggagaaatggccagttctgaggctgggacaggctaagcctgcagcaatgtgtagtatctgaaaatgaggtgcttacactaaaaaccccccatgagcacagacactgaggttatctcagagggacatgggccagctgaaggagttgccagacgccaaagctggaacagtttaacaaactcatagtgacagccttggattacaatccaaagcataaagtgcgtgagtccatatgacacagataaattatcatcaacgaacagaaaagagggccgggcgcggtggctcacgcctgtaaccccagcactttgggaggccgaggcaggtggatcatctgaggtcaggagttccagaccagcctggccaacatggtgaaaccctgtctctactgaaaatacaaaaattagccaggcgcggtggcggccgcccgtaatcccagctattcgggaggctgaggcaggagaatcacttgaacctgggaggcagaggttgcactccagcttgggcgacaagagcaaaactccatctcaaaaataaaataaaataaataaatagagaagacacaaatcttcctcacagaggaattccacataatgtccgcagacactccctccaggaggcgggggctggacccagtgagcggcttccagaggacagagcgggcgggaaagcagggacctgtcagagtgcacacctggcaggcagaccttggccaggtgatcagaaagccgtgcggacgtcaggaccctgatacggtgtgacgggaagggccccgcacctctgtgggcatcttcccaaaacccatcacccagtctaattgcgagaaaacaccagacggacccaacgtgggggacgctctacagacaccatgacaggcctgctcgacaccgtcaaggtcggaaaacacaggaaagtctgggagactcacagaccaggggacggaggagacaaaatgcagtgtgggctgggcacggtggctcacacctgtaatcccagctctttgggaggctgaggctgttggaacctttaagctcagagttggagaccagctcaggcaacacagcaagaccttgtctctgcaaaaaatttaaaaattagccacgtgtggtggggcacacgtgtactcccagctacttgggaggctgaggcaggaggatctcctgagcccgggaggtcggggctgcagtgagctgagattccaccagtgcactctgggtaacagagcgagaccctctctcaaaaaaccaaacaaatgcagtgtggttgctggatggggtcccagaacagaaagggcacgcatgggaaagccacagtcttcagttagtgtggtctgcagagtgtcccaatgtggctctgtgactgtgacacataacaccacagtgaagaacagtgaccacaccaagggaggccagtgcagggcccacggggactacactgtgtctgctacttctttttttctttttgatacaggatcttggccgggcgcggtggctcacgcctgtaatcccagcactttgggaggccgaggcaggtggatcaccaggtcaggaaattgagaccatcctggctaacacagtgaaaccccgtctctactaaaaatagaaaaaattagccgggtgtggtggcagtcgcctgtagtcccagctactcgggaggctgaggcaggagaatggcgtgaacccggaaggcgaagcttgcagtgagccgagatggtgccactgcactccagcctgggcaacagagtgagactgtctcaaaataagtaaataaatagatacaggatcttgctttgtcactaggctggagcgcagtggcgggatcacagctcactgcagccttgtacttccaggatcaagtgatcctcctacctcagcccctcaagtagctggagctacaggcatgtgccactatgctcggctaatttttgtatttttttatagagatgggggtctcactatattgcccaggctggtctcaaactcctgggcccaagcaatcctcccgcattggcctcccaaagtgttgggattacaggcgtaagccactgtactcgccttcaacttttctgtaaacctaaaattattccaaaacccaaagtatattaaaaaaaccaccgtggatggccggcggggtggctcgcgcctgtaatcacagcactttgggaggctgaggcaagcggatcatgaggtcaggagttcgagaccagcctggccaacatggcgaaaccccctctctactgaaattacaaaaattagccgggcgtggtggcaggcgcctgtaatcccagctactcaggaggctgaggcaggagaatcgcttgaaccccgggagatggagcttgcagtgagctgagatcacaccactgcactccagcctggtgacagagtgcgactctgcctcaagaaaaaaataaaaaaataatactaaaaccttcaaggattacggaaaagctgtgccctggagcacatgggtgggcacataaggattggccctggtcgtttgggggcgtctgttggtcacagggcggccccagcagggtttccctgagacacagggcacactggccctgtagaggcgagcttcctggagtgagtttcagctttgttcttgtgtcccaggctacagcaactggacgaggagaacagtgaactccggtcctgcacgccctgtctgaaggccaacattgagcgtctggaggaggtgagctgccaacagcctggagctgtggccagtggggccagcccatgccctgcctgtggggcagctgaggtagccctgagctctgtgctgagcgggatactgtgctgtgtgtgagggaacggggccagctcagggcccaggccgctggaagacactggaccgtgctccacccacaggagcagggcccagaggctcactcctagatggacccagggctctgaatctgggaattgtcctccaaggggaaggcatcagccagccacttatgccccaaccactgccgacgtggaggcagaggctacacatggggctcccacaccccagcttgtcactgcgagacctccctgcccccacctcaccaggtgtgctctgggaagctcccaggaaggatattctcagagcacttgggccctgactcccatgaaccagaggagcccggctggaggtgcccacagccactgagtcaggtcctgtccacacaaaggtccttcctgcccctcgtgagaaacggccctcgtggcctgcgtgtgcgcctctacccagaagcaggtggccttgacctccactgagaggcaggaaggctcagacccagccctgtcgcgctccaagcacgggcgccaccgcgttgctgttgggagactcagagattggagggacagacggccggggcaagctgcatgcacaggtaggtgcgtgacccgcatccagggcaggtgtccacccctgcaggagaagcagaagctgttggatgagatagagtcgctgacgctgcggctcagtgaagagcaggagaacaagaggagaatgggggacaggctgagtcacgagaggcaccagttccagagggacaaggaggccacccaggaggtgagcacccaccctgccccacgcccagtcctgcgcccagcctgccccacggggagcctttgtttcctgagacgctagctcttggctgtgctgctttgggcatagccgctggtgtgtgtcgtcctcccgagagacggccagatcaaccctgaggttctacagccaagtgatggctgacggtggcccctgggagcccaggccccccggctcactgcacggttgccctgcagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggtgggcaggcctgggcctccctccctcacactcctgcagaagcttccacaagactggttgggaagggggggccgtggagggtcagcatctgagctggaggcctttttccccgggcagtccttgtccctgctcagccaccagcaggggccacagcccagtagtgatgttgctgtgccttcaggacaaccgcaacctgaaggagcagaacgaggagctgaacgggcagatcattaccctcagcatccagggcgccaagagcctcttctccacagccttctctgagtccctggctgcagagatcagctccgtctcccgagatgaggtaacacatcccgtgtctgcacggtgtggcctggggtccacagtctgcactgtctgtgcgctgtggtttatgcgctgtggcctgtggcccatgcgcctcagctctgaccacctgcttgccctacagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgcacacgcagaggccggcttcttcctccaggggggccacagggtggggtgggagtcttctgggcctggcccagcttccctcaaggcgtccgaggccatcagttgtctgagctcagaacccagcagacctgcctggctctgcagcttggtcagactaagacccttccaaggccgtaggattgcacctccaggcccagtggagcctggcagctttccagccaggttctggatcctgacgagctgctgagacagcatcaaggtggggcaggtggggcggggcaaattgggcagcacagggctgtgtgggcatcagggctctgggtcacacgcctctggggacgtacgtcccatgtcgggagagccgtcaaaacgtccccgggattaagagaagagtggggggcagggcgcagaggctcacgccataatctcagcactttgggaggccaaggcaggaggatcgcttgaacccgggagttcaagaccagcctgggcaacatagcaaggccccatctctaaaaaataaaaaattaaccaggcattgtggtgcgcacctatagtcccagttccttgggaggctgaggtgggagaattgcttgagtccaggagacggaggttacagtgagctgtgatcacaccgctgcactccagcctgggcgacagcgagaccccatttcagaaagaatttaaaagggcagtgatgtgcagggtggtgggaggacatcccccagaagagggggcagacacagtaccagcaccacaggcacgggaaggtgaggaggcaggtcccgacggaagtgggctcccgaggtcatgggcagccagggagtctgagagagctcagtgccactgcagccacaaagaatggcctgcggggagtggtcccatctgatcaagagtcccccaaaaacacaagccttgaaaactggaccacctggtccagcatccaggaagcggactgtgcatctgcggctctcgctctcccgccccccgcgcgagatgcccgcctgcctgtcactctcagatgcagatggagatggagaaaccaaggcccagggaagctgaggacccaggtctgccagtcccctcagcccagctgctgcttgcgggctggtgaccagaagaggaccaggcgtggcctacagtgaggagtccttgaaccctcagtgcaggtgcagcagaatggttccaggtcacagggcccaagaaccctgattgcttcatgagttagaactgaggagtgacaggccgggcgcggtggctcacgcctgtaatcccagcactttgggaggcccaggcaggcggatcacaaggtcaggaaatcgagaccatcctggctaacatggtgaaaccacgtctctactaaaaatacaaaaaaattagccgggcgtggtggccggcacctgtagtcccagctacttgggaggctgaggcatgagaatggcgtgaacctgggaggtggagcttgcagtgagcagcgatcacgccaccgcactccagcctgggcaacagagcgagactccgtctcaaaaaaaaaaagaactgaggagtgacatgggcggtgtgggtgtgtccaaggccaagttcctcctcccaggaaaaagacctgctctcccacctacccaggggtctgtgtggtgccagtaagacccatctctgcctagagggagaagctggaggtggggaggggaactcactccacgctgccaggccagagccagggaggggaaggggagcagcttcctcctcctgataccccactgtggtctaggagcacctcagtttccacgctagattttaaacatggggctgtccacagtccagctggccccacctcgatgacccactggggtctccagcccaaaggagtttgagacaggaggacacaggatgaaatggaaacattcccggaagggctgccagagaccttgtgggtgagcgagagcagggtggggtggccggtgtgcatgcctggtggacgtgcccagaagcctgcaccccccaggaggcccgaacgtgtccctctggagtgtcgcccccacccccagctgtgcagtgggatggtcactgggcctgccaagtctcccaaggcagatcctgtccccagctggctcctgacattgaatgttctgagtcttggtcagttctgcccgatggaagagcaccaaggagtcttgcccggcaggatagagaggagcggctctgcccctgccctggaacaagagccccggacgtgggtgcagagcccctcacatgaggaccgccccatcctgcctctgctgaagggcaggtataggaaggctggaccccctcagcggccccccggatgtgggtgcagagcccctcacatgaggaccgccccagcctgcctctgctgaagggcaggtataggaagtctggaccccctcagcggccccccggatggcaccctggcccctctacctgctggcagtccagtaacctggaggtggtggcccagagaaaggcgggaacttctcccagggccccgtccattgttattttcacctgtccggccgcccattctttttttgagacggactcagtcacccaggctggagcgccatgtgccatcccagctcactgcagcctcaacctcccgggctcaagtgatgctcctgcctctgcctcccaagtagcagggaccacaagcacacaccaccacaccctaattatcttttaagtggagacaggtttcgctttgtgtgttgcccaggctggtggtccgtcgtctttttgacccaggcctgtgtggctcacaaagcaggcaattgcagggtcatcccatcaaatctgagcatggcaccagagcacacaagtcagccacctgcgggccttggcaccctcgtgctccacgccagggtccctgtgtgctcaagtctgggctccatgatggcactggggtttgttctgtttgctgctttgtgcgcgtgaggctttctctgggtgcctgaacagatgcctccagtttcagttctttctgtttggccctccccatcctcttctcctccaggggggattcatggctcgcctcttggctcttctgggcacttggcgagcttctgcgcacttgcgttagctgctcaggtctgtctggatgtgagagtcgtgtcctcaggccaggaagcactggcacggagcagggctcggtcaatggtctggataatccagagtcacttaccttctgctgtgcagtcatttacaattcacgcctgtgtgcctgatgtcttgtgactcagaatcttcaagacaatcacaggctggcctcacggaggcacgagtgactcatttctctcatcgcacccattccctccagcactctccttgtgcggggaaacctcagtcaccttgaagacgcctcctgaggccctcttctgggtgaatgggcttcctccttcaccatgacaggctactggggagagctggggtgctcccaccctctcctcaccccaaatgggcctggcctagcaaaactggccagaactggccactctgcagtgagctggcagggccctcagcatcagatcaacaggttcaactgcagctgcctctctggtggggaggttataaggcctgctggctagaccactggcccctggccagggagccacctaggcagtgccagggaaggactgggaagggaagagaacctgcggtccctgagtgaggccttgactgcaccctctcctgtggttcgaaagccacacttggccagtatcctgccatgcaggtgaggaagctggggaggacagggtcccagagccttgtccaagttgcagagaggagagccagctctcactctgcagccctctgtgcccccagacccccactggcccccggggacacatttcctgcccttgggatgctttggcatggatatagtctgggaacaaacggcacatccagctgccctgcctgtctccacagagggggcagcagacctagggggaggtgtccaagacacaggaatgaagtgtccttaccaaaagcttccgaggacagaaataaacccctcctgccagcttctgcactgactgcagctagaagccgagctccacgtgggacacaggtgtccctgctgcggcatctcagcatgacggaggcccatccttggctttcctggagcatgaatatcctctgaggagcactggccctggccttgtaggtcttgctgagactggcttagattttctggcccaggagcaatcgtcacccaacctcccacttgtaaatctcgccacagaatcggcccacaaccgtctctccggaatctcggcggaccagccctgctcctgtgtctccctctcccgcagagccactgccttctcaggctcctcaagtgcacctaagagcgggagtctggctgccctcagcactcgcgtcccgccctgcagcctgataagcttgacgccaaggcattctcccgagagccggcccagcagctgctggcaggagagtggcctcagggcagcgggaaggggacctccggggagagaatgaggcctgcgcaagggtcctggaaggacccaggagtcgccccggcttccctcccccaggccctggttgggcgccgtgggccgcgtcccagttgagcccggcgtggccgtttaatggcgtccctccgcgaccgaggacgaaggggcctagagaggctgtgcccaagcgacgctgcgaggccaggccgcgtctcgggccagggcggtccccttgccaccgccgctcttggccgccaggaccaagcacagcacgcagcgtcgcgaaaggggcggtcctggaaggcgcgaaggggtctccgggtctcgcgaacacggcggggtcggggcggagtcgtgggtcctcggtcgagcggccgcccagagccccgcgggacacggacggccccagcccggctccccgcgagccccacgcgtctgtgacgccgctgatgcgcagacgccgcggctgcaggccccgcccctccgtgcccctcgcaaggccctctgggagttgtagttccagctcctcctcgggccgccccactccctgataatcctggagcgcggcgcctcccggggaccgaggcctcgggcccggccgtctccagcagcgagggcaggagaagtggcccgggcggtcggcggactgggagggcgccacccgaggactacaactcccggcctgcctcgcgcaggcaccgccccgagcttccgccccgtcggcgccgcgcagccctgtgggagccgtagtccgggcgcgcgattcacagcgccgcgtgcgccccgggcgcgccgtagccgcggggcccgggccgggcgctacgctacgaaggcagcgtaaggcgggcgccggacgcgggcaggggccggggccggagccgggtcggggcgccccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggtgagtcccgtcggccgggcccggccgggcgcccagccggggaccccgggcggggagcgcgggcccggagggcggcggggagcgcgggctcggcggggcgcaggaggcctcgggggccgggcgcgccgggctccgagccagggcagggacggcagggcccccggagtggggtcagcccgccgcccgctggcgcctccaggctggtgggggccagggctgggcgatgcttcgcagaggaacccagaggaaggcgggaagtcggcagggacctgggccatgtgggtcacttgaggccagccccgggggccgcgcacaccggaggcggcctcggccctgcctgcccttgagtgcccttatatccgggcccatcgtgcggtcctggccgccttagggatgttgtgcttggtgcgggcatcactcccctcacttggggaacggcctgggggcggccacctggcgtggaggggctggcgggagccccgtctgtgccagccatgccagtgttctcttccgtgttcctctggggctgctgcggcaccagctgggaagttgcaaatctgctgtcctcccgctggctgcagaaggggcccctctagtcctgaccgggggaactcttgtgtggtcagctggccctggccgggcgagctctcggggcccccttactgctctggagtttgttaccggactgcaggtaacaagacccggaaagcaatggtgaggcccagaacctgaggccaggcctgggtgtgtggggccagtggggaagactgggactccgttgggtgctgaagagttgtgtgcttctccttcgggaaacccggatctcttcctctgcccaggtctgaggggtgcggaaacgtgagtcacagttcagtgtgggagtgccccgtaattgcctccgcgtttccagagtctggggctgggcaaggatataggggtgattctcccttccggttctgagtgacttctcaactgtgaagtggggcaagagaaattgtttttctggcctgtctgggggaggcaggtcctgcaggaaaccagcttggcctggccttgggttgggtgtgccttgcctcctccgaggtccttctgcttgcgggaggagcacccctctttttcctgcttctgtctgtgtctgaggctctccagagctccttgattggcagaggagccagtgacctctgagtccccaggagagcccgaggctcagtaactgcataactgcgcagggcctcttgtctgggcctccacagaccgtggtctctgagagcaggaagtggctggtcccctgtaatgctgcatctgtgtgacagcctcaagccctgctggctctctctccgggcacccctcacttgcttcttgccctggccttgggcagcactccggtaaccccagtgccacaggtgaggaaccgaagctggagacagctgttcatggcaggggaggggccgagggaggctgagcgcctggtctctccctcctgctggttccaccagttcacacgaggcaattggagggaaggattctgctgcccggaaaatcctccggaaccacaggtgttgttcatgggcctgagccgctcagtgaagaactcggccgttggtggccgagttgcccctggtccagccctctggcccgcggtgtgatgcctctactcatggcaacaggcgtggacaggtgctgagaaggaggacgacatcattaaacaaaacagcttggggtctttgaaaaacagtgacagaaacccaggaaggctggtgacttgtcaggtctgtgtctgtcctgggtggccactcggccctggaccgtgaggctgaaatgacaggagacacggagggtgggcttgggtggtttcctcataagacacagaagaaggaggcccccaacccgggggctgcctcgtgcgctttgctctcctgttttcctgctctgtccctctggtcctgccctctgacccctggcacagcaggagtgcccagaagcccagtgggacttgttctctgcctaaagcccttccgcatccctcgtacccactcggtgtggatgtgggttttctcaccaccaggctgtgcctcagctgtgtggagccactggcctctcatgccccacgctggagagaacgctgaggtctgtgcggttctcatgtgaccctgtagctggtccctggctccccactgtgggatctgcctgcagcacttacacttgggaccgccctgtctccctgctggatgtggcgccgagggcagggtccgtttctgtttcttggtaggcctagtgtctagcgctatgcagccgtgcgcagagcaggcggtcagtgagcacctggggttggccctcaccacaggcagttctgaatacctgggttctggcagcccagggggactcctgcgtgctccaggaaagtagcacagcagcccctgtggcgtggacacggccacacctgagctcggcctgtttctgagtctgagagaacaggcttgctggcctgtgatctttgcatgtgtgtctcgctgcagggaggctgtgggttggggctggacctagacccgttcagccacaccctgtcactatgtgggtcacacacagctgggtggagacctcccggtgcgtggcccagggaggtgtctgggcgtggagtctgtggacagccacattgtaccactaggacaggggctgctgctgggcccacagggtgcacggaatggggtctgtgggaggatgggggcatcctagcccagggcagggaccccgtgggccccccaagatgagctgcgtcaggctgttgctttgcacactctgaggggcctgcctgagtgctgcatgggaagccagcagtgtggccgccctccccagaactcatccagggcaccagggtggacccatgagtcccgtcgggtcatgggcatcagcctcgccatcctggcctccagatacaacgatttgtcagattccctgaggtcaaagggaagcttcaagggttgccatccccgcctccctggcggtcctagacgggatgtcaggaggacgcagggccatcgctgctttttaaatgtcacagtgactgcagcgtctgctcctctgtggaaggagcttgctccgctaatgagggagttcctcctcatggccttcccctcacttctcttcaaaaagttgccctttattttaacattttttaagttttatttttttgagccagggtcgtgctctgttgcccacgctggagtgcagttgcaatcatagctcgctgcagcctcaaactcctgggctcaagtgatcttcctgcctcagcctcccaaatactgggactacaggtgggcgccaccacacccagcctctgccctttgtaagtgaagtcccccaggcaggttgaacctcttacaccttctgcccctgcctgatccccactccctaccccccacctccctgtcccctgtaatgagaaaggcaataagttttggagctttctggagttcctgcccctcctgaaaaggtggctgcagagaggctggagctgatggggaaagaggtgccacgaggcctcctctgggttagggccacacggctcccaaggcccccgtctccttctctggggtgacaggtgcccccagggccacacggctcccaaggcctccgtctccctctctggggtgacaggtgcccccagggccacacggctcccaaggcctccgtctccttctctgggatgacaggtgcccagggccacacggctcccaaggcccccgtccccttctctggggtgacaggtgccccctgtgtcccagaggcttctgcttggccaccagtgaggtcaccgggctgcccagaccagggctgcttctgccaccacatggcaagcagagaagtagagaagtgccaaaaaccacgagtgcttgtctggtccttttttcctgttaaaaatagaagtcggggctgggtgcggtggctgacacctgtaatcccagccctttcagaggccgaggcaggtgggttgcctgaggtcaggagttcgagaccagcctgaccaaaatggcgaaaccccatctctactaaaaataaaaaaattagctgggtgtggtggtgtgtgcctgtaatcccagatactcaggaggctgagactgtagaattgcttgaacctgggaggcggaggttgcagttagccgggatggcaccactgcactccagcctaggcgacagagctatactccgtctcaaaaaaaaaaaaaagaaaaaaaagtagaattcggttgggctcagtggctcatgcgtgtaatcctagcactttggaaggccaaggtgggtgaatcacatgaggtcaggaggtagagaccagcatggccaacgtgacgaaacccccatctctactaaaaatacaaaaattagctgggcgtggtggtgtgtgcctgtaatcccagatgtttgggaggctgagacactagaattgcttgaacccgggaggcagaggttgcagtgagtcgagatggcaccactgcactccagcctaggtgacagagtgataccctgtctcaaaaaaaaaaaaaaagccagccgctgtggctcacgcctgtaatcccagcactttgggaggtcaaggcgggtggatcacctgaggtcaggagattgagaccatcctggctaacacggtgaaactccatctctgctaaaaatacaaaaaaattagccgggcctggtggcaggcgcctgtagtcccagctactcgggaggctgaggcaggagaatggcgtgaacccaggaggtggagcttgcagtgagccgagatcacaccactgcactccagcctgggcaacagagcgagactctgtcagagaaaaaaaaaaaaaaaacaggtgatgcctgtgccactggacacacctgcacaccatcctcatgctgatcacaaaagagggtgaggggccgggcatggtggctcatgcctggaatcccagcactgggggaggccgaggcgggtggatcacctgaggtctggagttcgagaccagcctgaccaacatggtgaaacctcgtctttactaaaaatacaaaaattagctgggcacggtggcgggcgcctgtaatccgagctacttgggaggctgaggcaggagaatagcttgaacctgggaggcggaggctgcagtgagctgagattgcaccactgcaccccagcctgggtgacagagcgaggctctatctcaaaaaataaaataaaaaatttaaaaccaacaaaaaagagggtgatggctgagtgaggagtccatggtgggccctacacagggcccaggaaggacagggcgggaagcgtgagcatcctgcccaccgcagtgggtccgccatggagagcatgaccttagagaagcaaagccgcctggctcgaagcagtggccgccctgctgacagctgtagtggccgggtggcactcgggctggggtccgggggagtctaggtggccacctggctgtgtgcctgtgcctgcccaagctgggcacctttccctggcagtgcctgggaagctcggccgccctccctggctggtgctgctctgcagccccgctcatggactcttgcccacggcctgctccttgtagcagggtcgggccgtgggaggtccggacaggatcttgaatggccctgtctgcggtcctggctggccggaggttgaccgcactggacaggtcaagggccttaaaccagggtagtgaggagcctgctgagcccctgctgctccccgggctgcctttggcgctcggacagacacccaaggacagaagctcggacagcttctaaggcgaagggtctcccggggctgatttcccgggactctggctcctgcagagagggctggaggcggggctctgtgttccagggtcagagtcctcctggtggaagctgaggtgcctgattaaatgcctccctttctaggcagcagcccagacgcggcacagagagggcctgggagcttgctgcagcttcaggtgagtttgttcccaagccctgcggctcgtttatgggtttgcttgcgctgcagaactgtttgtggagcagcagggttggagtgcccacggctggggggcctctcggagcccttgattcacagaacccctggaggccggcagccctgcctgccctgaagagcctcgttctcccagccgtttgggccgtggtcctgtcgtgggaggcgacggtgagggcggcccggggtcccgacaggggtgtttgtccctttggggacctcccctgtgctgtggccccggcccccagatggagctccccatccccacggcagcgctggggctggggctggtgaggagcctgtgcacggcccccaccgctatcctcagccaggagggtgcctggtccctggggagcggcctgcacctgtttctggagaatgctgtcctgccagttgtcatttggggcgggcggtcggagtccacgtcctcccccagggcggggccctggccttgtttcttgtagggacgatgggaagccctgtcctcagccctcccacccgactcatgcaggagcttcctgtccttggggtcatctcctccacaggggccttagcgtcagtggggacaaaggcagagttgcctgtcttcaggttgtgggcaccgactgagcttcgtcccggtagtggctggctcttgtttcctgcctggaccagcagcctctggtctggtgggtgcagttttagggcgcagtggggttgccgtggggcaaggccaggccaccagctgcctggacacaggggcccccgctttccatctgctgccccccacacccccagctcgggcaggggtgacaccggggcatccttgttggggtcgctgtggttcccatggtggcaagatggctctgtgaaagattgacggagatgtagggcccaggagcaggtgctgtgtgagtgggacacgcctgtgtcacctgcggggcaggggagggctcgggggtacagccgtgtacatgattagttagcgagacagtgaggagtgtatgcggagtggacacagctgtgggtgccgcccgcgcaaggctgggggtcgctgtgccagccctgctcccatgtgggctcccagctccccaggtagggacgctgaccccgggaggtgcctttgcctgcatccactggagcctcaggagcatgcgttccgtccccacgggtcacccccactgagcccaccacctaccgagaggcacctcgagaccctgtcctgccacgggtgggctgtcaaggccagcaccagagacccccagcagacctcagtggccgcagatggagcggggcggcaatggtcacctccgggactcagccctgtgctgagccccgggcagtgtgatcatcctggcccttctcgtgcacgtcccctggctggatgctccttgctgccctcacggggtgtgtgtgtggcatacaggacagggaccggccagttggccctgctcattaaccacttgtccccacagggcagtggcggcctcacctctgcaattctctgaggctggatctaggccaccgccccgtttaaaactagggcatcggctcccagggagggcggggagctgcacagttggacttgtgggggtcaggcatggatccacacagcccggggccctccgcaccctgcccctccagggagcccagaggcgggcgtggctgcagcctggctctgtggcagtcatgagtcacggccactcttgaggcgccgccctgagagtcagccctgtggtcacggctcctgctggttcccattcgcgagcacctgaaacagcctggcccacagcagaggcccggggggcacatgcagctcacgggagcagcacagatgcttggccggcggcaggccctacaggagcagcagcggcccagggcatgtccctggggtcaggggtcagagttcggcatgctctgcgggggcctcaccctgctgtccctcggcctggcctgggcacactccttggtgacagtgcccctgcacgcccccccccccccccggttattcagacagggagccaggatgggaaccacggactgacctgacctgcgtcctcggggccactgcactgggtgattcacgtgtgcccaggccctgaggtgggccggacctgggagtggcaggtgagcgttcctcccaagagcctctggctggccgcagcaggccctgtccctgctgtcctcagtggccctggacatgataacccccctgccgaggtctggccggagccagcacccacggccgagatgcagtcagccctggctgggcgctgtccctgggggtggctgctggtgctgccctccctccttcccaccacttcttgctcctctttcctggggccctcccatcggagtcttcctcctaaatgcagttccctccctctaggggaacgcgggctgggagcctattttttttttttttgagacggagtctcgctctgtcgccccggctggagtgcagtggcgcggtctcggctcactgcaacctccgcctcccggattcaggccattctcctgcctcagcctcccaagtagctgggattacaggcgcccgccaccacgcccagctaattttttgtgtgtttttagtagaaacagggtttctccatcttgcgcaggctagtcttgaactcctgacctcgtgatccacccacctcggcctcccacagtgctgggattacaggcgtgagccactgcacctggcctgggagccttttccgtagctgctcatcctgtactagcatctgtccatcatgagtggacggaacacagggggacccaggacccacagctgcactcgggaaggccagcagggtggatttcgggaagagcatcggtgccagtttcccacagtcacccttgcgatgggaccctcaggttggcacgtggctggcagctgtgtcccgggagctcttgctccttagtgggcctcgccagccagggcagggcccccggcacccctcacggggctcttgactcctctggcagcggatcggggcggttcagcgataccatctctggagatcccctggcgtgtgctggaaaaaccccggagagggcttaacagagccagctgtccagcctctgtgacagggacgtttgcttttctctgcagggtcctctcttctcttccgagcacccacgggaggggactgtgctgtccctgctctcctaggacaggcctccctcctgtccagatggggcccacagggtcagttgcctgagactggctccagctcaagaaaggttttctgagtgagcgcaggggagcaggaggctggtgagcagctcgcttcctgccctgggtgcagctgggcaccacttctgccttgggcctaaaggcatcagtgaggagcaggcggggcctggtaggagcctgtgtttctagcggcacgcgtgaccccaggtgccacgtgggtgagtgcgtgggtgggtgagtggcgaaggagctgaggttggccctggcaggtgtgcagtcctcacacagaacgggcagggctcctgtcagagccaaaccagctcagggcccagtgcaagcagcttctgtcccgtggcacctccgctagtcgccgctcccacccaagccctgccccgccctgacccgctcagggtttggctacagaaggggagtgtcggaaatgcccaacccgtctcccgtgagggactcctgcgtggcctgggctggggaacgcaggggccgtttgggtggttccggcgtctggcgtagccacgcgagaggccctgggttgatgcgtgggctccctgctagcgagcctgctccgtgcgtgctgggctcccggccttgcttccgtgtggcattcgagaccccgtggacctcgcctgcgtcctgcatgtttgagcgctgccccttgtggaggccgccagcactggtggctgcagggcctgtagtgtggcacgtccagagacccggcctggagaacgggtcctggatgtctccgtcatgttttacgttcgcttcacacggacgcagcgatgtctcagatacctcggatcacacagagcacgtcgccaaggcttgttttgtctgttcctttccacctgtcttacgtggataccaggagatccgccacgactcccgtggccccgtccacactgcgcggcgctctccggcgtggccgccaggtgccccttcgagggcaggtgtgagtacagggtggtccctgtggagaagcgcctgcaggcgagtgagccaggctgtgccctgctgaccccgaggcctgaatttcatggaactcccacctctcacagagtattgtttttttttttgatttttttccaaccatttaaaaatgtaaaagccattgttgacttgcgggctggaccaggcttagggctgggctctggtccgcaccccacactggccccgtgtgtcctgtgaccgttctgcctacggggcaggcctgagccaccacaggatggcagggtctccagggtgcagggcccgcaatgcttcaaccctcccacgaccccagcaccttcagagaaaacggaccctcgtgccgagtgaagtggttcaggcgaacgttatcaccacacgggggactcggcggcttctgccccaggcctcaaaggagaggggatccagaattctctgtctcaccccctcagcccctgcccttgaagcttctgtccccaaggctgtggggaggaaccagggaagggctggcgcgtctgctgtgcgatcccaggtgctcgtgcctcgctgagctcagcccctgtggcctcagagctgcaggcccctcccgggtgtcagagcactgactggaaaggccccccacatccctgccctctgctgctccccatcgtcgcgggggagaagctggaactgcacccccaccccccccagcccgctcacctagggctgcccccaggcctccctgagctccaaaggatatgttctttggtgctttttttttttttggctctgtctcccaggctggaatgcagctgtggtgctcacgccatcctcccacgtcagcctcctgagtagctaggtctacaggtgcacaccaccacacccggatagtgtttagttttctataaagacagggtctcactgtgttgcccaggctggtctcaaactcttgggctcaggtgatcccccacgcacggcagctttgacacttacttgaccctttcctcctaagctctaccctgacgctggctgtgtgtcccagagacttaatcagaagctggaagaagggctgtgacgtgtgtgacagcaggaactgctggtcaacccacagccggccagcctgccgggacgccatcttggccccaatcttggcagggagaggggagtgtatcggactctggggagagcagctgcctgcacgggcagggtcctcccgtctcaggattaacgttctcaactgtatttgatttctcctcagccagagggggtaaggtggccttcccagaagcacaggtgggccgcgtgtcagaggccctggacagcctgtgcctctcccaggcctcccagcaggggtggctctcgcccctctggaggggagaccccaggaaccggcccccgccctcagccatagcctcacagggtccttgtttctcggggcctggctctgtgggtgcacaaggcatggtcgggctcccgtccttctggaagtctccagagtggcatgtgggcagctgtgtgaagcggccccccagatcttcatccagcctggcctgcagcagctccctacgccctctgctacctcccctgcctacctttgggtagacgttctcttgacccttccttctgtgataaagcaaaagcgtgtgatctcttttctcaccaaggaataaaacgtctctgaataccacagacgtgatgccgggcttttgggggccggggggtgtcctagggccccgagggaggagccctgtgggtgccgaagtcgggccgcaggccctgcactgagatgtcccctcagcctaccccaggcggctgggcatgctgggaagtcctcccgggctgtgtgtgtgaatcatgctgtttcttctctattttctctctctgtctgtttatttttgttgtgtgtcactctgcccagccggccgtcctgtctcttccctccatgctccgcttcgcccgctgctggccagaggtgaccaggtccggctctcagcacggccgccggccggggggccatggggagctccgcctcctccctggccgcagagaccgagtcggaccacagcttccccgggggaccgccctacccgggtcccccggcagcggctggctggtgtaggagcggcccaggggggcccgtctggggaggtgccctggtcagccggcagcaccagcccccacggccccgggcccgaaggtaagaggtggggaggggtggccccggagggctcccgggggcagagggcctcgttctcagggtgccccctccttggcagaggtgcttgcagagaagtgggtccctgctccttccagttgtggcagctctcttccccagggtgcaggagctgagcaggtctgagaccccggcctcggcctggctggttggtggtggggatgggggctagtgcgcccaatcccggcggccctgtgtttctcacaggctgtgctgctccacgcagagaagctgttcctgaagcttctttttgggctggggtcgctggcggctgcaggctctgggcatattgcctgctgcccacggtttcaaagctgccagcactcgctgggctccgcctgctgcccccccgggggtcacaggccacatggcttggtggccgaactccacgtgctggctcctcacagctgtcaccatggccttggctacccgctgcgtccctcaggagctgccatcaggttctgaggtgcctggtctggaggcagtccaggtggtgaggtctggactggctggaccccaccgatgctcctgccgtcaccccgtcctggccctcactggaggcagggacactcaggggcccggggcctcggggccagtgctgcagtggccgccgttgctctcacagcgggtccaggcctggcttctgaaggcaatgtgcctgcgtctcacactcaaaagggcctgccaggctgcacctggcggcagctcccacgggggacgatgtcctgctgtctgttggcccccaggtgggagggacgggcgtggagctgcaggcagtgggcaaggccatggcaggtggccaggcctgggaaccagcctccaggtggcatccacgctgaggcctgagctccggccgacaaggactggggatgcaggggattagccaggggctgtgtgggggagccctggagccctgtctgcgagttaccccgatgaacagggagacgcggcagaggcagggccggggaggggccgtgtgggggagccctggagccctgtctgcgagttaccctgatggacagagagacgcggcaaaggcagggccggggaggggccgtgtggggcctggtggtcggcagaggaagggtctgtgctcctcctgcgtgtggtggcaccggagcgcctcccagttcctggtgttaccgcaccagccgcctcccagtgagcatctccacgtgtgccgacaacagctttgttgaggtagaacttaccagactcacctgttaaaagagtgcagtttggtcactcttagtggtttgtagagttgtgcagccgtcattgcaatccagcgttgcagcattccacagcccacagggacccccagccccacagtccagtgttacagcatcccgcagcccagagggaccctcagccccagacggccactgaccggcttcctgtcttggtttgccttgtgcagaaggtgcgtggatgtggggccacaggacgtggctggctgggtttgccttgtgcagaaggtgcgtggatgtggggccacaggacgtggctggctgggtttgccttgtgcagaaggtgcgtggatgtggggccacaggacgtggctggctgggtttgccttgtgcagaaggtgcgtggatgtggggccacaggacgtggctggctgggtttgccttgtgcagaaggtgcgtggacgtggggccacaggacgtggggccccgtgtctggcctcttcactcggcaccgtgccctccagattcatgcacctgcagcccgaggcagtttcattcactgctcctttgcgggatgaaccgcattttatctattcatggacgctaggactgcttccacgtggcttctgtggacaatgctgtgaacattgtttacgaggttttgcgtggacctgttttcatttatcttgcatagatacctaggagtgggattgctggggcgtgtggtgaactttcataatgtcttgaggaactgccaagccatcttccgcagcggctgcattacctagttcccaccggcaacgctggggagggtcctggcgtctccactccctcgacagctcctgccgttgtctgtccttgtgattctggccgtcccagggggtgggagctggtgtccccttggctttgatctgcgtttccctggtggccagccatgtggggcctctctccctgtctcatccacccgtgcctgtctttttttcattcattcacttatttatttatttagagacagggtcttactctgtcacccaggctggagtacagtggtgtgatcacagctcactgcagcttctacttcctgggttcaagagaacctcccatctcagcctcccaagtagctggaactacaggcgtgcaccaccatagctggttaattagaaaaaaaaaatttggccaggcgcagtagctcacgcctgtaatcccagcactttgggaggccgaggcgggtagatcacctgaggtcaggagttcaagaccagcctggccaacatggtgaaaccccatctctactaaaacaaaaattagctgggcgtggtgacgggcacctataatcctagctactagggaggctgaagcaggagaatcgcttgaacttgggaggcggaggttgcagtgagccaagattgcaccactgcactccagtgtgggcgacagagtgagactctgtctcaaaataaaaatacaaaccctgagcttgggagggtccaggctgcaatgagctgcgatcgtgccaccgcactccagcttgggcgacacagtgagacgctagacggtgtctcaaaaaacttaaacagaaaaatgtagaaaggattgtcgttccctttctcgttttccagagggcagaggactctcggcccctgctttttgagcaccaggccgagtttcagacctcgggatggcctctccagtctgcagctcccggcagcctcgggccacactcccgggatccccagggactggcctgggactaccgggggtggcggccgtggctctggctatggggagggaggcagagccgcggggcaggcgtggggtctgctgtgccgggtatgtggggcgtgtgttagactttggacctggcctgcggggtcaggccgtggtgtatgatgacgccacgccgctctttctctttcaccctggcctcctgcctggccctcccctgggtcggcatccctggggccactcctgcccgtgcccgctgctgtggggcctgggctccaggcagctcctgtctgctgctgcaaacaggcccccaaggtgcatggtgaggagacccccaggctagagatgggcgagagcggtgggcgagcagactgcgggaaggcagctgggcctccacacgcggagccctccccaccacgtgcatgcacaggcgacccctgccgtgctccgacggagggcgccgggactggggagggtcagcgcgacagccctggcgtttactgaagagctgcctgcctggctcgctgccctggtggccgctgaattctcccaacgccccaggacagcaggtgctgtggccccatgaccgctcccccacatggatgaaggggtggtgcacaggctggtggagcctgggagagccagggcagcctgcggccatgcggccatgcggccggcgtggggctgaggtccctgtacagctgacagagtgcctggcgccctcaatcagtaagtcatctacgggccgggcaccggcggctcagcacagagaggcaacaagggtagaccccccctggcaaggctgaccggcgccgggctgtggccagaccaggagactgcagcccagctcgagggaggcaccacgcctgcccctcagagcactgagcagagccccccatggtatcccccgccctgggcacagcaggaggagctgccgaccaagtctggcaccccggtgtgccccgagagctgtctgggcacaggttgcggggctgccccggccggacggggcatctgtgtttctcggtgtggcctcagggctctggtggctttgaccgaggccccgggggacagaatgcagcttcctgctcctcacttttcctaagaaaggggccgcctcccaggactggggctgcgccagtcacaggcccgcggcctccacgctccgggtgctgctgtcccggctgcttcagggcgggctctgtcttgcacgcagcgagcggcttcatcacctcccttttgaattggagctgagtgtcggcaacgcccagataactggggcgcgcgggtcttttgtgctggatttttctgtacagttgcctcgatcttccatccagcttggcctctgtgcagtaaggagcggcccgtcgcctcccccacgtcgcctcccccacgtcgcctcccccacgtcgcctcccccacgtcgtcgcctcccccacgtcgcctcccccacgtcgtctcccccacgtcgtcgtctcccccacgtcgcctcccccacgtcgcctcccccacgtcgcctcccccacgtcgcctcccccacgtcgcctcccctcacgtcgtcgtctccccccacgtcgtcgtctcccctcacgtcgtctgccctgagcccgctcccttcgaaggtaaccatcctgcagtagtgagggctccttgctgagcacgtgtggctgcgacttcaggagcgttctgggttgagaattccaaaagggcttcgctcaggcctggctttgggtctttgggctcctgacgcgagcttttacttccaggctttggcggtctggcctcaggaggtcaaggctgcagtgagccgtgcgcgagccactgcaccatcctgggcaatcagaccccatctctaaagttcaaaacaacatctttgtaagggtttcgggtctctgagcccatgaacctgcccaggccctgcagaggtgagggtggccctagagtggctggggggttgtggagaccagaaccagggcagaagggcagggagggtgggggccctgccgaggtctcccaccgctgacccctgacccctggcccccttccacctcggcccaccgagagaggccggcacagcgcagactgcggggtcagtgacactcccctcagcgtctccagccacagaagggccgtggcctgccttcgccctcctcacccgtgtcccggggccacgtttgaactttaggccttgttctgacttcattgaaaccctcctgaagtgcagacgtcttcctgacccacctgggttttgccaggatgactccgaaaggtgtctcccagcagacacaccccgctggcgattgtttggtcctggggacccgggttctcattctcctctctggagctggtgaggctgtccttgctagtcggtgacaactacagggccaaagggagggtgtgtcccaggaggcccagcccacctctgcctgcacctgcggtcagcggggtgcagagtctgtgaaggcacctcccggagtgggggctgcaaagatcatggccactgtgccacccacaggggcccaggccggacgcctgggctgtgccgcctcggcagccaggccgaggaacgtgcaggtgcggccgggagcccgccggccacagctgcatccatgcccttctccgagtggtgatggcggggagaggcctggctgtctacgggcagattgcttgggctttcacagaagcccgctgttagagcagattcccggccttgggtctctctgctccagctggacgccctgagcctcgccgggcccagtccacccccgtccactctgccaggggcagctcagagccctcgccacgcggggctgagcgcagggaaggcagcatcacggagttcgctcggctccacagaacacccgtgttgctcgcggagactttttgtttttgtgcttcttatgaagaggcaggttttctttcttcctgaaccaaaagggtttagatggagcacaagattcaggccatatttacaagaacaattgatttttctgccaggcagagcagccagtctgtctcggaggctgtgctgtggtgtggggaggccccttgctcagatcagcctgtgccttccccaggccccggcccatgcacctgcccttccgtaggtctgagcacctgttcttccacgcccaggacgacctggtcctgagtttggccgggaccccctgctatctgccgtccacaggcctggtgacagagaaagcagtgccctggaacagcagcccggctgtggggtgctcagccctctctgtaggatcctgtgtggctcaaggggtctgctgagcctccaacgggcaagaggggccctgagccatggatccattctgggtggaggcagcccccaccgccgcctgcctcaaatgctcagccctaggccctcggccccgtagctctgcagccacagacgggtgccttccccaggccgagaggagggtggggtccagccactcaggacctcacagggtggccctgatgagcaccttcccttgcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggaggtgaggcgccccctcgccctcttcctgctcctgagcctcctgctcccgccctccccttcctaggctttgggctctggcgatgggctggggaggagcccacaaggcctaagacgtgatggggagggcagcaccctccgccccgaggctccaagctcccaatggccctggggtccagcttggcctcctgacccttggtccttgctggtgaccgagatgcacgaccttcacccccctcaaccctccaccgtggccaggagggccccgagccccgtctgatgtgccgcaggaggcgagggcttcccaggggcagcgtggagaccccgctgaagtgcgaggtcgggatgtacccgtgctccgccctctagagtccaggatggcatcacccacgggtcaactggggcgcagcctgcaccctccccagcagggccagggccagagtcgtgctgccacccactgggggctgcgctgtccccctgggcccacacgtcccctgctcctcacctgtcgccagccggtggcctctccactagggctgagggcttcctcgacacagggccggcgccaggtctgtggctgtccacgctccacccgtccctttggggctcaggcagtgcttttgggcgctctcctgggtggggtcttgtccctgccaggtggagcgaggccaccctgcccagcctgagcacatggccgtggtctctgcagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggtgaggccttctccaaggccggggtggggcgggtgggcgggcgaccggccgcggtccccgcgaggtcaccctgaggctctgcgcaggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggtggggcggcctgcagggtgggcacgggcggcaggggcagcctctgaccccagccccgaaaacaaggccggctgcttcctcttctcccagggcgggtagtgtggggggcgggcgggggtggcctctgacccggccctctgcaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggtaagaggaggggcactgcgtggtcagccgcgttgggaggagaggcgaggcggagcggtgggagatgtggggctggtggcccctgacccagttctgcttccacgaggtgcccctggcgtgggctgaccccgcgtggccaggccacagccccaatcacctccccctccctgggcggggctggagctggccttctcatgccaggaaggccacatcctggccaggccgtggggcgagaccgatgccgtcaccccggagcaggtgtgagcggcgtgtcgagtttgacctgggccgtggggcgagactgatgccgtcatccgcctcggggcaggcgtgagcggcgtgtcgagtttggccacactctggtcagcgggtctgtgcctcgacccccaggggcctcctcggagtgccccggtgcgagcaccttgaagctcccggagccctcctctcagctgaccctgggcagtgctgctgcccaccccccacccgcccgggagccacagagcccagagccagccccacaaggcctccaggggacccaggcctgccacccctgactcaggccctgtgcgcttcaggcatggtggagggggctggtccagaccctcctgaacacttcacgtggtccctacaggcaggagtgggcccttctctgctgcgcctgcctgtcttggtggcaaggtcgcggccagcgagggcactggtcagcaaggccccggtcagtgagggccccgctcagccatgcccccagtcggtgagggccccactcagccatgcccctggttagtgagaccccctgtcagtgagggttccctgtcggtgagggtccccggtcggtgagggcccccagtcggtgagggtcccggtcggtgagggtcccctgtcggtgagggtccccgtcggtgagggtcccggtcggtgagggtcccctgccggtgagggtcccggtcggtgagggtcccggtcggtgagggccccggtcggtgagggtgccccgtcggtgatggccccggtcggtgagggtcccggtcggtgagggtcccctgtcggtgaggtccctggtcggtgagggtcccggtcagtgagggtcccctttcggtgagggtcccctgtctgtgagggccccggtcggtgagggtcccctgttggtgagggtcccggtcggtgagggtcccctgtcggtgagggccccggtcggtgagggccccggtcggtgagggtccccggtcggtgaggtccccggtcggtgagggccccggtcggtgagggtccccggtcggtgagggcccctgttggtgagggccccggtcggtgagggcgccccgtcggtgagggtcccggtcggtgagggccccggtcggtgagggtccccagtcggtgagggtcccggtcagtgagggtccccggtcggtgagggtcccctgtcggtgagggtcccggtcggtgagggccgctctgccacacaggttcctcatgggtgcctcctgtggcgggggcaacatgaaggtggacgattcggcctacgagagcctgggcctgcgcccccggcatgcctactccatcctggatgtccgagatgtccagggcaccaggtagggccggcctggctgagggtgggtggggtgccggtgagactcgggcagtgtggttcagatcctcacccctgtggtctgcaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtatcggcaccgtggggcggtgtgcacgccgcccccgccctcctagggccgagtccttctctggagaacaagcctgtccctcctgctgacctggggtggggcggcttgttcgtggcccaaatgggacctggagcttcagctccaaggtgccaacctcagaattcaggtccacccaggtcagcagattccagcgccctgaagagccggccctggagggcttcctattataggcctcagggatgggcccccgggggccgggctgcaagaggacggtgacggagcagctggcacctgctggggtcaccggcctgtggttgcggtaggcgctgagccacggaggtgtgggccgtggtaggctcagggccccgtcctcccgccacctgcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggtgggtgctgcggggccccatcgggctgggctgggctaggctggcggccgtgaccacgcgtgaccctggcccgtggtgtctggcgcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccagggtacgtggcccctaccccaggctcatgccccaggcccacggggagggctgcggttcacacgcccgtccttgtagcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgaggtgggtgggggtcccgggggagggtggcgtggggcagggggagtatgccccagcacctcccctgccccacaactgccattcctgtgcccagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggtgcgcccccgcccctgcccccccacccctgcacaggtgccccctcccctaccccgctgcacccacacccaactcgtgcccccccacccctgcacaggtgccccctcccctaccccgctgcacccacacccaacccatgccccccccacccctgcagaggtgtgctcatacccctgcccccacccctgtacgggtgtttgtcaccccactcctgctcctgcccctgtacaggtgggcacagccctgcccccatccccaccctgccctccacaggtcctcaccggtcccctcccccaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaatcacgcctcctcctcctgctgttgccccgcgcagggccctgtggaagggcggggaggttgcaggtctgaggggtaggccctgcccaggcatcccgggcaggcggacgggtgggggcccctggagatggccgtggtggggtgactcacaagcttgtaaggggcagccggccctgccaaatggacgcagccaggaaggacggagtgactgggcgggggcaggggtcagaccctgcggccgcagccccagggccgggaaggactgggcagacgggacagcagcgcatgcagcttcttccagcgaggcatccgcacggggggctctgtctgaacccatcagtcacccggcaggagcagatggagtgagggggcgcgtggggagaaaagtttcctgtcccctcccagcctcgtcccagggtggcctctgcccccacacgggtgctgctgagcaaagcgcccgctcggaggctctgctgtctccctggacggagttgggggctggggtgcggccggcgcggggtaagaggctgtcacgggcagcgtatcgaatgtgaaagcaattaaagccaccagcagtgttcgctccgggcgggcctcgggcggcggggagctgccagaacacatctcacctcggtgcccgcggacgccggccctgctgctccgcgactgcgccacgtcacactcctcctgtgggtgggggccgggctcgtgcccgctcctgtttggcacagagctggctctgtctagtcctggggtatctgggacccccgttcctcccgagaccctgctcctctgtccctggccccacccccaccaccacccacctctctggcttctgccaccccagtcctggggtggcccaggacagaggcccacaagaaggaccctccttcttgcaggagtcccgcacagcaggcaaggggtccgtgcccaccccctcagctgcccagagtccccactagcccagccagcagcctcctctccacttgaaagcccccgggagcagctcccacagggaggtgatgagggaaagggggggcgtctgcagaggactcagggtcccacagcacagaccctgccaggtgttgggccggggccacgtgaggggctgctgcggaggcctggaggaggcggctggcagcaggtaaggggaaaagatgcgagcgtcctgcaggcagcagggaggattggctgggcaggacacacagccctggcgcggggcagaccttggtggcagctgtcggggctgactccttcccactgtcactgcccggcccccgcccagccctcccctcccttctctgtgcaggcctctcccctcccccgcatctcctcctgggtctcacccccaccaacagcaccatctctctggtgtatctggtctgtcccagccctgtgcccccacggtgccctctcctggcccctcttgttggcgctgctggccacagccttcccggggtgggcagtggcaagttctcacttatgaggcatcgctgtcagaagcatttagtgtacaaattagccgtggcctcctcgcctccttccacagctctgggctccaggctgactgggccgcggctccaggccctctcccgcctgcccggggcgcactgctgcccagtgtggacccctggctgcctgcccatgtcctggcaggagtgcccgctccccactggccggccagggctcctctaggaccccgacctagacctgggcaggggtggccatggcaggccgggggtgctcagtgaggttttggggggtgggaggccaaggcccaggacccggatctaccccaacagtggccagccctggtgctgagggctatgggggggctggacatggggccccaccaccccacctgccagttggaggccccgccaccccgcccgccagcccgcctgccactcaggcggggaaaatcatctgtgacaggcccaggaaggccagccccgggggccgcagagagacacacacagctcctcttcccaacatatggctgctgtcggccccgggcgctgctggccagtgccaggctcgggagccggtgggggctcgagcagcctcagcctcccgtcccacccgcctggctggctgccccctctgtcagtctacatcccagcctcctgggacggggctcactcccaccacagcagctcagccctccaaggagcgtcctgtaccctcctccgtcccagaggctcaggacacacagagggtcagccccgcacccggcccagggtggccagtgacccggcacgtctatgagagtgtagtgcatggggaagggcccagctggggtcttccagagccgggaggcgggtggggaggggactctctggtgtggactctgggatggtcagggctgctggggaggactatccctggtagtgctcgagccggaagactcctggagcccccattcaggcgcctcctaacagggcccccgttccctcaggtggatggacccagggaccccagagctccgcaggctcttcgtgtgccccccacacccttgggccgttgtcctgggcgctctggcccactcggttgcccagccccctccgttctcccctggcacccccactgtgtacccgcccatcaaggccagcagcctcaggctggtgccgagggccctcacgtgtatccatgaccccttccgccaaggctgggctgcccctctcaaccagggatcctcaagtgggcagcaaggaggaagcccccaggaggcctatgctctgtagacctggggttcttgaagtgctcagggtggccacaggccctggggtccgttattgaaaggacagacatcagctgtgtccggacaccttgcaaggtactgaccccacgtgggggctccaacctgctgccgctggatagattgccccggtctcaggacctgcgtggggcctccagcctggctgcagccctgacactgccctcactgtgtgggtgcaggcaccccggcccctgcacctgtcctgacactggctgtgtgtcgacactgaggggatgagacaggcctgcccccgggcactggccatgccgagcgctgcctccgctgccttctctgagcccagctctccgtcctgcccgtgagcccccggcacagagtcccattgttaatggaggtgacaggcgggcagccgtgggcagaccgggcagaagaggttaatggccaaaaatgagcttctggctggaggcagaaggaggggccatggggtccccatcccaccctgcactgggactggctaaggagacatcagggcacccactaggaccagagcagaagtgcccggacactgagcaccccactgcccattctgcagatgggggccatgggccagaaagttgggggggtgggggcacaggtgccaaaacagagtcccagtcactgcctcaggaagcagaagccacctctccaaacccaaagtcagcccagtgtgcaagagctgggaccaagcaggtgggtcatggccacagtgaggaagctgacgtgcccagggggccctgtggttgcggggtgctggcactgatatcccggcctcgcctggctgtttgtgatgggaacagtcatctgggcacccagtgtactggcctcacatgctcctcaccccccacctcgtgcacggctgaatctcaggacccccaccagcaggtgcagggccccctcatcctccctgccagagtccttccgggaggccagaaacacgtccaagttgtgccccggggcccctctcgaggctgcccctcttctcttctcatgcaaacttctgcaaaggcccatcggtggtgaggggtggaggtgctccttcagcctgctcagcgctagacacggccttgttccccctctggggctccttggtcccctgagcttcactgggctttatttcctgtatgctgacatctaggtgctccaagaccaggcctccctgctccctactttcctcccctggacaatggccagagcctccagccagttggtctcctgtgctgtcagctgtggcctcttccagaccttcaaaggggtcagtctcgggctggccactgagggactactggtgtcagggtgaccttggaccctagtctcccggggcagtgctcagctgaacacgtccagagtagagtctatgtacagaagcagccggcctcctggcccccgctctccacggggctgctggcgtgacggcagcccaagctgtctcccggcccggagctgcctgcacggtcagctggtcagctgggccaggccaggtgggcagagagaaggctggcatgctctgccatccacagcacccctcccagtcccctgccccgccccagggacttccctcagacgggcgtgtgcggctgtgtcagggaaggtggcatggaggcaggagggagacagagccccacgcccaccccagaaccaggggctgttcctcatggaccctgggtgtgctctaccagggggctctgccagcagccggaccggggccacggagatgctgctgagctctcttctctgccccattcgaggggtgacacccagaagccccgtggggtcctcccttcttccccaaggcacccctgaccccgacctgagctggggacagcccgggagcctgcggctgagcctgcagagagccccaggtcctggggagctatgtgggccgggctccctgtgctgtttcagagtcagcagggagtagcacactcccctctggctggagaccccgagacgcccgcctaccgcaagtgtcgggtttaggacgtctcccctgagcgaagtcaggggctctgccccagccatgcctgtgtccgggagggagcaggccggtcaggcgaacctcccctaggccccagctgagcagtggggctccaggcctttacgttctggcagctcagggagctgcttggaacttggtgcagcccgggaggtggggctgggagcagccctggccctgcttctctcctccaccgccccaggtcctctcaggaggggactcccgtggggagggggtctttcaaacagcagggaagtgcgtggcctcgtggggcagcgctgaggcacctcccacaggagccgggagtgagggctggaggggtccgcatccaggaagggggagggtgctggagaccagccccaggtggaggcggtcagccggcagggcggggtgcgaggggccggtccgggcagcctccggtttagaggaaaagagaacggagggcagggctcgcccagggagggcaaggaagggagcccggctccgctggctcagtccgcggcacccctgtcccccaggacagcccccaggggccctggctcgggtgggccggcggctgtcaggggccagagccctgatggataagcgctgacggcccctctcccgcgccccgcgccgctgacacccatcacgccgcggcggggacccgggagacctggcggcctctgtgcacccccgcggcagcctgcgggcaacgggggcgggaggcgccgggcgcccctgactcggccgcacacctgcgccgcagtccgctctccgtccgctgcctcccgggttcccggccgctccaccgcgcgccccgagagctgagccggtcccggcgcacgaggccggtgagtgcgcgccagggggcggcggggggcgcgcgggcggcgggggcgcggggttcgggccgggggctgctccttccctcccgccgcgagcgcggtcggaggtcgcagcgccccccggagcccggagcccaggcgcacgcgcgcccgcctctgccgccaacttcgggaggtgcgagcggcgtcggggggacgcgggcggcggcggaggctgcgggagtcgctgccgctcgagggaccgcggacccgggaggtccggctcccggcgccgggcctcagtttcccccacgggagccgcatcccacccccagagccccagcgcgtccgcggggtccgagtcgcggccggcgcggggcggggaggggcgggaagtttgcgccctacacgcggcctcgcagacttggcggctccgctcccggccgggcgcaggtaggagcggcgggagccgcgggggcggccagttgggcgtcgcggggccggctggacgcggggcgcgggggcagcgggtggccaggcgtgtggggggcgcggggggcggccgggtcccccccaccctcttctcgaagtccaggagcagcgcggggggagggagggccgccctcaggggccaggcggggagggcaggggccgggtctggggtctggggcagacgcctgacctcgcgctcgccgcacccgcctgtgtggggcgccctgcgttcccgggggggggggcagcaggatctgcgggtggccgatcagggtccccggctgctgggtgccccctcctgccctgtgggggtgcctgtgccccccgtgccaccggttctcccccagctctcccccaaacagggacaggtgagtggggccgggtgtcggggcctggcacagggctgctggctgccccgggagcgattgccgggtccggctgggacgcgcgtgtgagtgcgtatgcgtttgtgtgtgcgtgtggctgctgtccaggggtgtcttttgctctgtgtacacacaccaggtgggtgccagctatcctccgggtccccaaggggtcagcagctgctgagacagccccttggacaagcccctgacccgggagcccccggtccctgctgggaggcgggatgggttgtggcatcggctggcacagctgtgtggctcccagggctgggtgatcgatggcccggcacagccgcctctgtcgccggagcgcccacacccatttgtcatccacatgggtggggggggcggcgggcagggagaaggggccgcctctgcacccaccacccagtccaggccgggtctgcagcccctcggggagccccaggacctctcctggcccagcccctgcctcccgaccgccaccctgtctcagccacagaccagctggtcagcctctgcctgcccctgcagcccgtgactgccctgcagggccccaagcctttggacgagtggacttctccagccctgttggtcgtccccccaacggcaccaacacagtgttttgggggcagcagacagcagtgccccagccctaccctgctcaacccactggccatgcatgaccacgggtgcgacccccagccaggtctgcgtgtgtcctggggagtcggtgtgtagggcctgtgtgagcatgtgagtgccgtgttggagtggtttggaaagcccccccacacctggatgggtggtgagtgtgttatcacggacaagcagccgtgttcaccgtgatggagtgtgaggtgtgtgcagccagggccccgcacttggtggcagactccgttctgagcttaggtggcacagaggtggcttctccgggcactgggtgagggctctgtgtgagcctgtgggctgtgtacacacacccaaagcccgtgtgcgcaggcgtgctgtgcaccccacacaggcgcgtgctggggcggtggacagcccaggtggcggcccagatggagtgtggcgcgcataccagcgccgtgtggggcgtggggaggagcgggtcttggctgagtgtggccgctgcaggctcggccgctgacctgcccgaagccacccagatggagctgggctgagcaggtggctgagccgtggggccatgctgggacgtccactccccacagcctggcctggccccacatgagactgaccccctaagagacccccagtgcccacctgacgccctgctagagcaggctctgtgccgcctttagacacacacgcatacacacgcactcacacatgcatgcatgcacacatgcacacacaatgcacacacgtgcacatgaacacaagcatgcacagaggcacatgcacacacaggcgcacacacgtgtgcacacacacgcacatgcacgcacacacacgtgcatgcacacgcacacatgcacacacacagacacacacaggcacacacacacacacgcagcatcatcccacacagacccttccgttggtgtctcatctcagtgccttttcctaggctttgaacaggcagattggcaggggccagggttgctggagggaatgagaccaggaggctgacgtccacccgaagtgagctctggtcacgctgattcttttagccactcacatgctgtggggagatgggtgtgggctgaactatcctagaaattggccagcaagtcggcctggcctcaggggtggggatgtgtgtagggtcaaccgataaaataaaggacgcctagttaaaatcgaatttccgataaacaatgaacacctttctagtgtgcctttccaatattgcctaggctacacttaacactcagaaatgacgtgctgctgatcggcgtcagatgcagctcgctgtcctggacttttttttttttttttggtgccctggactttgctgccaccctggaagtgcacgtggggaggagccgaaggatggggctcggggggcacgttgcagggcagaggcggcggggtggggggagcacccaggctccagtccctggagcctggggagccatggatggagaggagtggggagttagtcagaggcaggcttggcactgactgtggccccatctacaggtggccatggtgcccggccctgcctcatagcaggctgccatgtcgcgggaggcgggctcatgccgcgtgggcacaggggcgagggcgcggtctcggaagcccaagaagccacactacatcccgcggccctggggcaaaccctacaactacaaatgcttccagtgccccttcacctgcctggagaagtcacacctctacaaccacatgaagtacagcctctgcaaggactccctgtccctgctgctagactccccagactgggcgtgccgccgtggctccaccacgcctaggccccacgcacccaccccagaccgccctggggagtccgaccccggcaggcaaccccagggagcacggcccacaggtgctgcccccgcgcctgacctcgtggtcgccgacatccactccctgcactgtggcggaggccccaagtccagggccaaggggtccccagggccaccaccccctgtggctagggccacccggaagggtcccggccccagtgggctcctgcctgagtcgtggaagccggggatgggaggggacccaaggggcgtgggtgcgggggacatggcctcagcaggccctgagggcagcgtcccctgctatcccccgcctgccccaggggagttccctgaggcccacagcctccacctgtctctgctgggcgtcaactacccgctcagccccggcctcttctcctacttggggccctcactggccgctgcagcccatgtgcccttcctggcctcggccagccccctgctgcccccggccacggccttcccagccgtgcagccccctcagcgccccaccccggccccccgcctgtactacccgctgcttctggagcacactctggggctgccagcaggcaaagctgcccttgccaaggcccctgtctcccccaggagcccctctgggactccggctcctggcctgctgaaggtgccagttccagggctggggccctggccccgagtcacccccagggacccagggcaggagggggagctggagcgggcagcccagagtgaccccaggaggaggctgtccctgggaagcaggctggagcttccgaaggcatcccccagcctgacaaggttctgttcccggagcaggtgggcgtcttgggctcccggttcctggggtggacggaggggctgggcggctgggcatggcggttgggcggctgggcatggcggctggggtccgtcctgagctcagtcgctgggaaagtgggctccaggccacagaggggaactgagacccgagagccagcgcgggggtcctcggggtctccaggagagcctaggctctaggctggggccacagggcagaggccgtgaggggagaggggcaggggccgggggcgctgtgggggcagtgcggcctcctgaccagcttccaccccacagcctgcccaccggctcctctgtgatgctgtggcctgaggacggggatccaggcggccctgagacccccggccctgagggccccctccccctgcagccacggggcccagtgccaggaagcccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatgaccctgtcattcctggcagtggctggggcacctgtgttgcgacgaggagttcccagacccctgaggctgtctgtggcctgcagagcccccagggcgccgaggtctgacctgcagcgcctgaggtctgactgtctctgcctgcagcatgccggcccctctcctgcagcccctgcccctcacctgcctgggacctgccccgcctccgcatgcatgtggatagacccccacgggccgtggccaacgcttgtccctggggccacacagggacactggaggtcacagttatttattgatcacaattgtggacattaaaacagaaactgttcacacacgccgtctgtgcctccttcctttggggccctagtgtagccacctggacacccccctaaggaagtgtcctggcctgggaggcctgggtgggcagcagtcctgctgggcctctgtcttcagactcggccctctcctgtgggctgggccctccccgcggggctggggtctgggggtggggcgggacatcggcgacgggagctgagccaggagagccgtgtggactgggctgctcggcctgtgtcttggtgtgtcgggggtggagaggcgtgtggactgggctgctcggcctgtgtcttggtgtgtcgggggtgggcacggacccctgaacatcctctagcctctgaatccagcaaggccgcgctcatatcagctctcctgcggttaaacggtggccccggggctctgtggctggaggctgctcacccagcgtgggctctgctggcccctgccagcccctgcagccgtgataggtatcagccttcacagctcactgcctccctcccagcagggcctggcttggccctcccacgggcaggggatgggcagacagggaggggcacccgggacccccacagcaaatcacttctctcctgggagagctggccacaccctccacgcccaccctggaatgggctctggagcccacatcgcccccccaggaggagaagcagttcctgcctgcgtccagccgggctggggccagtccaagcaggctggcagcggccccattaactaccagggagatagcatcagccccgaccctgcctcggggcagctagagctggggtgctgcctggccaggcgcggagtgctgtggggacaggtcccagccgggcccctctacccagaggcttcctggaggggctgcagggggctctgggcagccaggaactgttcccaagtcccgagtctgagggagactccctgtcctcagcccccgccccccatatgtccactgcaccccatatgtccactgcacctcagtttctcacccccactgagcagacaggtgagcatggccttgctgggggcaacagcacccgtctcccaggtgtggagacacgacctccttcgctgtcacccgtggggagcaggacaggcctcatggagggtgcctcagccagcaggtcacccgcctgtggtccagacccaaggaccctgcttgggggtggcagcctggggctgccttgccacttggagtaatgaacttgctggttgtggggggaccatgggggacccctggaggggggtgggctgcatggcatctggccgtgtaggggacgtgggaatagtgtccgggcagagggcgcagcctgcaacaaggcgcggaggcaggaacaccacagcatggggagtcctcaggggacctggtttttctttcatagaagcttcaggggccaaggccggagactgcactctccctcctccacccggcccagctgcgtccctgccagtggctcctcccacttcctccagttctagtttccaacaacagaggctgcagccacccagccccgaagcagggcccagcgagacagggcccaggtaagagacccctccccccggcctctctcggtggggcaggtggaggccctcggaataggctgcctcgcccctaaggggtcagaagtctccctgacctaggggctcgggtagaagggctgtgtgtgggtgaccgcccccccgccgtagaaaggggttccacaggcagatggatttgagaaatgttgcttatctgtctgaggcccatgagctcatctggggctcaggggaaaacccacagcgagctccacgggtcatgtgtctcccagactcaagtcccaggcacctagacactagggtggccgctgggcttggtggccaggtagaccctcaggaccaggaggacccggcctcataggaagaaactggaggagtgactttgccattcccacacacagtggggccttattctctctcttgcagccccaagcgtgacccagctgcagagaagctgagacggtgattcggactgactggactctggcctccaggtgtctgcacctcacactggacccacctggagactccacgggctcccggcagctccggctgcttgggtggatccgggtgcccgcaggggctgtgggagggccccggggcctgcactgctcccccgatggcctgctcttcctcacggccggggctgcaccctgtgtccacgtgctagatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctggggctgtgcacagcttctcgttgggtcctgcttgggagcccctggccccagcctccatgctgggtctggagggcccctgctgggtgggcccagggcctgatgggggccttgctgtgagtgaggagtttggggatgtgaggctgtttggcagtgcccgccaacccctgggctccctggggggctggacggggcacactttcggctgcccagcgggcatctgctccaactcagagggcaatgttattgtggcagacgagcagaggcgccaggtgaccctgtttccccgggctgggccacccatctgcctggtgtcagaggggcttgggcagcccttgggagtggcctgtgcaccccagggccagctcctggtggctgatgccaaggacaactccatcaaggtgtaccagggcctcaaggagctggcctgacctgaggctgggttggagcagccctcctgtgcctgaggccagctcccaggcccttggatcaccgcgggaggaaccctcaggatgggtggagcctccaggctatgggcattgcctgcctgatgccagcaccacctgggctgggccctgggcttggctcgagttctcctgctggtgaggctccggatctcaggagcagccctgagtctgcttcccaggctgcccctgccaggcctgcagcctccccagccagggctgctctctgctgtccccattcagtgccctggcccctgcattcatgccccccacaccccctcaggccctgtgcctggactttggggctggcagctgaagccttgagatcctgggccagctgccggcacacagctaggcagactctcccaccaggtgcccctgcccaggcctcctaatcgggggcagacaggcagggagggtgtggctgggctgggctgggcggggcggcctggggcaggggtgtggcccctaaatgtccccaacctcagagggacctagagtcctgagcctccagtagcttctctgggcctggcagaggtaagggggaggcaaccctggagtgtctggaggcccatggctggctgaaccctggatgccttttcttccgcgtccccatgaatgaaagctgtctgggccttcattctgcagacagggacaaacagctccatgctgtttgtcctcccagtgcagccgtgctgggagggtctgggggagcttcctacaaggagagactcctgctgctttggaaaactgagaaaaaataggggtctaaccctctcctcccattttacaagtggggaaatgaggcgtgaaaggagaggcgtctgggttactccgtgggtctggggtccagggaagggcctgtatgggggagggagctgggaggggacggtgtctggctctacccctgtggggtggggaggtggggctcccctgtatcacaggacatcccccctgagaggtccctcatatgtctgggtcctgtgggtgggggactaactgcgcaatgtagttaggtgctcaataaacggagttgccgctgaggtctgggctggggtcttgttcctgggatcgggaggggctggacgcctgtgtgttctctcctgacgatcgctggcggcagcctctgggctggtcctaccagggctcaaaattcccggcaccactggccttggggatctgggggcggcccctctgcagacaacagagtgacgggggcgggaccgggctggggctggggccttcctggaatcccgcagggcctggggacctgttcacttggggaggctgggagccaggcggggtccgggttccacgaaggccaggtccagtcagtttctcaggtgaggaaaccgagctgacgcggggctggcggcccggaggcaggctcgggaggtccgggcctggggactgggcgggcacgctgcgccgcggaacgctcgggtcgggcgggcgggcgggcagcccgggcgcctttgggggccggaccgtcgcgcggcaacgcgcggagccggcggaagtggggctcgggtcccgcggcggggctggaggcagcgagcgccgtcgtctgcccgggcccgcccatcggggtccccaaccccatccggaccccgccgcccgagcgcgcggccccggaagcacccggtgagcagggggggtgggcggcgcgcggcgggacctcgggcagcgcccctgcggctccgggcctgggctgggggctccgcactcccgcccgcggcgccgctgctttctcctcccagaagtggggccgcccccgggcccgcgccgacctgggcccctgtggaccctgtgcaagggcggtcggcggcccgggcctggctgtgggcccttcgcagttgtcccggtttgcaggaaagggcaaaaaacggaatcgtaggctcttcccaaatgagaggggaaggccctgcttgaggaaggcaagcaagtttgtttgtttgtttgttttgagacggggtctcaccatgttgcccaggctgaactcgtgtttgtttttcattatttatttattttgagagggagtctcgctctgtcgcccaggctggagtgcaatggcgcgatctcgggtcactgcaaccgctgcctcccgggttccagcgattctcctgcctcagcctccccagtagctgggattacaggtgcccaccaccacgcccggctaatttctgtatttttagtagagacttggtttcacccccatcgaggctggtcttaagctcctgacctcaagtgatccgcccgcctcggcctcccaaagtgctgggattacaggcgtgagccaccgcgccaggttggtgtttatttttcaaacaaggcgctgggaaacgcaaattctccagagctcttgtggagcggtggcagggaggggcggctcagccagagatggccctggcccgtcctaactgggctggggtgcccccattccctcattcacggggaggagagggaagtcttagtcttactactttatatggtcgacctccctacctgcctggtctgggaatggcttctcaagagcactcgggctcattcttagcagaggaagctcttctggctagcctggcgcccgtgtgtgtgtgtgtgtgtgtgtgtgtgtgtgtgtgtgtgtgtgtgtgtgtgtgtgtgtgtgtgtgtgtgtctggctagcctggtgcccgtgtgtgtgtgtgtgtgtctggctagcctggcacccgtggctagcctggcgcccgtgtgtgtgtgtgtgtgtgtctggctagcctgtgtgtgtctggttagcctgtgtgtgtgtgtgtgtgtctggctagcctgtgtgtgtgtgtgtggctagcctggcgcccgtgtgtgtgtgtgtgtctggctagcctggcaaccatggctagcctggtgcccgtgtgtgtgtgtgtgtctggctagcctgggacccgtggctagcctggtgcccgtgtgtgtgtgtctggctagcctgtgtgtgtctggttagcctgtgtgtgtgtgtgtgtgtttgtgtctggctagcctgtgtgtgtctggttagcctgtgtgtgtgtgtgtgtgtgtgtgtgtgtgtgtctggctagcctggcgcctgtgtgtgtgtgtgtctggctagcctggtgcccgtgtgtgtgtgtgtgtgtgtgtgtggctagcctggcgcccgtgtgtgtgtgtgtgtgtgtgtgtttcctcagtctttaaagatgctcacgttgctttctcccgtcccatacctcctctgctatcgatcgcttctctttcatcttcctctggctgtgtgatcccagcagctgctagtgcaggcttctttgtgccgccgaccgtcccagaggctgaggtgggagtgtgatgggcgtttgccccacagtacgttgagttttctctcactactcgacagagaagagtagcttctgccctcccatctccttcggtagacacaaggcactttttttttttaaggtaaactttgtagatgaagcacaaagaatacacacaaagaaagcgcacagatcgtgagcacgtagctcggtgaatttacccaaagtgagcccaccgcagaaccagctccccctagaacatctgtttactgttagacccattgtgtttcttttccgacgatatctgtgggcagttttccttagtccctgtgaaagctcttccccagcagggcgtgatgggtccctgggctgagctggtgtgaaaggtgggctgtactgggtggtcccctatggtggtcacacagccagacacgctgggccccttgcaggcagaatcactttgtccctctcacgatgtccttggtgcctcacgtcagctggcctccaggcatccacccgccgcctgccctctctgaccactgaggaaatgggcatttgaggagttctgcagcctgacccagaaggtcccttttcagctagaacccaccgccttgagtgactggatcctccagccccagtgcgggctgcctgcaggggaggagagcagctgcaccaggggcctcttaagccccaggcatttccgtgtgaggcctcttccagagcccctccaagcttcgggagaggacttacaggtcacaccaccccgacgtgtgcatcctgctctgttccctcgtccctaaggatgtggtgggctctgagacctccaggcatcctggtctgttccctcatccctaagggcgtggtgggctctgagacctccaggcatcccactctgttccctcgtccctaagggcgtggtgggcactgggacctccaggcgtcccgctctgttccctcgtccctaaggatgtggtgggcactgggacctccaggcgtcccgctctgttccctcgtccctaaggatgtggtgggcactgcgacctccaggcgtcccgctctgttccctcgtccctaagggcgtggtgggcgctgggacctccagacccaggctcaggccaagctatgtccctccctcgagtgtggctccagcgtggggggtctctgctcagggtggccgctccactcttcgtgcaggcgagatggggctttctgtgtctgaggaaggcgagcggcccagccagccggccagtagtgcccccaccgctagggagtcctcctgccctgtggggccccgccagggaaggcatcagtggagaaggagccccagctggctgcatggctccgcaggggcctgtgagaaagggggaggagaggcccagggcctgggaaccgcggtagctcaggtggcttcctactcaacagccaccttggaaggctggtgtccctcagcctgagagtgcaggatgcagtttctccacacctccgggacctgtaagcctctctctccccgtttctaggcacccatgtcgttggagaaatatatcctggagagaaaatgctccctgagggagccctgccctggggtggctgtggggatgtcagggagggccaggcactgccgggtgccaccgtgggcgggggtcagagtggaggccgaagccctgtgtgccctgagcaacgaggcaggtccttcctgcccccagggaggggcttgtgggaggcagggaccttctggggggctgcccgccgtgcgcacgaggtagtttccacagcccagcagcacatcattttacattttcatctttattcttgcttaatacgtgaatcatggtttgtcaaggtttcaattggcgtgaccttgctaatgagattgtacagttctcctcgtgctacacctttaagcacacctctctaatcaggtttcttaaaactaagaagcctggagttcggttcggccccacagccgcgtcaggtggtgccgaggaggccgtgccctgggccggcctggaaatgggagggcaggcctggtggctgcatgtgcgtcctgcctcgtgcgggtggggctgagctgggcctggggtggacttggggccagcactctggctgccccttggagaagcatggcccacgcgaggcggcagccaaggagccctacggcgtccaccaccgaacttgaagctgaggtgccccgacctggggccctgtggctgcacctgtcaggccgtctgtgcaacatcccgcagcccacggtgggggggcagcagcagctctgagccgagcctctcctcttctcttccagcctcccggcatggtgctcaaggccttcttccccacgtgctgcgtctcgacggacagcgggctgctggtgggacggtgggtgccggagcagagcagcgccgtggtcctggcggtcctgcactttcccttcatccccatccaggtcaagcagctcctggcccaggtgcggcaggccagccaggtgggcgtggccgtgctgggcacctggtgccactgccggcaggagcccgaggagagcctgggccgcttcctggagagcctgggtgctgtcttcccccatgagccctggctgcggctgtgccgggagagaggcggcacgttctggagctgcgaggccacccaccggcaagcgcccactgcccccggtgcccctggtgaggaccaggtcatgctcatcttctatgaccagcgccaggtgttgctgtcacagctacacctgcccaccgtcctgcccgaccgccaggctggagccaccactgccagcacggggggcctggctgccgtcttcgacacggtagcacgcagtgaggtgctcttccgcagtgaccgctttgatgagggccccgtgcggctgagccactggcagtcggagggcgtggaggccagcatcctcgcggagctggccaggcgagcctcgggacccatttgcctgctgttggccagcctgctgtcgctggtctcagctgtcagtgcctgccggtaggtgtcccgggacaggcaggtggcaaagagtggggtcccatgagtgctggcccatccctttgtctgcagtgggcacagaggcccagatgcgctcttcctgggcccgggccccctcccactcctgcagcccgggctttggccccatcctgctctcccaaccctcgcctctcagagggtgtccctcacccctggggtagagccaggtctctgggcagcctcagggattgccaggggccctcccagaaggtgtagagggtgaacctcagtggcttaggtccctgaaagagaaatcagaaggtgagcacagacatgactactgctgcctgggggtgctcctgagggcacacaggcccgctggcctccctgtagccctgcctgtgcccccagcaggcctctggacactgcagcgctcatgggctgtgggggtgtcatccacttgctggccccgtgtgcctgggggagtggtctacaggccctgcttctctccacaatcacaggtgctgctggccaagggtcagttgaagcccaagggccctgaggggcacgggggtagccccgagctgtggctgagaacagagggcccccttccacaggggacctcatctgcctggcggaggtgccccatggggagcagctaggggtcacctgcagttgccccctgccttagacccgggggtgcatactctggaagcctggggtgagaagctaggccagcccaggagaccccgggcagctttctgggccctgtcggcggggcgaggccctgggcccgtgggagttgctgctggctggcaggcgcttcttggcaccggctctgggagcatgtggtgaccaggtggcccggggtcagcacctgcgaggaggccaggctccgtgttagtcacgtgcactgtgaggtgggcgcgttgagcgctgcctaccaccacctgggccaccgagggcccctcccacctgccccctgtcctgctgagctcaggagtgtggcctgggtgtttgtggtcccctgcacagtgggggacggtgggaggaggatctggagagggacacatcactcctctccactcccacgcagagtgttcaagctctggcccctgtccttcctcgggagcaaactctccacgtgcgaacagctccggcaccggctggagcacctcacgctaatcttcagtacacggaaggcggagaaccctgcccagctgatgaggtgtgggcctgccctggtctctgcagggctgggtgcgtgccctctggccccttctccatccccctctgcaccacgctgacccctccggccaggcaggcctcctcctgcggccccaggctgtgctggccaccctcatgccggccgggccggacctcccttccaggaaggccaacacggtggcctctgtgctgctggacgtggccctgggcctcatgctgctgtcctggctccacgggagaagccgcatcgggcatctggccgacgccctcgttcctgtggctgacgtgagtggactggggtggagcccggtgtcccgggtgggcgtggggacccctcctgggcagcagagccttcccgggccagagccaccgccccacaaagccagttctaccttctccatgctctggagacacggccctcccctgaaccagaagcaggaactccaggggcgctggggcctgggcagggcaggcctcgcaggtacacccccctttccttctgaaggggctgtgtgcaggagccagccgggctgaggctctggggagcccgcctctccctgtgggcccagcgtcctggtatctcccttgtggtccctgagatcagcgttgccctcctggctctctggggccctctgcagagccagggtcatgaaacctttcctgtccagggaggcccatgtgcagcccagctgggacttcctgccctgcccctgtgctgattctgtaactcctgtgctgagagccagaggcacagcttgtctcccatctcccaccttccctgcatggtctgtgccccgtttccagccgggtgcagccccctcctctgcagatctagtgcatttccatgctgcctctgggccttcagcttctctgtcttcctccctcagcaccaaagccccgtctcttccattaggagcttgtcttcctgctgggggtggtacctgactctttggcccaccctcgggcctctgtggaggcctccttgaggcctgactgggtgggtcttgtgtgggctgcaggtgtgcactgggcctgcttgtggccaggccaggcctctgggggcagcatcaggcacgtctgtgtggctgtgggggtgcagggagctccagcccagaaggaaggaggggcggggctggggaaggggctcggcagctttgcctgtggtcgtccgcacctgccaccggcctactttgtcctagacctcccttttgcaaaagtgctcagaaatataaatatttaatttaaaaatgaaagtctcttcctgctgccaagctcttatcctttaaatattaaataagctctatttataaagaatgttcttttctcagccgggggtggtggctcatgcctgtaatcccagcactttgggaggccaaggcgggcggatcatgaggtcaggagatcgagaccatcctggctaacacagtgaaatcccgtctctactaaaaatacaaaaaattagccaggtatggtggtgggcacctgtagtcccagctaattgggaggctgaggcaagagaatggcgtgaacccgggaggcagagcttgcagtgagccgagatctcaccactgcactccagcctgggcgacaaaacaagactccgtctcagaaaaaaaaaaaaaaaaaagtgttcttttctccttcttgccagtcctgctgtggctgaggccttggcccaggcttggaaggggcctgcgcaatgggcaagtgggggccaaggtgtcactcactgtctccttagtggggaggctgaggctcccttggggtctgcccgctggggcacagcctctggatgctgagtttcttcctgggcggccaagaccctgcttccctgtttgctcttgggggtgcctgtgccctcaacttgacgccatcctccctctggggacctgtcctcctgcctggtcgctgtggccctgatgggcttggcactgtctcgctcacctgtggtcatcccgggcagcccccagcctctgcgatggggtggggcctctggaggggactgtgtcagctgtgggcttccctgcagggctggagccgaatcagggtctgccaggcctcagtgcgtccacgtgtttggggccgagggctccagtgggtcctgtggccgaggtagtgagaggggaggaagatggtagaggtgggtgcaggcagggggccacgcggatgccctgtgggcccggccatgtcacccaggcctgcagagagaggcctccagaccagcctcctcagaccccaatcccggagccatctgtgaaggggagcccgtgtgctgtccacgctaggacgcggtagaccctggaggagggaaggctggccaaggtgggagcccatcacgaaagagcctggggagatgcaggtgctgagcctggctgcccccgccccagcgtggcccctgtgtccctgcagcacgtggccgaggagctccagcatctgctgcagtggctgatgggtgctcccgccgggctcaagatgaaccgtgcactggaccaggtgctgggccgcttcttcctctaccacatccacctgtggatcagtgagtgcagggcaggcgggggccccagggaccccagagcttgctgaagagggtagggacccagccagaccccgccccctgtgcccccaactctgctccccagcgtcctgtgtgtgtgaggcctgctgtgctcagctgagggctggggcctgggcacctcccgagggctgaccccaccctgccaggctacacgcacctcatgtcctgtgtgtgtgagggttgtgctgggccgagggctggggtctgagcgcctcctgagggcctaccccaccctgccaggctacatccacctcatgtcccccttcgtggagcacatcctttggcacgtgggcctctcggcctgcctgggcctgacggtggccctgtccctcctctcggacattatcgccctcctcaccttccacatctactgcttttacgtctatggagccaggtgggcgtgggcttccccctccccaccgccccctgggaggtgcagaggctccggctgggcgggcgttcgagtggggcgggggcggggcggggcggggcggggccgggcccgacagcactgcgtcctgtaggctgtactgcctgaagatccatggcctgtcctcactgtggcgtctgttccgggggaagaagtggaacgttctgcgccagcgcgtggactcctgttcctatgacctggaccaggtatggggcagggttcgtggctggaggggctgactgcctccggcctgtgcccgctgggccagcgcggtgcttgggcaccacaagggggcagcctgctcccgtcctgcagctgaggccgcgcacaggccctgggaatagataagtctgcggtgtgggctgcacgtggggctctgaagcagcgcagagcttccctgggccacagagaagagacagacacacagccccgaaggtggtgcaggcacaggccctagaggtgccccgggcccagagactagagatgccccgggcccggagactagaggtgccccgggcccggagactagaggtgccccgggcccggagactagaggtgccccgggcccggagactagaggtgccccgggcccggagacttgaggtgccccgggcccggagactagaggtgccccgggcccggagactagaggtgccccgggcccggagactagaggtgccccgggcccggagactagaggtgccccgggcccggagacttgaggtgccccgggcccggagactagaggtgccccgggcccggagacttgaggtgccccgggcccggagactagaggtgccccgggcccggagactagaggtgccccgggcccggagacttgaggtgccccgggcccggagactagaggtgcccgggctcggagactagagttgcccgggcccgtctgctgctcacacttgccgcagccgctggatgctgccatgcagagcatgttcttggtgactgtgtggccacgcaccgtcttgggtggtctggcccccacctgtctccctgcgagtcccctagtccgtggggtgtgggtggacagccctcctgctactgggactgcttctgagcaggccatcccgagttccctcaggaagccgcaaggtcccgactgcagctccgggatgggggagggcacagtgctgggccgtccctgggcgcggggtcctgctgatgcccggtgtgctggcccctccctacagctgttcatcgggactctgctcttcaccatcctgctcttcctcctgcctaccacagccctgtactacctggtgttcaccctggtgagctgagcacccacaggctgggcctggctgcagtgctctgtgtggcttctgccagcgctgcctgggagcagtcagctgtggggcgggctgtctcctgctgcaggccacgtgggtggcctttcaggaccctctgggcagtgagtgctgcgctctggagtgggcgaggccctatcctggccagtaagacaccctcactgccctggagcacgcagctgggtgcgtggtggaaggaccccacggcaggtggggtcacgcaagaggcctcccctggtgcctggcactggggcagacagtgggaggtgagcagaaccacctccagcacctgcttgattcccaggcctcgatcccctctgcatgtgaggctgtggggaggcacctctgacctggtgagagggccgggtgctccgcctccagctttgctccagagcaaggcccaatggcagactccgtgccctgctcagggtggggtccctgctctccccaggaccctgcagcctctgggcccccttcatcgtggcccaggatggggtcggactgctctgcccccaggcgcgtctggccgggccggtcctaaatgctcctctgccacagctccggctcctggtggtcgccgtgcagggcctgatccatctgctcgtggacctcatcaactccctgccgctgtactcactgggtcttcggctctgccggccctacaggctggcgggtaagtgctgcgtattgggcagctggccctgggtaggtggaggggaaccacacctgtgggccctgcagaagcaaggacagcatgggccactgtgcctccagcctggaagccgtggtatgcatgcgcaagcgggcagggaggacagggcctcctagtcccagaggtctgcaggaccagctgcctccagggaggtggagagagactcagagactcacctgccgcgcaggttcagaaccctggagacctgaggccacaggcctttgttcttctgccttgggattttctgggcttgggagtctgaactgcaggccaggggccaagcgcggcaaagtcagaggcactaggagccagcagggcggccaccatccagtaagtgccccgtccgctgtgccggaaaaccccgtccactcaacagcacagcctgcgcccgtccctcactggggctcttccctgcttgccggacacctggcttctttcagtggagtctgcaggaggcttttttttttttgagacggagtctcactttgtcgcccaggctggagtgcaatggcgcaatctcggctcactgtaatctctgcctcctgggttcaagcgattctcctgcctcagcctcccgagtagctaggattacaggtgtgtgccaccacgcccagctaattttttgtattttagtagagatgggggtttcaccattttggccacgctggtctcgaactcctgacctcgtgatcctcccacctcagcctcccaaagtgctgggattacaggcacgagccaccgtgcccggcttttttttttttttttttttgagatggagtcttgctctttttgcccaggctggagtgcaatggtgtgatctcagctcactgcaaccttcgcctccctggttgaagcgattctcctgcctcagcctcccaagtagctgagattacaggcacacgccatcacacccggctaatttttgtatttttagtacgtatggggtttcaccatgttggccaggctggtcttgaactcctgacctcatgatccgcccacctcccaaaatgctgggattacaggcgtgagccaccgtgcctggctgcaggaggctttgatgccggcctggcagccagctccaggagttgggcgacggagggggcggggagagcttcgtgggtggccacggccagcagcacccgggtgcccctcagagaggaaggtacctgcagcctctgctcatgtgtggggccagcccccacgcgtcccctcgtcagccgcttgctatccttgcagctggcgtgaagttccgtgtcctccggcacgaggccggcaggcccctccgcctcctgatgcaggtgaggccccttgtggccaggacgcccctacgctgctgcccctgttctgggacggtggggtcagctgggtgtagtgtctgggtggcaccacgccagcctgcgatgaggtacagggagggcccagtggagctgagggggaaggcccacgcgggaccccctcccccttacccccagggcctgaggacactggtgtggtcctgtggatggggcccattctgccctgtgtcggaggcgcccttggctggctggggctgccctgggccccacagggctcaagttctgggtggaacagaaccgactgagtgagtcctggggtggggtgtgcgtccctgtggcacggcccctcagagttgggcagccccgaggggagatgcagcttctgcctccccccagcgctcccttctggctgcaggctcacttgcctccttgggaactgggactggcttctcccacaggcaagggaatgtctgagacagcactggccctgcctcacaactgcccgcccccaccctctctctgcagacggggttggagctcagaccaccccactgaccgctgcccttgtccttccagataaacccactgccctacagccgcgtggtgcacacctaccgcctccccagctgtggctgccaccccaagcactcctggggcgccctgtgccgcaagctgttccttggggagctcatctacccctggaggcagagaggggacaagcaggactgagggaactgctggctcgcctggcaccaccacacggccacagccagccatctgctctgccagggtggcaccagctcagctggcgcatgtcctgtgctttgtggacgctgctgtgtgctcctgaacacggcaggccctgctatcacaccttgggcttggaggtcattgggagtgagcagatgtgggggtggccagccaggctggccgcactccatcactggcactgcctgccttgggacccgcttcccacctgctgcggtcaccatggtggcgagcacagcaaccccaggtgtccagagcactgccccatgcccaccctgtgtacccaggtccagagggtccgtccaccacagcagccccaggtggagggctggtctccctgggggctccccagtggctctgccctggctgtgggggtggagggaccttgccaggatgaaccccccagtcccaggcaccctctagctccctcagccgaacagcaccctgcatctgggggattgaagcagtcgctgacccccgtccccagcgggcccgggccctcactccctgaaccacacggggtttatttgcggatgttccctggagaggtcgctttgtgaagaaaccatcagcaggctgtgagcatcgccaggctgctgtgggggcgggagcagcctcagtgtcaagggcccgcccactgacccagccgtacctattcgtccacggtgccccgtagcagcaggtcctgcggccaaatctgtctcccttcatgggcctcccagggaaggaggaagccctgctgtgcagacacctctgtggccccccaggagtgtgagtggcctggggagggggccgtggcactgaggccgaaagtgcctgccagacggcacggtctgggtgcgggtgttccctgtgagcccgagtccgcttcaggaggggagcctgcaggtgccggctggtgaggggatgacgcgctgtgggtgggaggaggcagcgcccatctcagcagcaccaggactgcctgggactccctggcaacccagcaccggggaagccgtcagctgctgtgacaataaaacctgccccgtgtctggagcgcaggctcggtcccgggtccatgtgcagcgcgggtccagggaagctctggggggggggtgtgtggacgctactcgagggacttgggctgcctcacgtgggtctgccctgcagagtctacaccggcctcctgctggaggccctgacgacggctgatgggacgggctcacaggccctgggcccttgaggactttggtgtaggcaggtgaacccgggccgcccaccctgggggccgcccaccctggggtcgtggccttgcctcgacatagatggtgcaggggtgtaggcctccaggggtggggcgagcagctcctgctctgaatctgtggactccatgtggggtgggcccctcgtgggtcctggcccagtacagcctgcgactgccacagctgctaagaatggtctctgtcgcctgcagtgctgggggcccagctggcgggccccacagcccgttcccagcccgaagtgtacaggcctccatccaacctggacttccaggcaaccagaggcactcagggcccaccaaccccctacctgtgtcccctgcctccccccagctgcccacctggcccaccacccctcccatctgtactctcccccactcaccctccagttgcctacctggcctaccctgctcctaccagctgcccacctggcctgccacccctcccacctgtgtcccctgtcccccaaagc

SEQ ID NO: 37779 - DNA, 67873 bp, Homo sapiens
gggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatgtcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtaaatgtttatgtgtgctcaaggtcgtgtgtgtatatgtgtggcatttatttcctgcaaaacctgagttagcagaaccctggggtacgtttagctagtgtatactttggtctgcttttctttaacatctgtggcaaggtttcttgttgcagaccagcgaagtttgcaccttcttttagctgggtgagagggcacactggaattaggcaggaagtgtccaggagttaactgaatttttagatcttagtttgaccttttcagttttcagtttttctttttttttttttattttttgagacggacggagtctcgctctgtcacccaggctggagtgcggtggcgggatctccactcactgcaacctctgcgtcctgggttcaagcaattctgcgtcagcctcacgagtagctgggattacaggcacccactaccacgcccggctaatttttgtatttttagtagagacgggattttaaccatgttggccagccccgtcttgagctcctgacctcgtgatcctcccgcctcggcctcccgaagtgctgggattacaggcgtgagccaccgcgcccggccagttttaagcttttaatgtgtctctttcttatttccaagaaactacagattcttggacaagaactatgtcatatggtaactttgtaattctcatagccccaagcacagcacggaacacatagtaaaggctcattaatattttaaatttaaatatgagaaaataacacaaactaacatttttggcttaaagttgaagaggcctatctaaatatagttcagctcctggaaatggcgatgcgcaatagcagggtatttttaggtaaaataacaaggtcttcttggagaaaataacatggtctttttagataaatgtgtgtgaaatttagaggctgccccagaaggctaggtacagtgctgttagtggaagagaagtatgctgcatctgtctttttggaagagaccaaataatggaataatggtgtttcacagcttctttgtttcttgtcttttttcttcatttgtttttattttaaacaggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggtatttgagtgggtcacatttgctaagggagcatgtgtttttcttttaactgttaaacagaaatgtggctttttttagtcaccagatattgaaaagttaatgtcttggtttgtcctcagacgctatttcagttagaggcagcattcctgcattggatatgtttaaatgcctaggaaatgcaaacagcagtttatttacacaaacatataaacatatttgcttgcctacttttattgtatgtgtcaggcactgtcctaagtgctagggatattggtggataatatattttcataatgcttccattttaaagtgaccgtggatattgcaaaaggacatttcaatgcggtgttgattgctgtggtggtgataagcatagggtgctgctataggaacacatagatatttaaattagtcctcatggtggtgttgagtcaagaggtgggatcaagaaaggcctctttaatagaaagatgatatttacattgaaacctgaaagttgattgggagttaactttcgtagagtagtttgtttcaggcagaggatgttgcctatacagaagcttaaagaccagaatatgatgcactgatgtgttttctggaacacagtgtgaattaagcaaggcccaaactcagccagatcagaaagggtctggcctgactggagcatggagagtgaattttgcaggggagctacacagaagacaggaaaacaagttaggagaaaactgccacagtccaggtaagatgattgtgaccggcttaagattgtggcagagttggaaggagtggagagaagtggtaatgcttaagagataattagtagatagaattgttaggattctgtcattggaaggtgaagtcacaggaacttctctcgcccaccaaactgagtggatggtgatgctggtccctgagacagggagacacaggaggagcaacaggttaggttgggaagatgatgaggtctgtttaagatatggtaagtttgagatttctgccaagtatgcaggagaagatgtacaacatgtatttggttatatttttatttatttttaatttattattattttttagaggtaggatctcacattgttgcctaggttggtgcccagtggtgcaattgtagctcacttcagcctccaactccaatgatcctcttgcctcagctttctttgtgtagccgggactgcaggcgtgcaccaccacacccagttgactttttttttttttaacatttttggtagagactattttactgtgttgcccagaatgttcctgaacgcctgagctcaagctgtcatcccacctcaagtttccaaagtattgggattacaggcatgaactaccacacctaacccagcagttggttataaatttttgggcatagaaatctgggatagagatggagatttgggagttatcaggaaataggtagtaattgtagccagggaaaggttgtacagaagtgattctgaagcttttttggatacccttaaaaaatttaatgaaatcagtggactccttccccagaaaaatgtaccatgcattcattcctatatattatttcacatacacagaccacatgaagctgagctatggattccagattatttaagaatttgtgggatagagaggaagaagtgtgttgagagtggtactctgatagacttcaaaagaaatctggcatcggtgccatttttggtaaattttgtgatggtttggcttaatttttttcttgcttgtaggtttattacaaaaaacataaattgagccaaattttagattatttaggaaaattaattgatgaatgaatgtatttcatctaccagaatgaataatgttattcaggattgcacctatgttggtctattcagctcactaatctgtgtcccaagataatactgagagatgttttgataagatagggttagcctcaaggttgtaaatacagtataacaaggttagaaatgtaatccatcaaagttccagttttgttgatcagtgtattaaaattttcttgaaccatttttacattttaaactcactaattgttatgtaatcctttagcttaggaattgcgtcactttcaaacttcaggggatcattcataggtttaaaatttcagtggttgataagcttatttttatcctttttttgtgcattatagttttgtaaacttcaacaaaattcacactcagcatttatttttccagaccaaagagccttacattgttttggctgaaggtaggcccttccgttcctttgaaaaagaggtgggtggcatctgtccacttcccagtgctcttaagatttgaatgtttgggttttgagtgctactttcccctcttgatggatatccatggttccaggctgctggtttgggagaagtgttcagcgagtcctgacgtccttgataggctcttggaaactgctactttaagtgaaacagtgtaaagcaggtccatcaaataatgtcgttttcattataatgaaatggtgagaaaataaatggttttgttgtacgttgttgtacttaaagttgcagtttccaagaacccatcgataccgttgaggacttaccatatatattctgcctctggtccagtacataggcatagccttgtgtgctgcagatctttcattcattttgacatgcatttgagcatattatgtgcaagccattgttacgtaggtgccaggaatacagttgactaagcttttgccattatggagctttcattctagtggggagagagatagaataaacaagtaaataagaaagttaattttggttagtgatgtgttatagccaagcagaatgatattgaaaaggctggtagggcactactttaagataaaatggtcagggaaggcctctctgatgaaggtaacatttgagctgagatttgaatgatacagactcagtgatgatagtgacgatttaaacaagttgttccacagggaaataccacccaataacatctttcagaataaaatcgtaaaagttttgagaaaataaatatgaattcactgctgcattagtttgttagggatgccataacaaaataccatagagatggtggctgaaacaagatttattttctctcagttctgggggctggaagtccaagatcaagctaacagggttggtttcttctgagacctctttccttggcttgcagatagccatcttctggctgtgtcctcatgggtttttctctgtgaatgagcatacatggtgtcctttcttataagcacgccagtcatattggattaagggcacacccttattacctctttaaccctaattaactccttaaaggctctgcctacaaatacacttagattctaaggtatggagattaaacatatgaacttgcaggaggggaggcagggggcacttgacacacaattcagtcaataaaacctccatttagttataaatagtcatatgtcactgtgtttttttctgactttatttggaaatactgtaatttcaaacttgaaagccttaaaaacttacagacttttaaacttgcaaaaataaaaatagaacaaaggaacacccatatacactttacccagattcacctattgttaacattttgccctggttgctgtatcattggtatcgttttcttcttcctcacgccccattttttccctaaccttatgaaataagttacatatattatggccctttaccctgaaacatttcagtgtgtattttttactttttatttatttttattttttgagacagagtcttgctctgtcacccaggctggagtgcagtggcgcgatcttggctcattgcaacttccacctcctgggtatcatgctgctgcctcctgagtagctgggattgcaggcatgtgccaccatgcctggctaatttttttgtatttttagtagagacagggtttctccatgttggccaggctggtcttaaacttctggcctcaagtgatccgcgcccccttggcctccctgagtgctgggattacaggtatgagccactgtgcccggccttcagtgttttctaagatgaggtatagtctgttacaaaacacaatatagttaatggctgcagtaattttaacattgatacagtaattacactttttattctaattttgtatttgacccaataatgtctcttatagcattttgcctgtttcaggacaggaccttgtttagggttcaggtattacatttagttgtcatatctctttagcctcctttaatatttctacagcctttttttcttttgttattatcacattgccattttttgaagaatgcctccccccacttaatttttcaaaatcatttttatacattttagtttgaaattattgtagaatcaaaggaagttgcaagaatagtgatgtatccttcacccagcttcccccaatgatgaccttttatgactgttgtaccatatcagaatcaggagttgccataggtgcattactgttaactagagtatagcccttactcagttttcaccagcttttacatgcattctctatgtcacccactcctttgttttttgataggatgtttctcattttgagtttgtctaatgtttcctcatgataagatttatgttataacttagtaggaatactgcatagatggtgatggattttcacagggtcacatctgtaaacaaatgatggttgtttgtgatgttaattttaatcatctggtcaaagtcttcccaaattgtctcccctctatagttttttattttttttcaatcccttgcaactaataacctgtgggaagagttttaagatgtgcaaatatgcttggtgtggtggctcaaacttgtaatcccagcactttgggaggctgaggtgggcagattcttgagcctgggagttcaagaccagcctggacaatatggtgaaaccctgtctctacaaaaaatgtaaaaaattagttgggcgtggtggtgtacacctgtagtcccagctacccgggaagctgagatgggaggatcacctgagcccaggaggtccaggctacagtgaactgtgatcacaccactgcactccaggctgggtgacagagtgagaccttgtatcaaaaaacaaacaaaaggccagcgcggtcgctcacgcctgtaatcccagcactttgggaggccaagatgggtggatcacgaggtcaggagatcgagaccatcttggctaacacggtgaaaccccgtctctactaaaaatacaaaaaattagctgggcgcggtggcaggcgcctgtagtcccagctactcgggaggctgaggcaggagaatggcgtgaaccagggaggcggagcttgcagtgagctgagatagcgccactgcagtccggcctgggtgaaagagtgagactccgtctcaaaaaaacaaaacaaaacaaaaaaacaaacaaaaaaaggtgtgctaatatcctgcccattaccacggtttatcgcttgacatttggcatccattgatgattcttgcctgattgaatttttgttatgatggttgcaaaaatgatttttccactcaaatacgtcctccacattcaacagtaggacctcagcattctgctgtactcaaggatcctctgttttgccccatttatttatttatttattattggtatagactaattcttaatttttttcagttgtatatatttattaccttgttaattatattggtgcaccagttgtctcagatttggccagtgggagaaggagccttctcaggctgattcctgtgtccttgtgacagtcctcatctttttttttttttttaagcatttctttactttttgatataagataccgtacttaccctgccttagtgctcaaaccagccattaaggaagcctaattcttttagtgtgtagtgaattatattagaagcctctatctagtgctcgttgccattagattgtctttgacactttgctcttacagctgacaaagccaggcaatatatgtagtgtgtgtgtgttgtactctgcttttgttgggtggagtgttctgtcgatatctgttagatccagttggtgtttttccctactgtttttttcgcctcagcaccaacttctagattatattttatgtgcttatgttcctcaacttacaacggagttacatcccagtaaactgattagaagttgaaaatatcataaatagaaaatgcatttaatacacctaacttattgaacttcatagcttaccctaccttaaacttgctcagaaacttacttacattagctggttaattttaattgtatttttcgggtcctctgtttccttgttgcttatggtgtttttaatagctgtttttcgaagtccttcattctaaaatgtgacactatacagagagaaattaacaaatttattgagtgtttattatgtgttaggaacttagttgctggagatttttcaatgaatagagaaaaatagaaaaatcccttcctcatgtaaattgcgttctagtgggcatgtagacaagaagaaacatagagactgtccccactttgcaatggttcagcttatgattttttgattttaccatggtgcaaaagtgatacacattcagttgaaatgtatttggagcacccatacaatcattctgtttttcactttcagttcagtattcaataaattacgtgagatgaatcactttattgtgaaataggctttgagttagatgtgtttgcccaaatgtaggctaatggaagtgttctgatcatgtttaaggtaagctaagctggaaaattcagcaggttagatgtattaaatccatttctttttctttctcttttctttttttgagacagagtctggctctgttgcccaggctggagtgtagtggcccgatctctgcttactgcaaactctgcctcccaggttcaagcgattttcctgtctcagcctcccaagtagctggaattacaaacgtgcaccaccacacccggctattttttgtattttcagtagagatagggtttcactgtgttggccaggctggtctcgaactcctgacctcaagtgatctacctgccttggcctcccaaagtggtgggattacaggcatgagccaccgttcaatatttttaacttttcgttgatttattgggatctaaccccattgtaaatagagcagcatctgtacataaaatataacctggaagttgttgctatgggggaaaaacagtaaggaaagggaaaagggaatgtgtccggtgaggggtgtggcggtagttgtggtagtggggcctgcagttttaaaccggcaatcaagaaaggcattactgctgagtgacatttgagcacctgaagatctgaaggaggtggaggtataagccacatggatccttgggggaatagcattctaggtagagggagtagcaaatgcacaggctgtgaggtgaggttatttaaggatctctttagacttgttaaatgcctgtcatgtaatgatttcagttaaactgtgttgtccttttggaaatgtggatacttacaaaatttctggtttgaagattatataagtgcaaaacgagagttatctctcttttcctctccctaatcttacagctacactttttagcatttcacatattatgtttgttcactgctttattttctgtcttccttcctagaatgaaagcttcatgagggcaaggattttatctgctttatgtactgcttgtgcctagggcataaactttctgtttaatgatgaataaatgatttgtcggatatgactttgtagtagtaattccttatgaatctaatgtctgtaagtccatacttgaaaaaaaaagtttcttgttttatcactctatgtaaattgtatatattacatatatacattcattttattttattttattttatttttttgagatggagtctcactctgtcatccaggctggagtgcaatggcacgatcttggctcattgcagcctctgcctctctctacctcatctcctgggtttaagtgattcttgtgcctcagcctcccaagtagctgggaccacaggtgtgtgccaccatgcccagctaatttttgtatttttgatagagacgggctttcatcatgttgaccaggctggtctcgaactcctgacatcagatgatctgctggccttggcctcccaaagtgctgggattacaggtgtgagccaccacatctggcctatacattcattttaaattacagaacgggggaattatttaagtttttttaagagggagaaaaattgtatggctcttctttgactttatactttagaaaccagtgttcgggtaatagacattttccctgtcagcttgattgtagttgtatgttgcattaaaatttttaatttcatttactttggggttttgcattttgggttttatgaactgtctgagttctcaatctatattgcatgatattttttatctcttttctaacagaattatacctgctatttttcaggttgtgtgatagctgagctttttacagaaggtgtaccattatttgatctctctcaacttttggcttatagaaatggacattttttccctgaacaagtgctaaataaaattgaagatcacagtatcagagaattggtaactatgctacaaatattcgccataaagtttttaataggatctagttcccacttttgctttaatcagatttctggaatgttgtaaatttggaatcaagcagtaaaacaccatagactaatataaacagccttttgttattactttgttagggaagaatgtactgtttttttccccttcaggcacagagctcatttgacttaaaaaaaatctatttattatctattttcccactataatcttcagtgtgctttttacagatttggaaggaggtaaggtagtttctaggggttggagaggttgtcctggctagagcttgctagtaagaaatgaagaagacagacatttgaaatggaggggacaggaaatgtcaacttgaatgtaatacagcaatacagggccattgcatatagaagcaaatagctttgtattaatatatgaagctgagggcagttctggaaaggcagctacagaagcacaaattagtatagcagaatgggcgtgaggagtcgtgtgggggatcacgtaagccacatagctacattattgtttgagggcatcttttctaagtcagttatagggtaactgatattgtggtgatgactctgagtcatggaaaagattgtggtgtgtttagaatattctttaattatgtagggagatatgtaatacattttaatttctcttaagtatgtcaaatattaaaaaataaggtgcttcagaggaagccagttgaggccatatttattgaacagtgcactggatgaggagttggtgtagtgttctgtctttgggtatggcacatacttgttacgttgctttggttatataacttcatgtctttgggcatacattttctgaactgcgaaagaagtgaatttgtttaatttttagggcctagtccaaactaaaagcaattctaactagttaacattttcttttagtacatttgagtcccccatgttcactactaagctcttatttaaactgtaaacagaaagttcagataactcaatacattttgtgatattgtatttcaataatgactgataccctatgagtgtcccagaaagattaaactatgttctgtgcattgaaaaatatttatttccctatgatactagaaaaccataggataaattcaaattaggtgtatcatttctagtgtttgcagaatttaacatctctttgacactatttgaaaactttaagccactgattcccctactgattagatcctagagctatacttaaaccacagattcctttgcacttgtggcaataaggttctgaaccataactcaacccgggatatgtaaatggattttaggggttctgtgattccttccagaattgtatgtgttttttaatgcaaaaattgtgtgtatacatttttctctggaagagatccattgctttcctcagattcttagtggtatctcctacttagaaaagtttgtaagaatctttgagttgtggacagcaatatattagtccctattttaataaatggggaatactgagccatggtataacctcctctttatgtgtcagggccatctgtaatatatttgtatataattttttactgctttctaggatgatggagtcacaaatcacttagcagtcaggttctgaaagatcctttaaatcgtatgtaaattgcctttgtagctttcatctggtttacttttctattctcaaatctattttaattccttttcttcccttggtataggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctggtaagagtttattgtccaaatattagccacttagatattttttaagttaatgactataatactgcttgtttttctgatttgtttgagaattgcaagtatgaactttgctctttgaactatttgtgtacattttgataatatttctagttactctgttcctgggaatcaacgtttgtgtgttctctcacttttgaaatgatcagaattatcaagtgatggaattttgtggttttcttaggaatactacattcgacttggaataagactaatgtttacaagtatgtgcttctgatctagtgtctttaggcctttatgaagtttctctgacaaatatggttatttgactgtcagttttagcatacaacaatctattgctgctgaaaaagattaattttgctagataatttgatgttgaaagaacctagcatactaacttactgaagtttaaggttgttttcccagttactgtactgtttaggatatacatcttctttatgatgaggtgggtgtgttatacacacctacctgttttgcctgtctcactcaaaatcaggtgatacagattcttgtttctagctccccaaattaattctgaaagcttatttctgcatgagaaatatcactgaatatatataatatcactgaatatatataatttatttctataatataatctgatagaaatcagggattctgttttgaagtctttgtaaatagtacgtgtgtggtaatgatattgtctttttttttttttaaagaaatgtagttcattcattttatgatttgcttgtcattattttaatgaaacatgtgaaaagtggtctttggactctggtcttatctctaggcacacccacaaagtgattggtgattgttacgtgtttttatgtttcctcatacatatatttttatttatgtttatctctgcctatttatttatttatggtttctataaccatacaggtatgaacttcaggcccagaaatccaggatttctcttaagacacatcaaagtttatcatttataacaaagcatagttgtaactcacttggcaaatataaattaaataattgaaccagataaaatcaaatcaaatgaaagtttatcagttttaaaaacaagctctgtcttctttaccagaattttatgatcctactttttggtgcagtgtatcttaatctgttctcaattgtgttaaacgggtcatgttctgatgaggtgccatattaacatattgacactcagttactaatagctatcacataaaaataatagctactgtttattgaaaaatctgctctaggttgttgtaagggttagctgcaacaaccttgagcgttagatgttatattaccttcatatgacaggtgaggaaactggggttaggagagactaaataacatgacccaaatgtatccggtctaattctcagttctcagagctcctgctctacaccttggttttgaagcaatcctgcttttctttggtcttctgggtctttatggtgagagtccgtgataacccagggtcagtgccagcaccttgcattgttatttcttcaaggcccagtatgtgatcacccaggctggaatgcagtggggagatcatggctcactgcagctttgacttcccaggctcaagccatcctccaaacgtagccttccaagcactataggtgtgtgccaccacgcctggctaatttgcggtcttttaaaatagagccagtgtatttgaatgtgtatggttaaatataattaaaatacatgtgtcagtaattataaaagtttaaaatcaacatttgtttctttacagtattttttaaatatcatagatgctggtacagatttgtgtaaagtgaacttccaagtgtgctgtggtttatggacttaaaaggggaaataagcatagatctactcagactttagaggtgcccaggaaagtaagagacttttcctaataaagatttgctcattaaagtggggatattcatctagaattttgacatattatcaggatatggcccagagtttttccatttttagggcgagcaggcgttatagggtatttacatcttgcttacttagaggtaaatttttattctattcagagcattgttgaacctagcaggggtggggagtgggacccaggatgaagggaataattgtgtttgattgactcaaagatctcaactgccataaggtacattttgatttcagagatgttggaaagcaaggaaaaagtaaggttattttaagtttaaggtagttaaactttacgttcagtgctattcactgctaagaaggaaaagagtacagtctttgaccggttgtgatcatatgttaagaaacacatatgttaagtgggaggcaaggtaggagaagaaagtgtaagtgaagagcagatacaattgatagtaaatgtgacagcagaaattagaagtagttattttgtagtggtgaggaatatcagacagtctttgtaggtcatcagaaagagaaaggagaagatatagacaactgtagaaatgtgcaaacagtctgccactttggttcactaagaacttgagtatcacttgtaaagcagtctaacaatggtttctctttgaggcagttgtgacttttcatttatatgtgaagaaacagtctcagattgcttaaatggtcaagttagtaagtggcaaggttgagatttgaacccaggtctttctgatgccaaagcttagctttatctgttattttaatgtggatgtttctttgttagtctaataaatatctctcacttgtcaaggatactgtttaaaaggtaagtccctgcagagaattaggcttttttttttttttggtcctcagtagatgaggtattagattatttttatattattatttttttaagctgtgtttcaaaaataagactagtggtttggagacagttacagattatgagctgggttactaaaatctgattaagttaaatgctaaattgaaaagttctgtttttcccataggcttatgattatttatgtataaagacagggaggaaaagttaataagctttacagagagttaagattgtaattataaattttcttcctttttattttatagaaaacatagctctgctggcagaaacagctctgagattcctggaattagtacagttaaaaaatcttaatatggaaaatgaccccaataatgaagaaatagatgaggttacacatccaaatggaaattatgacacaggttgtataattttctcttccagatttcctgttatttagaatgaattgctgatgctaacttgtaaaactatcatttgtagttttcatgtaaggtgaaggaataccagatctatatattagataggaagagtccctggtgtctaattattctctctatcctcatatactgttatcttgctcaaaaataatcagcttgtcaccatggatactaaagtcaattgtttgtcagccagaattgatttgtgtgaacagtaaagctggctgaattatataattctcataaaagaaaaaattagaaacatcatagctaaagaagctaaaccttttctccttacgtgagtatattctgagtatcctcaatcataaattgtttttatttcatactatttgttatttacaaaaaaccataaaggaacagatgtgatgatggtaaacttattgatgtcaaagtccttgtcttaggtttctttgtgttatacaactctttacagatttttacttaatgtttgttgagtaaaagatttagaagtaaagtaatagatgtaattttctccaagatgcttctagttgtgaaaaactagagaaatctagttttttagaattttatgctgcaaacaactacaattgttacttgttagaatggcaccatttttagacaacatgtattatctagagttgaatacagtggaataattttgaagttataggaggatgtatcaggaagtcctagcctttttttatggaattacttggaaaataatactgtcctataaccatgtaattggacctgttgagataataaagttaaatggtaaaatttttggggagggaatctaaagtttttcttaatgtgagcatatagttttgcatgtcagaccagttacctttttccttgacagtagtagctggaccaagagtggcccctgtcttctgtttattcacagataattgttaaagattagctctgcatcaggcaattaggagcctgccctaagcactagagcatggtggtgaatacgatagaaacgatccttgctcttgagcttacattttagtaaaaagaagacaggcagctaagtaaataaataagtgagaaaaagtgaggatgaggaagagaagaggtaagaccagagaagacagtggccagatgaagtaaagccttgacagaacttgcagtgtgttttctggctttctaaaataaactgacctttaaaaacattttctaaaaggattgctcagtaccatcatattatatcctaatcctattccattattttcaagtccttgattaactgggatcttactggggcaatgtgatttcctttctggtgcttctctataattttctccttgagctaataaatgaaactatttgattagtgagatagtaactatgtttgtggcatctgcttgttaggatattcttcactttatatttcagtttcccatccttcagagctttgaataatgcaaaaaattggtgattaaagtcttcggtggattctgtaatcagtctctctgatgagtaagaaagaagactgggactatctgtatggggaaaaattgatcttttcttaactatttcttttctttctttctttctttcttttttttttttttttagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtatgttttttgcttttaaattcctttaagatttttaatcatcctctcaaatacttccatgcaatctgaaggatagatgatactaccaaatttcattaataatgaaatgaattcctagtatttctgtcttcatgctgcttttggatgatgtaagtattttggcttggttaaaataaagggttggtatatcaacctgtgttacatccgtatgaaggaataccgtgtggtcattaactatatttagacagaataatgacctggaaagtaccatgaagtatgttaaagtgacataagtaggttgtaaatcctcttaaagaatgattgctgtagtgtaaaggtaacaataacagaaatcatatatgtttataaacatgttaataaaagtgaacatgcatcacttttagaatcagaaaataagttaaaatataatcatggttgaaaatcaatgtagttggaaagaattaagttaaaggctttgtgtaactgaaaatttgtgaaaatttaagcagcattttttttttgctgttctttcattttacaattcttgatttttagatatatctaaagtcagacatcttgtgttttatatgcatgacttatattacatttgtattcagaattagaagtaaatgaagtggacagtattttgcatgggttaagtcatgtttgatacaggatttaatatttttctcttttgaataataactgatccccttttccctgaatgtactgatcttttcagtttaagatttggccaattatgaaatatatgctaaattcatattattatgattatccactaccccctattatatcatttcccacatagttgtaacagtttatctgttaacccgaaaagtttaaagactattctgcacaatagaaagcttggctgtgtccagactttcttgtgaggcagcagaagctgtaagactttaagggccgggcgccgtggctcacgcctgtaatcccagcactttgggaggccgaggcgggcggatcacgaggttaggagatcgagaccatcctggctaacacggtgaaaccccgtctctactaaaaatacaaaaaatcagccgggcgcggtggcgggtgcctgtactcggaggcggcgggaggggggctgaggcaggagaatggcgtgaacccaggaggcggagcttgcagtgagctgagattgcgccactgcagtcaggcctgggtgaaagagcgagactccgtctcaaaaaaaaaaaaaagactttaagttttggttcccaataatctaggaaaggtttgctgtttgatttttgtttgctaaaaaaataaaatgcaagaaacctatgtggcaacaggattgatatttctgcaaatgctatcatatgttttggaggaaagggtactttctactttgaaaaactttcaaattcccggttatttttggaaattactgtacctgtttttttcttttcagacatcttttgttttttatttttgcattaatttatagatgcatcttagccttccatctaggacttcatctaactcagttcctgaatacagtattctttgattcttacatctttttgtcttgcttgctctcttcttcttccaaataatgttatatttatttcttttctcgggaaaagtcggttcttaaaacttcccctatctattggtcaattcatgtgttctttgaaacacatattagtttgtcttaatttaaaaataaattttttatttataaaaaataaatatgcttatattacttttggaaataaaacttagaaaaatttggaaaatacggaaaccagaagaaaataaatgaccattaatcctacaacccatgtacaatgtctgttaaagctttgatgttttttcccatagctattcctcttctctttccatcccatttatccctttctgtcatatgctgatcgttaagagcaggcattgtggagctatactgttgggttcaggtgttcactttgtcactagttgtggttcttggaaaatcatttaatttttttgtggcttagtttacctatctgtaaaatggaaataagaatagtgcctgtcttactggttgttgggggatagaatgaattaatatatgtaatagtgcctggcgtaagtgctatgtatatattatattacttccaaattttattatttcttaaactttttctaataacatactttaagcattttctcatatcattaaaaatttatttgaaatcataatttgataggtctaaactattcctttatatagttttgcaaaaatttaacccttttggatatttaaattattttcatttttttctgtcatatatagataatctatatatttggtataaatatgcaacgtatgtatgtaagtagttgtttctgattattttcttaggatagaagtaaaaaaattttaattactgtgttaaagaatgtgaatttatttttaaaactcatgacacatttataagctattcaaaaagatgatatcattttgcatccccatctccgttaagtgctgcacacccatccagtgtgaaataggctttacttagtccttgcctgttggaagggtaaaatgataacttgttttgatatatatttcttagcttaactatcaagttgaaaaactttttcatgttgattatgcattcatatttctaattctatgaattttaaaattcattattttggcttatttttttctgatacttatgcttttcttgttcttttcgagcctttatatacatattaagaacattaattttttaaatcaattttaagctcacgtttcttagttctttaacttgatttttgaatcttttctgtagacagtttttctgaagtcagtttactcgatctttttgctttgtgatttttttttttctacttttgtatgtaaagtctcttcccattccagaattagattaataatctgttgtgtgcttgtctttttttctttttcatgctttagtttttacacttaactgtttaattgatctttatttttggtctgtgatgtgggatgaaaactaaattttctttttcttctcagatatgtaactgattttccagcataatttattaagcattttttttgttttttttcttactggtttgtttcttactgttttatcatctgttgcatgcttctgtctgttaaggtcagttttctggctatctagtctgttccattgatttttctcttcttgtactcatattcatagccatattcaatttacattattatatatttttaatcacctttatcatctgatagggtaagtttcagatgtcattcattttcaaaatagttttagctattttagctcattgtacatttcagtttgtaaagttcctaaatataattcactggaattttagatagaatttttccttttattaaagaaaacaattataacataattttttaatcataaaggaaataggcttttagaaattatttaaaatttaatcaaaatgtataatgtatgaaaaacaatagttgaaatttccagaggcaactactcagctttctgcttttattttagtgttttcaggtgattattaccatatctctaaataatattttcatattactatttttagaataaccaactttggactttatctcttgaatttttttctgtgccagatgaagatttaattcactcataacatgccttgatccttcttctcttttcagtttttgagatgttgactactattttctgtgctttagtttttggtttgttgttttaataactttaagtaattaaatctattttgtgtgctccacctctgatttgcagtacaagattagtgccccttttctttctctttacctgtgtctctcttttttattgtttggttagttgagaattgagaattctcaacaatttttttgtcatagttaataatacattctgttctataacacaatgaagtcttttatgtatagactgattatgaagcttcaaaacaaaatacatgattatgaatgtgtaaattttattgactgtggagccaagtaatatactgtaattatatttgcttcatcacaatcccaattcagtgactctccccctcaccatttgagtatgtttatagcaaggccagtggattctactttactccctcttctagttactaaatacactatttattttaatttcatatttggactgtgattttcttgagcaatttcaggaattttagatttctttgttttccttttagaaagaaaagtaataaattgtcaccatatccgtaatagctagcttctttcttattaattttatttgttgcttagaatctattccattttcttcttgatgacattcttgaaatttattagcttttaattctaatctgggctgactgatttctaggtctttgctagcttttttttgcccttgaattcttaggttgaaactttcctagaaagggttgcatgggaggcaaacttttaatagtccttacatgtcttgaaatgactttttttttatttaattgacagtttgactgaaaatagaattcttttcataacttttaatgccttgcttgcctatgtcttgtcttctaacctccattgttgctgaagattatataattacagtctgattcttcttcctttttaggagacctatattttcatttctgtaagttcttaggatcttagcttttctgtggtgtccgagaatttcctgatgatttgccttgctgtgggtctttttaactttatcatgctgggtaggaagtgcaatgttctttcctaggtaattgattaatatgtttggcttttgcttaattttattgctttacttaatgatatatgtacttttaggtattgaataatcacataatattgcttttcatttccaggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattggtaagtttctgtttctcaaaattagaatgagattggaagaactttataaaatttctaggtaatataaagaattgcaactttattgttcctgctattgattgtgtggggttcctactattgattgtgtgggtgtgcatgtgtgtatgtgtatgtgtgcatgcttatatgtatgtgagagacagacaagctgactcattgggtcctccagcctggttgggaagtactgctttgttttcatctgttggtaagtctgtgttacccttgtcaaaaagcaagactttggtttttgttttggctttcttttttttatttttaatttttttttttttttttttttttttttttttttttgcgacagtctctcactctgtcacccaggctggagtacagtgtgtgatcttggctcactgcaacctccacctctgtgttcaagccattctcctgcctcagcctcctgagtagctggggttacaggcacctgccaccatgcccggctaatttttttttttttttgtatttttagtagagacggggttttaccatgttggccaggctggtcttgaactcctgacctcatgatctgcctgctccagcctcccgaagtgctgggattacaggcacgagccaccgctcctggccgagactttgttgttaaaaaaaccatgatgtgggtaaagccttgactggtctgaagatgaaaattatttttgggcacttgactagcagtcaagttgaaaattggatgtgaagggtctgtcactgcattgattaccagttaagaattcgtagacttgaataatatgtttattctattataatttcacataatacattgcttctgtggcctaattagttatttcaaaataatttttggaaattatttttgaaatttaatatagcttgtaattagcattttatttatctacaaaacagatgcccatcaattttaaagcaaaaatcatcatgaaaatagttttttacccctgcactcaaagtttgtggagatttttctggaccttgctatttctagtctttgatcccaggatgaatatatggagtgctcatatatctttagtgtcaaaataaattatgtttatatacagaataaacccagtgtggtactacttcttcaatggataactcccttagaactacaactgaatttgatatgaaaactatggggagaaaaaaacacgttaccaagaaaaatcaagtaaacagtcatttcttggcatttaaaactgtttaaaagtaaaaaacaattttagtaacttagaaacacctacttatttaaaacaaatgatagactatatacatctctctcattctgtttttaaactatgtgtattctgttgtagtgatttttttttccccagctttattgaggtataatcaacaaataaagatagtatattatgttcaacatgatattttgatatatatatatactttgtgaagtaattatggcaatcaagttaattgacatatccatagttctttttctttagtggtaagaacatttaagagttacaccctagtgattttccagtatacattattattaattataatcaccatgctgtacttgcacatactgtacaagaacttattcatcttgtctaactgaatttttgtatcctttgactaacacctgcccattccaccctcccttctaccccagcccctggtaaccaccattctactctctacttctaagagttcaacttttttagataatatgtattagttcgatcataacagtatctgtctttctgtttctggcttattttacatagcataatgttctccaggttcatctgtgttgttgcaaataacaggatatttttattttttagtgctgagtagtattttagttgttatatacaccattttttttattcattcagtggacacttaaattgatttcctatgtcgactcttgtgaataatgctgcagtgaacatgggattgcagatatcccttcaacatactaatttcatttcctttggatgtataccccaaagagggattgcaagatcacaggtagttccatttttaattttttttttttttttttgagacggagtctcgctctttcacccaggctggactgcagtggcgccgtcttggctcactgcaagctccgcctcccaggttcacgccattctcctgcctcagcctcccaagtagctgggactacaggcgcccgctaccatgcccggctaattttttttgtatttttagtagagacggggtttcaccgtgttagccaggatggtctcgatctcctgacctcgtgatccgcccgcctcagcctcccaaagtgctgggattacaggcgtgagccaccgcgcccggcctaattttttttttttaagacacagggttttgctctgtcacccaggctggagtgcagtggcatgatcacagcttactgcagcctggatctccctggctcaagctatcttctggcctcatcctctcgagtagctgggaccacaagcatgtgccaccacgcctggctagtatttatttatttagagacggagtttcactcttgttgctctgtgctggctgcctggactttggggaatgttgacatgggttatgtgaaactacccttcctgccctcttcattggggcttttctcaattttgctatacccaggtgctgtaatctctcacctggattcctttgtaatggtgttttcatgcattgatagttgttaaaacagatttttttctacaagaggatgaatactgaaatgtcctattcagccatattgttttcactgcctagtgactcttaaagagaatggtggtggtggttttgatggtgattatgatttctttgttactccttttaaaaactatacttttcccacttagctattattaatattttcccccacatttgtcttctgataagttgaatgtgttagacaaagaaaagattgattgggaggccaaggcaggcggatcacctgaggtcaggagctcaagaccagcctgatcaacatggagaaactccgtctctactaaaaatacaaaattagccaggcttggcagcgcatgtctgtaatcctagctactcgggaggctggggtgggagagttgcttgaatccaggaggcggaggttgcgatgagtcgagatcgtgccattgcactccagcctgggcaataagagcgaaactccgtctcaaaaaaaaaaggaagaaaagattgaatatgctatttcataggcagttctttagattcaggcttcttcttgttttgagtatttgaggtgctttgtatcaggcagctacttaatgatataataatgctgtagaacagtcaaccacagaatctcagtaaatccttcagtaaatttttcgtcatgcacctgtgggttgtataggtggccctgcttcaggttctgcatctccaggttgtctgtgatgactgtgattcatctgtctcattctggggccctcattgtaggggcagtagctacccacatcatgttctcatggtgatggcagaagcacgagagggcaaacccagctatatagcacatttcagattcctgtttgtcgtaatattcattggccaaagcaagtgatataaaccaaaagaaagggggcagagaagtatcctttgtatactacaggtgtatacaaagtgaatgagtgtggttgtgtgatacagggaagttaagaattggggtaaataattcagtataatacagttcccaactcctgtcaaaccgttatgggtttagctactttctggaggtttaccaatgtttttccagtcctcattttccctcttatcacagggaaaatacccagtgtcccttgttggatggatcagaggctgcagggtatttatgaaataaacaaaatcttcttcatttataattagaagaattagaaatgcgagaccttgggagatagatattttgaacgcatcttttctccttcccctgttaatataagtattattagcctatgattgtattcctatttctctattaatgtgtatttcttatatacactaaataaatattagaagataaagaaatatcctctgaatgctggtgtgtttgcatgctcagagctaatacaatttttcttgcctttaaaagtttggattttattctaaatcaggttagtctaatgtcgattagttgaaatcattgattttatgtttaatacataaaatcgttaaaaggtatgaaaagacattcatttaattttctggtttaatgttatattttaaactttttaagaataggtatcatgttttcagcctttttgtttccattcatcattgccttgtgaaagtaactgtgagttatatattagatttgatcaaactcctgcattaaaaagaatatcagataggctagattgttcccttaatctttatgctgtagcttggagaagtaaattctccccaatttctctgccccttgggtggtagaggggatatgtccttgaacttctgtgggggtacaagttggggaataatagttagctatatgctgttgggacttgttatgtctctaacagtttttaatccagtgttataaatgagtaggtgcccacacaattttacttctgactaaaaaaatataaattttaagtcctcagctatgaggtaactgtttttattcttttgtggtactgctgtgatatttataataagagaatattataataacagtgtgtccacttgattgagtttatgcttcagggtaattgagtatgtgaaggctcctgatagtaacactgtggcaaaatccttttgtcagttacgttataaggtaaaaatttgtttatcccgatagtttgaaataacttatttgatccctaccttttcttttcctctttagcccccttcctgtgtcatcccaatttatggatacgttatggtgccgtgggatttatcacagtggtagctcgtcaaataagtacagctgatgtctactgtaaactgatgccttatcttgacccatatattacccaaccaataatacaggtatacatgttccaagttggagtcagtctttcctccaaactgtgcctctttaaaaaaaatgtttagagagtcctatttttcttaacattttttaagtatttaaattgggctatagcatgtttatattcctttcaagctaattaatgttaatgaaccaagcacctttgaaggtcagaaaagtgcaaaagattattatgttttacatcatgttatatctaatgtagcgtacagtagttcatatattttcttttgtgtaatattataaagcaactgttaaaagtgaaatatagtctagcaaaaatgtatattgatggccctctgctttttattttaaaaagtataactgattgcatccagttataataaattagaaaaagtctttttcaaatttaagtttttcaccgctaactggttgttttgatgtcttttcttttttattctaacaaccccacaacctctgctccacctttagcagtacttggtgataaactttaggtctttggtttgtacagggcaaatattattcacctagattttcagtgtttatacccttcatcttgctagacagcaaattatcaagataggcattaaatggattgaaatggcgaaggacgattctagctgttaaaacatctgaaagttcctatttttaccagaactccatttggaattcacacacctctctggctttctcccacttttgtatttcaatgtgccttccctttggagaaaatggccttggataaactctggaaactaggaagctttggttataccttcttttcttcatagattcattcatttctagaggttatcattctatttcatagagtttgtaggattttttttttatttttaccccaagagcaacttatatatacatgaaagatggatagcactatcagaaaaaaatgcctttttagaaaagtttatgcttccttggaaattaaatctagagatatctactccttttgaatagttactctatttaaaagtttgctcattgaactttttcttttgtcattgtttcgtattttgaaaggccaggatcagaagttgagaggctaattattcatttgcttcatgaatcttatttttctacaatttggattagacaaaagatatctttttatgctggtttccactggctgacttcaccaaggagttaaatatatctaaaggaagtcctcttggttcttttgctagagtcacagaaaaaaaaaaagaaaaaaaagaagataatcttcttggttacttttagcagtactcatccattttatttgcattgacaaggaatgtattccttttggataattaaaggaaagattttataaacactatggagatagcaatgttttttagaagtggttgaatctaccacgaaaatgtgataactgaaggaagacctgtggctgttgagcatcttttctggatcagtacctgctggttgtcagacctgtgaactgcacatactttttagatctaggacgttgtctgacatattgggatctagaaaaggctctttttgttttctaaaatttcctgggttggatgattagtcttccaatgacagacacacgtgtggtctagcgctacaatgaaaagtaagagataccttagctctttaaattttactagtattcttttttcttctacacacttacagatgttgatatcttattttcttagaaaatgaatatgttaacttttctcaagttgtatttattgaatttgaaaataactgtacatgttatatttttggctgatcctttttatttttccaatatagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacaggttgtatcacccttccaaagtcttacatttaaatgcgaatttcataaaaatattgaagtgtccatttagttttttaaaatgtttttgattgattagattacatcataaaaatgagtaagtaaatctggcaaacatcttaggcatttgcttttgattcctaaacaaagataataataagatgatgataaggtatcaggttaagctaaataaggaatcatgggagacctcttaagtttcttttgtaattactggctaaataaatgagggaaagacagtagaaacaaccttagatttaattagtagtcttgattcagttctatgttttaccaaaaatgtaatgaaatttagctggaagaaacattgcaaaacacagatgcaatatagaaaaatcctggttcatttcgatccaaatttgtaattaatacttgtaaacagctgaaataacttgtatttagaatgcatcttaggtttaatagaccagcagtttactggtatatcttaaaagcctatgaatttgaatcaattaacaaaatcttactacacttggcattggtaatgcctctttagaaatatgaattgtattcatgacaaaaaggccaaaagcaattgcaacaaaggccagaattgacaaatggatctaattaaagaggtctgcacagcaaaagaaaccatcatcagagtgaacaggcagcctacagaatgggagaaaatttttgaaatctacccatctgacaaagatctaatatccagaatttacaaggaacttaaacatatttacaagaaaaaaaaatcccatcaaaaagtgggcaaaggatatgaatagacacttttcaaaaaaagacatttccatagccaacaaacatatgaaaaaaagcttaacatcactcatgatcagagaaatgcaaatcaaaaccacaatgagacaccatctcatgccagtcagaatggcagttattaaaaagtcaggaaacaggccgggtgccgtggttcaggcctataaacccagcactttgggaggccgaggtgggtgggtcacccgaggtcaggaattccagaccagactggccaacatggtgaaaccccatctctactaaaaatacaaaaattagccggacatagtgttgtgtgcctgtaatcccagctactcgggaggctgaggcaggagaatcgcttgaacctgggaggcagaggttgcagtgagcaaagatcgcaccgctgcactccagcctgggtgacagtgagactctgtctccaaaaaaaaaaaaaaaaaaaaagtcgggaaaaaatagatcctggggaggctgtggagaaataggaatacttttacactgtcagtgggagtgtaaattagttcaactgttgtggaagacagtatggtgattcctcaagggtctagaaccagaaataccatttgacccagcaatcccgttactggacatatacccaaaggaatataaatcattctactataaagacacatgcacatatatgtttattgtagcactatttacaatagcaaagacatggaaccaacccaaatgcccatcaatgatagactggatgagaaaatgtggtacatatacaccatggaacactatgcagccataaaaaggaatgagagcatgtcctttgcagggacatggatgaaactggaagccatcatcctcagcaaacacaggaacagaaaaccaaacactgcatgttctcattcataagtgggagccgaacagtgagaacacatgaacatagggggaaacgacacaaaccagtgcctgttgaggggtggggggtgaggggagggaacttagaggatgggtcagtaggtgaagcaaaccaccatagcacacgtatatccatgtaacaaacctgcacattctgcacatgtatcctgttttgctttttaaagaaaaaactaattaaaaaataaatacatgaagtctaggccaggcatgttggctcatgcctgtaatcccaccttgggaagccaagaaaaaaagaaatgttaaatctaaatgtacatcttgttttatgaggggtatgtggaacttagggaagccaagataggaataaaaatggttaaaaataaagaatacagtcgctgaatatatgctctatgagccataatgcaaattttaaaaatttaatttgatgtgacttgaattcctggagagctttttctttgggttttcttttaaccttggcttgtacgttagatatgttttgtattttagaaagcaatttgtggaaaattggattctgaatcacatttttctgttgtttctcctgagtaagtaatccttatcaaagagatttcaatgtgcagtaaaaatcatctcaatctaagtgtttcttcagccttggccgttgtgactatttctgtctcccctacctatcctgtatattaatttaaaaaccttcatcccaggcccggcgcggtggctcatgcctgtaatctcagcactttgggaggctgaggcgggcagatcacaaggtcaggagtttgagaccagcctagctgacatggtgaaacgctgtctctactaaaaatccaaaaaattggctgggcatggtggtgggcacctgtggtcccagttacttgggaggctgaggcagggaaatcgcttgaacctgggaggcagaggtcgcattgagctgagatcgcgccattgcactccaacctgggtgacagagcaagactctatctcaagaaaaaacaaaacaaaccttaatcttgacattttcttttccttatcagtcattagttacctcatggggccaccctagcccctcatctcttctttttaccttgctaaggtataggttttgacactgccatgggtaaaaggaaggagtgggaaggaacagtttccatagcctttctacttcctgcttcctacggttcttgtaatcccttctaccactactgctccttcaatgccagcccccgttactgggtgccatgataaaaatcactaaaactccctgacccgtattcctctgaaatgttagtgcttcgtatattcattggtctgtcagtgatcccctcatttgtctgagtggaaaaagaggaacaaataatcccccattttatgttatttctggtgccagtggctttaggagactcctaaaggttaggggacaatcctctgttcaagagataagcactgctagtagaagggagagcaggccagaaactctgaggttcttaccagaaataacagcagaacaacaccagcttccggttttttgaaagccagcaatgactttaccagagcagtttgtgatttccatatttttgactatccttaaaacaaatttgagcaacaggtgttattcctattttatagataagggaatggagacacaaggaaggtagttaacttgcttatgttcatatagtgcagtaagtttcagagttggcatttgaatctaaacctatctgattccaaagcctacactcctacactgtgctgtgtggcctctaaagtaaaataaacagaggacagagagctaagacccagaagctggcttgggttttatacagacttagggagaagcccatgtgcagtttatctgctccagccccttacaagccttttctctaccttcacttctttttggtccctgtgctacctgagtttcttaggattactagtagagacttggatccaggggaggctttggagataggaattgagtccttgtttctttttttttttctttttttaattgagatggagtttgttgttgcccaggctagaatgcaatggtgtgatctcggctcaccacaacctccgcctcccggtttcaagcgattcttctgtctcagccccctgagtagctggtattaccggcatgcaccaccaggcctggctacttttgtatttttagtagagacggggtttctccatgttggtcaggctggtcatgaactcccaacctcaggtgatccgcccgccttggcctcccaaagtgctgagattacaagcgtgagccacctcgcccggcgagtccttgtttctaatgtcagggctacagagcgaaggaccatatttttagcttctgcaagcaggcaatatgaacacttctacataattttttttttttagcttagagttcttcagtgctcttctatacgggactgtacttgagacacatcatgggtaaagtaggcctttctagaccagcgtagcattgtttctatgggaaaatatgttagtagttccagttaatagacttaacatacacttttggaacgttacccatatgggagttggaatctgtactccagattttcagtagaacttaaatcaggagatgactcatggaagggctgttttcattagatccatctacaatagctccctgttttatttgtatccatttaatcaggtgctaataaataatacaaaatgatttcactcctttaaaaaatgagttacatttttaatgattttttatttttgcactttttgacagattagtataaatacaggtttaaaattcaaaagctataagaagatatataatgcaatgttaagattttatctaatccctgccctccggccagggagtttctttctctgtggattgtgaattttatgttgggtgttgaattgctttgcagtgttggacttgttctgctgtgcagttacttggaatcagtttcatccttttaagctttgcttttaagctttgttaagataggtttaggataggtccagaccaacccttaattggtcactttagtcccactactaagaactcagaacatgatgctttgtgtatattaagaggtcttgcactgttcccaaccttgtgttgttctttctatggcctcaggtggtttccttatgcatacatagtttcatattcagccaaagacttgaggagacccttctgtagccctctgaagctctcattctgtgcagatcctccttcatttctctgctccacagagttagcctttgtaactttcttgaactctgatgtgtctcttgaaatcagctctgttttactctatgttccttctgccatagcctggcaactctctctagacagtattgctgggacagtcataggactcagttttaaatattttaggcattgtagccctgtctgcctgttttcccatgcctgaaaagtgtgtgtctgtgtgtgtgtgcgtgcgtgtgtgtgtgtgtgttttgtacagtttgaagttgtttaaagtggaagggtaaaactagtctggtccctgttatttcatcatggtcagaagctgaagtttgtgggtatgtttatggacttaacactagtactgcactttcttagttaccataacttaggcttgatctttggtagaaaaaaacatctcccagcttgtttttttttttttctttccttttcaagatattcttggctatccttggttcttaacatttttttttctttttcaagagtttcttggctatccttgattcttacacattttccattttccaagtgatttttttcaagtcagcttgtcactttatgcaataaaaatttactgatgtattgattgagattgcattgaacctatagaagtcagcttgtcacttttgattattttgagtgctattacaattggcatattaaaacattattttgtttgtagctggtatatggaacaatttttatatttccttttatctggcaacctcataaaatttattaattataataatttgctaaacattttcttttgaacttgtacattcacagttgtatcatgtgtgaacagtgactattttattcatttttttccaatctgaatacctttgttttccttgccttatttaaatgactaggatatttagtatagtattaaagggagttggtgtgagtgggcatccttgtttctcatatcagagggaaaactctcgacattataccattcaatgtgatttttgctattaattttttttgtacaatcttttgaacagattaaggaaatcctctttctggagctaagatgattattggaagaatgttaaattttatcaaatgtcttttatcgagattattatatggtttttctgttctgttaatgtgttgaaatatgttgattgatttttcatattttaaacttgctttattccctggatatttgaaataaacacagctttgtcatattgtatctatatataaatgtagttttagaaaataaatacaatataaatatataaaatgtttttatatatactggatttggtttgctcactttagtggatattttttcatttgcgtttatgaacaaccttatcctatagttttcctttcttgtaatgttcttgtcaatttgttttttcatggtgcagtgctaacattttttgttttttattgagatacaattcactaccataaaattcactcttaaagtgtacaacttgctggtttttaatacatttgcagagttgtgcaaacatcaccactgttaaattccagaacattttcgtcaccctgaaaagaaaccctgtatccattagcagttattttctttcccttagcccctggcaatcactaatctgctttctgtctctatggatttgcttaatctggacatttcatattgatggaatcatgcaatatgtggccttctgtgtctggcttctttcactgatcttaatgtttttaaggtccccctatgttgtagcatgtatcagtatttcattactatttatagcccttactgtggccctcccttttgtggactaaaacatagactaacaaaaagagagctcttactttagctataaggtagctattgtctatttaaagcgaattttaggaggagacatgaaaataaaccaagtattgcaagttaacactgggatttagtcaagaatatgtctattattattgtactttaatgcaattttatttcatgttttttagctttgtgccctcctagggttggttttatcatagtctgcctgagaattgtgaatatgactctaaactctagtgggattctagattgaggcctcaggagaactgatattttattaaatgaatgttttttattcctttacatgatgaaaatgtactagaggattctgtggatggttgggaagaaagacactcagagctgccacatttaccagaatatttaagttgccaaggaattaattatttagattgattacttagtatttgtccgtttcaagtgcactattttaggtggattaacatgtaaatttcactataatctgataagatgggtgccagtaattatctttatagctaaatagaggtgcacagatacagtaagtagtaattagggctggaatttgaacctaggcagtctgacttcagccattatcctagattgctactgggtttgttgctcacatttgcagttgaggcagcattccaatcaatcccttagttgcatggtatattttatatatcgtagaatgcctttacatactcattcaatataaatttctcaacacaaccaggagcaaagttgaagtaggtacactttcttttgcttaatattgtacattcagagttttgttcacataataaatatttattcaacagttgtattttaaatactactagatatcacacattgtgttctttggaaattccaaagatgagttatgtgtgaatactgtcctttaggaagaaagttaagatataaatcatgatacaaattacaaagtgccctaatagagtgttctgggagatcttagtcgtgacatgtcattctgtattgttaactttatttttcacttggacttggttgtttcacccttctgtctcttttcagttttaaattgggtgatttgtcccttcagttgttagtcattctgaggcttgtttttattatttgtgaaaataaactagaacatatggttttatttggttttagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacggggttagtatgcttgtttgtgtgtgtgtagcttgttgttgttagttatttcataagactgttttttagctaattaataataaaataaaaagccccatttcacagataaagaacttacaaatacagtgactccattacttagcagggagattttggggaagaaaaatagggaagcgaactaacagttaaggaagtaacttgccagaatcacagctctgtatgtgacaaaccaaggtctgattccaaagctctacttttacagtaaaatcacgttgtcaccatggaggtgtatgattgaagatgaaattctgttttttaaccctttaaccagcaacccaagaacaatagtttgtgtaaaatggtatcaagttttctagttcattagtagtaggtaatgcccagtgaattaaaaagaaaggtcttgctattaacaatgaaatacaagagtagagaccagacaagacttaaccatttgtagtcttgagatctgaaactgtgagctcttgtgacattgacattgattatatgaagttttttaagatcctgtgcataccctttttgcacatatattcactgccagttacatgcctttaaaatttcctctattctagcattagattttgaaggcagctaatgaattacatttaaaataaacttctaattgccaaatttgagaaaaagtatttgtaacttaagttttaatggtttatatccataatatataaaacatacaaattaataagaaagcaagccaaaaaaagaaagattgaaggatatgaacagacaactgatagaatagaatgcatatatatgaaaaggtaaatagtttaataaatgcaaattaaaacatgctattttcttactattcactagatatagtggttacttgaaattgagctggctttgggaaactaggaagtaattaggtcttattattaacatcattggaagcacatatgttccatctgccctagaaatgaagtgagagttaatgaattgatacatgaatatgaataaattagaaatcttaaggaacaaatagaatatgaagtgtattgctatccctgcctcctctactgtcccctccaaaggcaataaaagcacataatggttttaaaggctaccttcagactaactattctgaatatattttcatagccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggtactgtgtcacccagtcagtagtcctcctaatgtctttgaacgctcttctgctattttggttgtttaaaggctgtgtactgtagtggaaaaatcaatatggtgacttgtcttttagggaggtcatatttctttctaagacaggtttatctttaattttatggtgaggaggaaatctagttattgaaagtactaaaaagatctcattttagagtacttggcaatacagtgatctgagattgtgggttgaagacattattatgaactgtgattataattaggctgcagtgaaccttttaaatcttttttattcctcctccagtataacatagccatatctataaaatagcaaaaatacttctgggaagaagtcccaaatttcctacgtgtgataaatgtcatgatgctttttatgtacagatcattcctgacttaacaatggttagacttaggattttgtgagtttatatggtgtgaaagtgatattcattcattagaaactgtacttccggtacccatatagccatcccatttttcatgttcactacagatttcagtaagttacatgagatattcaacactttattataaaataggctttgtgttagataatttgcccaactgttggctaatgtaaggttctgagcatgtttaaggtaggctaggctaagctgtgatgttcagtagttgggtgtattaaatgcatttttgacttaatgatattttcaacttatgatctgctttttgggatgtaatgccattgtaagtcgaggagcatctgtatttgaaataagtttgtaatttaaggcagctctttcctagtcagtcatatcttaaataaaaaacattaattgaaccagattaattgaattgaaattccatttcttcttttcacttaatgataatttttgtttaatgttattttcatgctgatcagtttttttatatataaaatgtaggatttatataaaaaatggaaatgtagcatttgtggttatacttcattttaactgggttttcactaaaaaatgtaattgtaattatatcgattttaaaattggtacattaatgaggacaaaaagctgttataatttatagataaaaacatgcatacacttctgtcttcaaatatactttgcttacgacgtaaatagttagaattctatttgttttgtaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggtaaaagttccgttgataagtagttgtagtctagtctaggtgcttaaggctagaatctaatagaggaaatgaatacttaactaccagacaaaagaggtaagaacaaaaatgttatttgggaaacccagaagaagaagcagtaagtaagaaatcttgtcattatttgtggagttggatctttttacaactggcaaagtcatgtttaggccaatcatgtaataatttagcctatctgtgcttcattttccccatttatagtactaggttttgcctgtttaatgccttgccactttttcacttgaatgtctggcttctttgaccaaattcctgcttttaatttctggaaggtttaacatactttcattaatattatttaagaaaaagttagaaaatttagaaaatgatgagtactttttttaaaaagaaaacaggctggttgtggtggctcatgcctgtaatcccagcactttgggaggctgaggtggacggatcacttgaggtcaggagttcgagaccagcttggttaacatggtgacaccccatctctatgaaaaatataaaaattagccaggtgtggtggcacacgcctgtgatcccagctactccggaggctaaggcaagagaattgcttgaacctgggaggtagaggttgcagtgagctgagattatatcactgcattccagcctgggcgacagagcaagactctgtctcaaaaaaataaataaataataaagtaaataaataaaaagaaaacaacatcacctctaaccctacgccttaacgatgatcaacattaaaattttgaggaaacagttccatattctgttaagacttaaaagcaatttagagatacttcaaatgaaaatctgactcaactatcttaacagacttgcctagtgtaatgtagcagagttagtctttgatactagatttgtaggtttaaaaatattttttgagtttctgtctacattttaatgataaaaattgaaattgagaagatgcatagtgtgcttatatatagatatttacaaatcatgtgaattcctatgggctactgatgtggacttggggaaaatgctggtaaaggtcaatgatttaaagatttagaaagtataattaagtggcaagtggcatcattagttgcataaattttcttatcaaaataaatattttggaattgtttaatgttcaaacggtttttgtgatataccagcacaactttaaaaacagtgaaaagttgatcataaactgctgtattttatgatagaatctgtctttgtaagtggtgtattatacttagagtaacgtattttatttaataaatcacagaaaagatgtcaaattttgtagttcagggatttcagaggtagcaggtacccctgtgccttcattttcaggtaactgctgtgccttctcagatcctggagaagggccccaggggctgcctttctgaagctatttaagcaacacttaattgccaaattgatgtctcagtaaataatatctgtcatggtccagtagaccactctttattggcaactattggtactttcaaatattttagttcttatgattgttttcaagctggttgttggttattataacaggggatgatggggacattgtatttgtaaactacagtttatgatacactcctttgcttttccttaggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccaggtaccatatgctcaggaatgaatcagttcattaattcaaatcaacaaatgtttattgagtgtttactctataataaccactgttttgggtaccaggcatacagcaacaataaatggacaaaaatccttcttctgtggagtttaccttctagtggaaagtgagagacaatgaaagtataagtaaaacagctaatgtgttagatggttaaaaaaaattgtggtaaaaaatacagcaggaaaggaagctaggaaatgcagtagaggtggggtagggtagaattttaaataaattaaccagagaatgcctcacagggaaaatgacatttgaggaaggacttgaaaaaagtgagagaaagccatatggatatcttgtggaaaaacattccaggcagaggaaacaggcatttcaaaggccctgaggaagaaacatgtttggcatggttgaggaacagcagaaaggtctttgtggctggagcaaagtgagcgaggtggaggagtaagaggggccagttagatatggctttgtaggctgttgtaaaggactttgaccttgactctgagtgaggtggggagcctttgaagagttccgagtagaggagagatgtcatctgagttagttgtcaacagaattactctggctgttatgttgagaatagactgaagaggagcagggcagaagcagttagaagactattaaataatcaggcaagagctggtcgcttggtagcagtatgaggtggtgggaaatgatcagatcctggatataacaagatttgctgaatgaatggattagatggaatatgatcatgaaaaaagtaaaaaaattatagaatggctaactgtgtaaggaaaacaaatagtgtaccattgccacactcctgcggacaagaaggatataatttatgacttcaaatccctaagactttaaatatgcatgatgtgattttaataaatgtgattatgataaatattttagatttgtacaactttataagtatgtccctatctgatttgcagtttgtcctccctctctttctttctttctctgtattggttctaccatattcttatttgttctttgcctagtttggtctgaaaagaaagctgctagaaatcagaattgaatctcatctgtgtaaacagatgtggagaatctctggtgcttttcttgttataagttcattgaccataattagccacaaaatcatcaaacaacaaaatatctttgataactaaaataatttaaaaatttacttaagattttgtgccgattagctctatatttttacaccattcttaattattgtatttttcctcattctctgtttgtgttgtattggtcagaacataatttaaaaagaagtaaagactcctaggtccgtggagcaatttttttttggtcaacattttactataaaatattcaaatatgcaagcaaagttgaaagtgtttcacagtgaacatccatgtacttgccacctagatttgtaatgattttactatatttgctctgttttataactattcatttttctgcctcccatcaatctattgtttaaaatttttatttttattttatttcttagagacagggtctctttttgcccaggctggagtgcagtggcctgatcatagctcactgtaaccttgcactcctgggtttcaagcaatcctcccgcctcagcctctcaggtaactaggactacaggcgcatgccaccacacccagctaattaaaaaaatttttttttttacttgagaaatggggtctcgccacattgcccaggctggtcttgaactcctgacttcaagtgatcctaccctctcaagtctcccaaaatgctgggatacaagtgtgagctactacctggccccatttttttttaatgatttcaaaataagatacagacatcagtatgtgccctctaaaaagttcagcatgcgcatcattaacaggatttcaatatttatagctcttttttcttcttgatataaaatttgtatgctatgaagtacacagatcttaaatgaaccattccatgagttctgacaaataataccactgtatcctgaatccctctcaagatgcaaaatttgaccatcataccaggaggttcccttctattcctttcttttaaatccctgctctttccttcccctgctactaccattcttttgattttttcctaaccattcttagcctttttttttttttgagacagtctcgctctgttgcccaggatggagtacagtggcacgatcctggctcactgcaaccaccgcctcctgggttcaagtgattctcctgcctcagcctccaaagtagctgggactacaggcgtgtgccaccacatctggctaatttttgtctttttagcagagaggggttttgccattgttggccaggttggtcttgaactcctgacctcaagtgatccgcccgcctcagcctcccaaagtgctgagtttacgggtgtgagccaccgcacccagcccattcttagcattttaattagcattttaagtacctcttcagataattgttttccaagtggttctttgttattatcagttggattcattgtcccctttattaggatggtaaattgcaaaaaccctgcttgttagttctcaagtgatttttattacagtcataccttctgtatcccagtgtcatgctttagacagtggtattttggtatcacatttcagataatatcccccaaattttggtaatttagctgactttatagaatttgggaagtctgtatggttaggagactggatctcctctgaatgcagttactcttttgctttgctgtaacacctgctctcgtttgtggccagccatgggccttggcttgggaaagagggtaagaaaatgcagtgtgtcgcccttatcacatgcctttattgactggtgaggggagaaggaagcaattcttattgccagagccaagtgggaaacagctggtggcagggaaagaacagcaaagctaatgtgttttcttaggaaatgttactagtacattctgactaagaggagtttcccccatgagtgatgttggcagaccattcagttcccagtcctgattttcttactgaattatgactggtgatttggactacctagatcttggctctgccattttcttttttcttatttgagttaaactttcagtttgtctctttgggactagttcttgaaaaattgctgtttttctaaacttttgcacagctttttcaacttatttgtttatagtattctaaattatattttctatgttttcttcttgtgctaccttatttctggctcattcagcttctcaattttaggggagatggatgcatttggtattcgttgaaattggggtggtagtaaaatatctaaatggagttctatcacagtgaaaacttaaaacaatatgagcagtacaaaagaaagttgtcaatgttagggttacatgttttggagtcactggtagtgttgaaagtcagcgtttttgagtggctatgaagtaaagggaatatgaagggcaacaaaagcctgatgtctgaatcttaggaagttaaatttttggaacaggaagagaggggcaagaaagggaaagagaagaaaccatttaagttaatattataaactacaatgaaagagaaaacttatgaaaagaatatgtaggcctctctcagtgagacaaaaaccctactagcatgaaaacctcataatgccattgatgcactctcatatagtgccctctggtggaatgcaattgatacctctttcctggaggtttttttacaatatatgtatcacaagcctttatgatgtacatatcctaaggaagtaactaagaatcaactcagatttagtttcaagactgttcagattgactttctttataatagcaaaaaattaggagcaaactaaaagttcagcagcagttatcaatgaaaaacattgataattgtgttttttaaaattaggtttaagaaaagcatatggggtttctattttggaatggcagagtaaggacctccaaaaatctgttcctccataaagcaatgagaatactggcaaagactgtcaaagtcaattttctgagaactttggaaatcagctaacacctttcagcaatctaaagtggattcaagaaaaacacctgactctcagtaagaatagtgagccatgtcgtccttaacttactgtaatcttatccccctttaccagctctgtggtagtctggaaaaacagcctcacaactatggtagttatgaaaactagccccttagtagacagtggaggggtcataatggcattggagctccccaaaagcacatctccagagaattgtcactatttgacctctgtgccagctggctgaaaagttctgttttcagggcccatctttatttgacttggcccataccttgttctttgagaaaactcttactcacagggcacttgttgaaactaatcagcaccatttatttaacatagcagtcatcttgaggtggcatcagcaggctgacagaaagcttaaaaggaagaactgggtaatgagatgtccatatgggcctttgaaaagttttgatctattcttgggtccttataagaccacatgtatgtgtagagttgtgcacatacccaggaagaaactgaaaagaccaaattctcatgtctggctggctttgagactctgtgcaagcaagaactgaaggctaaagcagagatgtaaaatgcttgatggagtgttgaaggtgtgccacaacacaaacaaaaccctcacttaattgttcaaggcattgaaagaaatacctgccagttattaggtgatcacttacctaactgaacagagacttcagtggccacatatgacaaggaatacagactttatagaattagtggaggaaagtcattaaacaaatagcaacactttggaatcttatttccaaaattgacacgttatattaattttgaatgcacagttttgaacaaaagattacaagttaggcaaagaaacaagtaaggatggcttatacctaggaaaaaaccttactagacatagattttaaatcagctattaaaaatatgtgcaaagaactaaaaccatgtctaaatatttaaaggaaagtatgagaacagtgtctaaccaaatagacaatatcaataaagagatagaaatcataaaatagaaattctggaactgaaaagtataataacagaaaatttgctggagaacttcaatagcagatttccactgataagagcaaaaaatcagagaatttgaagatggttggtattatccagtcagaggtacaaagaagaaaagaataaagaaaaatgaatagagccttagagacctgtggtgcactatcaagcattctcacacatgcataataaaagttccagtaggagaggagagagaaaaggggacagaaagaatatttgaagaaataatggctgagaacttttcatgtttgatggaaaacattaatctgcacacccaagaattcaatgaattctaaataggacaaaatcaagggagccatacctggacacatcataaactgttggaagacaaagacagaattttgaaagcagagagagaaaagtgactcatcacatacaagggatgttctataaaattaacagttgatttttaagtcagaaatgatagaggccagaagtcagtgtgttgaaaggaaaagactgtcaaccaataattctgtggcagtaaaattgtccttcagaaaccaaggagaaattaagaatttcaagataaataaaaagagggaatttattgccagcagattttccctaaaagaaatactaaagggagtcctttatgctgaaatgaaagaatatgatacagtaacttcaatccatataaagagatgaagagcaccagtaaagataacataagtaaatataaaagtacaaattatttttgtttgtaactctttttacctgctatctgattttgaaagatgactgcatgaagagataattagaagactgtgtcaatgggcttatgacatgtagatatgtaatttgtatgacaatagttatacatatgagggaggagggaagagacatattagagcaaagtttttatgtattactgaaattaagttggtattaatttgattattttaaggtgttcattgtattctcagagcaatcacaacttataaatgtaatcacaaggcagagttggtagaaggggtgaaaaaacatgatccaactgtatgctatgtatgatagacacactttagatttaaagacataaatagactgaaagtaaaagaattgaaaagataaaccatgcaaatagtacctaagaaagagctaggccatgcgcagtggctcatgcctgtaatcccaagcactttgggaggctgaggcggtggatcacctgagatcaggagttcgagactagcctggccaacatggcaaaaccatgactctactaaaaatacaaaaaaattttgccaggcgtggtggcacacgcctgtagtcccagctactcgggaggctgaggtgggagaactgcttgaacccgggaggtgggggttgcactgagctgagatttgccactgcactgcagcttgggtgacagagcaagactccgtctcaaaaaaaaaaaaaaaaaaaaaaaaagctggagtggccaatgtcagatagaacataaactttaaggcaaaaattactcctagagacaaccaaggagattttataatggtaaaaggatcagttcatcaggaagacataacaattacaaacatacttaacagcagagccccaaaaacacactaagcaaaaaccgatagaattgaagggaaaaatagataattcagttataatagtgggagcctttaatagcttattttcaagatggatagaacaactaagcataagatcagcaaagaaatagaaaatgtgagcaacactacaaaccaaccagatttaacaggtatcagtagaatactccactcaggaacagcagaatttaaatcttccttaagtgtacatgtaatcttttctatatttaaccatatattaggtcacaaaacaaacctcaataagtttaaaaggattgaaagcatatgaagtatgtttgttaaccaaattggaatgaaactaggtatcagtaacagaagggaagttaggaaattctgaaatacatggagattaaacaacatatggctaaatacccagcgtttcaaagggaaattagaaaatactttgagatgaataaaaatgggaacagcatactaaaacttggataatgcatctagaggagtactaaaagggaaatttatcactgtaaacatttatattaaaaaagaagaaagatcccaaattagtaatttaaccctaaccttaagaaactagaagaagagcaaacttaaagcaagtagaaaggaatgataaagactgaagaggaaataaatgaaatagagaatagaaaaaaaaaaatcagcaaaagtagaaattggttgtttgtaaagataaacaaaattggcacacctttactatagtgatcaataaaaagggaggactcaagttactaaaaacaggaattgaagggggcacattactactgacttgacagaaataaaaaaagagtactatgaaaggaataccatgaacaattgtatgccagcaaattagataacctaggtgaaatggatgaattcctagaaagacacaagctgctgaaaatgactaaagaagaaatataaaatctgaatagatctataataataaagaaattagtaatcaaaaaacctcccacaaagccctggctgagatagctttatggtgtattctaccaaaggtttaaagaattacaatagttctccattatgtgtggaagagacaatccaagacccctagtggatgtcccaaacctcggatagtaccaaaccttatgtatactgtggtttttgttatgtgtacatatctatgataaagtttagtttataaattaggcacagtaagagatcaacaacactaatagaacagttacaataatatattttaataaaagttatgtgaatagagtctctatctctcaaaatgtcttactgttctgtactcacccttcttgtgattatcaatctcataactgggacagctactaagtgactgactgatcaactagcaggtaatgtcttcagctggataaaggaatgattaaagtcctgggcaggagggaacaggacagtgtgagattttatcacactactcagaatggtgcacagttcaaaacttatgaattgtttattctggaatttccatttaatattttctgactgcggttgaccacaggtaactgaaactagggaaagtgaaactgtggataagaagagactaatgtaacatccattcttcaaaaagtcttccaaaaaataaatgagggaacacttcttaactcatcctttgaggcagatgtcaatctgataccacagccagataaacagttcacaagaaagctgtagaccaatacccataattaatataggtgtaaaaatctaccacaaaataatagtaaactaaatccaacatgtaaaaaataatatcatgaccaagtacaatttttcttaggaatataaggttggttcaacacatgaaaatcaattaatgaatgtaccatattaatagaataaagggtaaagaccaaatggtcatctcaacaaactctcagaaagtatttgacaaagtccagtatcattttatgattataaccaactcaacaaaccagttagtaatagaaaatgaataaaggccatctacaacaaaaaaccctacagctaacattgtacttaatgttaaaagattgaaagctttccccctaagatgaagagttagacaagaatgtccacttttgccacttatttgaatactgtactggaggttctagccaggacatttgggtaagaagaagaaattgaaggcatacaaattggaaaggagaaagtaaaactttctgttagtagccagcatgatcatgtatatggagaattagcaataattaaacaataattgttttaaaaacttactagaactaataagttcaacaaagttgcagaatacaagatgaatatataaaaatcacttgcatttctttatggtagcaatgaatagtccaaacatgaatttaagaaaccatccatttacagtagtatcaaaatgaacaaaatacttgggaataaattttacacaagaaagtataagatttgtatactgaaaaatactaaagatcattgaaagaaattaaagaagactcaaatgaatagaaagaaaccccatgttcatgcagtggaatacttaatatcattaagatggcagatctctcgatgtacagatgcgatgccatctctatggaatttctagctgccttttttttttccctgaaatcgatgatctgatcctaaaatccataaagaattacaagagactcagaataaccaaaacaatattgaaagaaaagaaccaaattgaaggactcacacttctgtatttcaaaacttgctacaaagctacagtaaattaagacagtgtagtacgggtataaggatagacatatagatcatgtctatgtctatgtctgtgtcatatattcatggtatagaactgacatgcagaagtacatttatggtcattttttttttgacagaggtgtcaggatatttcagttgggaaaagaatggcctttagaacaagcagtgctgggattataggatttccgcatggaaaaagatgaatttcagtagacttattcaaaatggatcatagactaaatgtaagaactaaaaccataaaacttagaagaaaacataggcatgtaaatcttcatgaccatggattaggcaaggatttctgagaaattacgtgaaaaacacaagtaacaaaggaaaaaatagacaaatgggacttcatcaatgttataaacctttgtgcttcgaaggactctatcaagaaagtgaaaagacaatccacagaatgggagaaataacatatatcatatatctgataaagatctattatttaaaatgtataaagaacacttacaactcaacaataaaaagacaaatgacccaattaaaaagcaaatgatgtgaatagatgtttctccaaataggaccaataagcgcatgaaaagatgcttcttagtcactagagaaatgtaaatcaaaaccacagtgagatactccttcacacccactacaatggctatagtaaaaaaggcagtgaccagtgttaggatgtagataaattgaaagctttatacattgctggtgagaatgtaaaaacagtgcagtaactttggaaaacagtttggtagcctttcaaaacggtagacatagagttaccatatgaccctatgattccattcctagctatatacccaagacagttgaaaacatatgttcacacaaaaatctgtacacaaatgttcatagcagcattattcataatagccaaaaaatggaaattatgataaaatgtggtatatctatacagttgaaaaccagccataaaacggaatgaagtactgctacatgctataatgtgagtaaaccttgaaaacagtatgctaagtgaaagtagccagatccaaaggccacatattgtatgatttcatttatattaagtattcagatagataaatccatagagacacaaagtagattagtaattgccaggtgctgggggaagggagcattgggaagagacagctaatggatacagggtttcttttgggtatgctgaaaatgttctggaattagataatggtgatagttgtaaaatgtggtgactttgtaaacccctttaaaagggtaaatttggtgatatgtgaattatatgtcaatattaaaagagatggggagagaaagcctaagtgtgtgtgagagaccaagcatattggcactcccatctctgccattgcttgtcactggctgtctttactcatttacagtactgattgggcccctgtggggcccctgtgggcattgtgtttgagacatttgtccacacaaagacttatacacaaatatttatagcagcgttattcataatagccaaaaggtggaaatgactcacatgtttatcagcagatgaatggataagcaaaatgtgatgtagccatacagtggaataatattaagcctaaaaatgaatgaggtattacataccacaccataaactttgacattatgttatgtgaaagaagcttgatataaaagaccacacaatgtatgactgtatttatatgaaatgtccagaacagggaaattcatagaaaataaagttgattagttgttgccagaggctagggagagggggaaataaggaatgaatgctaatgggtatgaggacagcttattttttgatttcttataattaataaaaatggcctggaattactggtgatctttgcagaattctgttaatatactaaaaatcattgaattatgcactttaaaatctatggtatttgaaaatcatttcagcaaagctgttattaagaaaaacaactaggccaggtgtggtggctcacacctgtaatcccagcactttgggaggctgaggcaggcggatcactaggttgggagatcgagaccattctggctaacatggtgaaaccctgcctctattaaaaatacaaaaaaattagctgggtgtggtggtgggcgcctgtagtcccaactactcaggaggctgagtcaggagaatggcctgaacccaggaggcagagcttgtggtgagcccagatcgcaccactgcactccagcctgggtgacagagtgagactctgtctcagaaaaaaaaaaaaaaaaaaaaaaactagagagagatactgataaaatatatgaaatattacagatttttttaaaaaaaacaagtgtgaatgtattgtaatatgtatagaaaaccttttgaaggatatgtaacaaaatgttaagtgtttctgggtggtattataaatgtttttacatttctgtatttagtacacttaatatgcattaacttttataataaagtgaaataaattacacaagatagatgaatgtgttcggtgttcaggggcttttgaccttttagaggtatggccccttagaagcgtaaagttgcagtctgtgtggagagtaatggaggagggagttggtgataatggaggtcccctgtgtagatgatatattcaagaagtttggcagtgaattcaaagagagtagaaaacacagcttgagaggtcagcatatgtgtgggagagactgaatattataattttgcatttatgaatgttttatggtttacatattacctgattttccctatggtccggttagggaaataggtcagtacttgttttgtagatgagtaaactgaggcatacaactggttaagtagcttgaccaacatcatataagtagttggtagtagaagtccgtgattccaaagccaatgcttttccttctgtgccaagctgtgtgatagaataactgaagggtataagagtgagggtttaagatattccaggagttgaagaagataggatcaggaccacaagtatgggagttctcattagaaaagagttcaaaaccagcctgggcaacatggcgaaaccccatctctacaaaaaattagccaggcatggtgatgcacgcctgtagtcacagctgccagggtagctgaggtgggaggatcacttgagcccaggaggtcgaggctgcagtaagctgtgatcgcaccactggccactacactccagcctggcaacagagtgagaccctgtctcagaaaaaaaaaaaaaaaaaaagaggagaaggaggggtagtctatgatagagagaagtgtgtgcagatggccatttgaaaatatcggaagaaaaggcaatttttgtaacagttcttttgagaggaaattcttgtttttgtcctgagatcagggagattaaatggaccccaaagtaataattttgcttgctaatggccatgtggatatttaacattagcagtgacattggttcataaatgaattttatttttctttcattcagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcaggtatcttatcttttgtctttcttaaacattgtatttagtgcactacagtaccttaagtctcctttctaccctgcaatgtagttgggatcaactaagggcctcttacattgcacttctttttttaagcccataaaataaataaataaataaataaaattttaaaaatgtgcttccagctcaaaactgtcaaatgtggttagtctcagaagatggtatctatgtatcttatcttctgcaaacttgtcaagaggtcaaaggggcagctttgaacttgcagctcatcccagtctagaatttgtctgaataacctaaaattaccagttatatcttctgtctcagctactaaaaacacaactctgcctgattttgagaatgtgagtgttcttcattaaggaaaactcaaatgtcagcattctgttgcttggcattaaaatctctgaagttgatggggacatggagaagagcatttagacagatgatttgcttatcattttaaaacaaaatagcggtggttttatttaagaatgtttattttttataaattgtggttgcttgcagattaaatgcatacaaggtaagatatttaaagacaaagcagaacaatttttgaccaatatgtgttacacactgaagatttcaaagacaagatatgttatgctttaagaatctacagtctagtggaagaaatagacaagtgaacagacaatttcagtgcaatgtggtaatttttacatggataacaggagccagcttgaaagggaagacaacaggcaagaccaggtgtgagttagccaggtgaagcaaggtggttaagaagggccaggtggaggtggtggaccccacagaagaaagcaaaatgaggagttgtttagtggatgataagccatggccattaggtagcttaaggcagaaagggatatttgttgggtcacctgggcttttgttttgttttgttttgctttttgcatttaaaaagattttccacacattcattgaacagatttaagcagcttttgtccaggacatattctttatggcctttaataacaaataccagcctatttttaagaaagtctgtttccgcagatgatgtctgtatagtaacatatctattgagtttcatgtaaattatttaataacttggcatagtgcactgtgtgatgactgagcccacaggccctacacgcagacagacatgcacattcagtgcacggttgtctctcagccaatggcacttttcactgtaaatgttactgtcttaaagcaaacactagataactacctaactacctaggtaaggagacaggcaggatgtttagcttttactctgcctcacagtgtgtgcttcaaagaaactttgccataaggtcataagtttttgattgttttggttatatcaactgttctcatagatagctcttactaattagaatttgtggaaggaaccattttacattttagttggcagttggattttttcatcactcctcaatgggaaaatatggtcaaaattagaatatttgtaagtacaagtgtttatccaagggttagcagactacagcttgcagtatggtccataaaataagaatgatgtttgcatttttaaagggttgcaaaataaaaataatattcaacaggaatgtatgtgattcacaaagcctaaaatatttacaatctgactccttatagatgatgtttgctgacctctgatctaaaagataaaactaaaactgcctgtatgaatgcatgatatgtgtgaataaaggagactggccaatgttttatgatgttctttttagttttaaaaatgcctcagcttcaaaaaaaaactagtacacttatatagtagaataataatctgcattataaaggaatgagttattgactcatgcaacaacattgatgaatcttaaatgcattttgctaattaacccacttaactgtataccacaaaaagtgaatttaaatgtatgtaaaatttaaaaagttaaccaggatgtaaggggaaagatggaatgcagtctgtgacaaattaatctgttttacaagtgaatcacataatcacattgaagggcatggcgaataaaggagtaactttggaaaacagtttttgaatttgacactgggaggctaatgacaaaaggaactcaactcaaacgttgtattctagttggttgtttttcacagggttaacaatttcattttagcagtttcaggtttaacaattctgaaactttacccttcgtttatatattcaggttgaacaaataagtaaatgtattgtagttatgagagccaggtttgtcactgttagagaaaggtattacagatgaatgaactctggtgctagataggagttggagattatcagtatggactcatgatatttgtgtatgcataggcataaatatatacatgtatacaaacacacgaacagatgcagaaatatagatgtgtccacatgcctgaagtagtatacataatatatcttttagctctggccattgagaggaactagaagcaggcacactgccgtagcaatgaacacatagggcttagatttttgtttctaaataccattcttcaataaaaggaactagtacttctagaactggttgattccaggtgtgtgggaaaaataaaacaagcctggagcatcttgtggtgtcaaaaaattaggaagtatttaaaaaagtacattgaaagggcacaagagctaacatgaaagagcttccagtgggcaaagttggaacaacttgggcaacaaaataaataattgtagtattagattgtaactcaaagaataaaataaatatctgtgaatccatagtggtataaataagtgaataaataagtttatggggaagaagtgacaacttacagaagaatcccagtcaactaatgtagaaggactgagggaaacaaaaagtcaccattagcttaccacaggcatgctccctcaaatggatgttaaaattagtgggccaaagttaaagcagaaactgaatttttgcattgtctcaaagtatttttgccaaatattgagtaattataaagggaaaaaatgtttacaatggagaatcctagcagacaccagcttaattcacatgattcaagttaacatcataagtgattcaggttaaacatttctaatctgaaaatccaaaatgctccaaaaactgtaagttttcgaatgctaatatgatgtcacaagtgaaaaattccacacctgactttatgggacagtttgcagttaaaactttgtctcatgcacaaaagtattttgtacaaaattaccatcaggctaggtgtataaggtatatatgaaacaaatgaatttcatgtttagacttgtgtcccattcccaagatacctcattatgtatatgcaaatgtttcatgctaaaaaaaaaaaaaaacccaaatctgaaacagttgtggttgtgagcattttggctaagtgataattaacctgtacatgctaacatccggtcctccctcacatgatgcactgagaagggcacatcacttctgtggtatctttcccaataaggcataatttcaggataataatgagaaaacatcaaacaaacccaaattgaggaacattctctaaaataaccagtagtcttcaaaaatatcaaggtcatgaaagactgaggaactgtcacagattggaagaaatttaatattgccctgtattatcctggattggatcctggaatagtaaaaggacactattgggaaaactgataaaatcagaacacgttctgtactctaattactagtattatagcaaggttaatttcttagttttgataaatgttctatggttatataagttgtttacctaaggggaagcttgagtgaaggatatacagcaactctactatttttgcaattcttctctacatctggaatttttttaatgtgtcggctttcgttttcttgatagagtcacatagctctggtttcttgactatggataggatataaagtcatcttaaagggagactagtgctatgttttcagtgactggaaacgtctgtgctttgtgtatttctctagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtaagctaactttcaagtcattggctgggttttgaatgccactaatgcctgcaattgctgtcttgtgaaatcagttttttcctctttgttcattggtaatttttcccgtcttttttttttttcatagtcatgttaaaataacttgcaattttatttttttttcattaaaaaacaggtttgaaagggtggaatcagtatcctaaggcataaaacagtttcctcattgtccttgttcttaaatgagcctccttactttataatcattaagtgatcagatttgctggcattctcttactctggcagtgaagcagcagacttaaggaaaatagcatccaagtttgggcaggcatggtttaaattccaatagctttaggcaggttatttaactcctctgaggttcagctatcttcatcttcaaatggggctaatcctttcaagggcagctttgaggatttaatgaagtaaaaggatctgtcacagtgcctgttgttgagagaagagctaagcaatggtttcttactttattgtttgccttgtctccaaaggctaaagatgaaccaagtgatccagcttgcttaagcaggattttaaaaaatgtattgttgcatgatattccattttatagataacaatttgtgtatccctctatccctcagttgatggatagctgagttgtttctagtgtttggcttttcagagtcaacctgctgtaaatatttgcaaataagtctttgtaaggacatatatttccattaatctcaggcatatatatacccaagaatgggattgctgcttttgtaaaatttcttttttgacaaacaattgtatatatttattgggtacagtgtgtgatgttttgatacatgtattaattgtgggatgattaaatcaaactaacaaatctatcaccttacctacttatttgctatgaaaacatttaaaatttactcttggcaactttgaaatatacactgtattataatcaccattctctgcagtagatcactaaagctaattcctcctaactgaaactttgtactctttgatcaacatttccccttttcccatctgcccctttcttaagtttcgcgtttttccctcatggtgttttgaacctgccgcttgagaaactaccaccttattcttttttggttggcatgcttattcagagagttatcttctgtgcttgaatttaggttttctagattccctaactcatatttgttacactgttaagtgtgtgccctttgctttattactttttatgtagtttatatggaatgcattttttttgccttttgtgtgaataaactgcacagggatagaaagatgtaacatacctgtctatagaatgtttaagagggaagggcaaatggaaacaattgaaatctgatgatagctacaaagctgctgctactttgggattggtaaagtgatcattgaataccagtaaaacatctttgggtatttaaggcaatctgaacattttgacttaccaaattcattttgtatcttctcaatagcttctgtttttgtgggtgccttcggcaattaataacaatgtcagcaactaataaattattcattttcaatttacattattagtagtagcattatgataagcactttatatctcagttatttatcaaccaaaggggtattgtttgaaaatggtgagacagcttcatgagaacaaaacttttttttaagtaacgaaggcatttttcaaataaattcataaaaagctaatactatttttcatttgtataaatgcagcttgatgcactttgatcattagatggtaatctttttttccttttttctttaaggtacaagcagtggtaccatggcttgttgggacatgaggttccagttgccaatttcaagtcactgtcatccttccagggctcgaatcagacgcctctcaatgcaccctctgtatcagtcctgggtgattgcaggtaagatggagggctggctttcatgtgttgggagattttcttggaaagtacataataacctgttgccaaaactcatgtttttagttttattttacatatgaactgaatgcttgattgtcttctgattatggaggttgccactattgatacctcactgtcatctatgttcaaaaatgatctcatcagtcaccatcattactccattcttaactgtccaccaccatctcctatcccttttttcttcttcctgtgtcccctatttttgttacagctgccaccatcttcctagagagctaagttagaaaccttgactcatccttctttgttgcaatttcttgttgctctgcttcctttgtgttgcttgaaagcttcccttcccttccttcattgggcacccaaattttcttttatggctcctgggcatgatacttgggcaagtcttgaaactgattttcctcatctttaatacgtagttaaaaatacttaccttgtagagttatagggaactgagataaaacatgcaaaatacatactctagcacacaactaatgcttgataaataatagctcttattattcttaggttttcccctcagccctcttgcctctaggctctttgtggtcccttcttgtacacatagtccatcgcatacactgctgctatcaaagtcaccgtgttgccaagttctaaggctattactgtgagcccttttcttatttgacttatcatttgatcagttgatttctgttattttcaaatactttccttacctggtttcaaggacatttctcttggttctcctacttcttgatctgctcgttccttctcatcttcctggcttttaaattgtggcctgcctcaggacccagtctttggtctcaaccacttctcctacactggctctgtgtttgatctcatgcagtctcatgctttaactactaaatttattcagactcatacctatttaaaatctctcttaagatgtctaatagccattgtaaactcaacatgtctaactaaaatgaatgcttgatttcctctctactaaatgtctccaccactgcctcctaccctgctcttcctatggtattctttcagtaaatggcagctaggtgctcagaagcctggaattatcctcgactgctctttttctcatcccacttccagtccattagccagtcctgtaagttctattttaaagtatagccagaatttgatcactcttcactacctccatcactatctccctagtccaaaccactataatctctttcccctattaatgtaatatcttcttcacagcctgcttctgtctgtacctcttaagaccatttttttcttctgctcagtaccttccattggcttcttggtccaaaagactttatgggaccggccttcttgccacctctctgacccttatcacctacaattctaacaggaaacagtagcacactcaaggtaggataatttaagaatttattttcaaataaaattgtttacaaaggtttgggtgtagggggtattaaaaaagatagcacagtaatatgggctggtaacagcagagtagcagtagaaggcatgaggggaggagggcatggttactgaatttgggaaggagtagagaaggccaccttgaaaggagcagtgactgtgagatgagggatacaaccagcctgatatgaatgacttgactttcttccctccctccctttgatctcctgctgcggtttcccataggcaagtattagtttcctattacatcacaacttatttttttaataattctagaggccagaagtctgaaatgggttttgtggaccaaaatcaaggtagcagcagacttgtattccctctggaggcactaggggaacatctatttccttgccttttcctgcttctagaaccaaattccttggctccttctttcatcttcagagccagcaacatagcatcttgtttcattgttatactgctttctgttcttgctgccaaatctgcctccctcgcctaaggagatttgtgattacatgtagggccccctgagtaatccagaataatctgtctcaaggtccttaatttcatcacatctgcaaagtcactttgccacataaggtaccattcacaggttccaggggataggacttggatacctttggggccattatttagcctaccacaggctggcggacccagccagagggagtacagaagcttgttgatgtggttcattcaggtcagatttagagcagcaaatggaaaatgaccagcattactgccctttctcctacttatctcccattctcagtctgttcctgccacactgacttgttttttcaactaagcacactcctgcttcagaagggcctttgcatttttgtctgttgtccccactaaaatggaagttccatgaaactgggaatttttctgctttgtttgccatctcttcttcagtgcctagcgcagtgactagcccatagtaaaaatatttactatatttactggctcagtaaatattattaagtgaatattatattgtctctccccctgaaagaaagaaagaaatttttctttctttctctcaggactgcaatttgttttgttgtaatcttctccaactctttttgtctgagtcaagattctggcctttgtttcctttagctgttcagggcaacaacgaagtgtccatgtgggacatggagactggtgacagaagatttactctctgggccagcagtgcaccaccactttctgaattacaggtttgacttcagtttttactgtaaaggatgatattattccccacatcctaagtactttcaggcatttaatcaaacctagtatctgttgggcttttgggttatgtttaaatttgggtttttaataacatcaagtatcatgtggccattgctacatgagtgtttccttgctagtgttctgcattattgggtaaataagttgctagcccataaagcttgtgatgtctctttggaaccccaataagatctagcataattaggaaaaggccagattgaagtagatagggcatacataactggtctctcatttcttcagttaaccaggtgcttgtaaagctactgacagttaacttgcctctagaaatagcactatcatttatggaatacacggatgtcttttatttgactccacatctatttcttttaagccttctcctcatagcgtccatggtatctactgtagtcctgcagatggaaatcctatcctactaacagctggctcagatatgaaaataaggtacactatctcaatactttaataaaatggatacttttacaagctgttattatagatactgatggcactgtaatgtttaaaatcatcttataaggacagctgttaatactttatttgtaaccaatggtatgctgttctatgaaaacctcttttcctaatgcaaaagaaaaaatgcattgatgaagataagccaatgattattagttcctcccattgtcctgaagagattgtcatcatttatttcctctttcctaggttttgggacttggcttacccagaaaggtcctatgttgttgcaggaagtactagttccccatctgtgtcctactacaggaaaataattgaaggcactgaagttgtccaggtactgtagtcttttcattcctttcaccttttgtaagcacaaacatggcttttgtaaacagaattgattaaaataaatggcttgaccaagcgaggagtactttgaatttaggaaatttattttttcttgaattttctgtatttaaaaaaattaacttttattaaggtaaaataagcataaagaaagtgcatataagtaatagctcaaatgaccagtatgtactttataacatcgtaaggaagcacttttattatcctcttacaaatgaaaaaggcacagtgaagttaagtaacttgttcaaggtcacacagctagtaaacagaaagctgggatttaaacctggctttgggactgtaaagtttgtattcttgactcaggcaaaaacttcaagtgagaatatacctttagcacctgggccaaagtaggtgctctgtaaatgaaagtgtgcttccttcatgacaaatattaatgagctttagaagtggtagaatatctgctatgtattttttatattttggtcatttatacctctttttttttttttttttttttgagatggagtcttgctggagtgcagtggcacgatctctgctcactgcatcctctgcctcccaggttaagcgattctcctgcctcagcctcctgaggagctgggactacaggtgcacgccaccacaccctgctaatttttgtatttttagtagagacggggtttcaccatgttggccaggatggtcttgatctcctgaccttgtgatccacccgccttggcctcccaaagtgctgggattataggcgtgacccaccgcgcctggcctatacatcttttaattatattctatcccttttttcttttgatgttggcaaaagttaatatgcacagaatattgacctaagataagttttccatagttataagtggctactcatgaaatccaatgactaggaccctagaatgtcattttggctcctctactccttttgctcaatgtattcgtgaaagcatgactacaaaaggtgttaacttaaatacaacaacagtatctcagaagcaggactactgacgagaggaaaaatgtggtacagacttttaacctctggcttgctcccttttaatcaccaaacaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgta

SEQ ID NO: 37780 - DNA, 52282 bp, Homo sapiens
gacttccggccgcgcagcggtgggctgagctaaaatggctgaggagagagtcgcgacggtgagcgccgagattctctttagttgcccggccgcagggcaaggcaagctggcgggtggcttttgtcccatgcagcggttcctggagagaggcggagctgggtgccgagcgtctcagggtgggcggggcgacacggtcccctttttactgtcccgggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaaggtaatgactagcacttgtgtagacagttcctgttaatcccgtgaattgggaatttaacatgcctggaagcttgcagcgtcactgccttctgccagtggagcgggactgtgttttttctgtggtgattaagtttaggaaagtacggttttggaattcatctgaaggctgagttgggcgttcactccacagaactgctaatatagaggaacccgatgaattcaggatgacctagtcgctattttttgaggcatatatctataattggatctaatttcggtaaagtgccaagtgtgaagctttgtttaccttgctttagtgttgggtttgaaagcctgttctgtccatttgttagaatgattttaggtattcggaatttattgtctttcgaaaaacgccctggaaaacagtacaaatagcagcctttggctgttttacaacttagttttggctaagcagcaaggttagtgttattgttagagggccttttgtttgttttctactctcatttgcagagtagtcatattattctagtctaattagaaaactctgaagacagaaacttttttttttgagacggagtgtcgctgttgtcggcccgggctggagtgcaatggcgcgatctcggctcactgcaacctccgcctcccaggttccagcaattctcctgcctcagcctccggattagctgagaatacaggcgcctgccaccacgcccggccgaaacatttttattaagctaagaaatttaaaatagctaggccggacgcggtgcatcacgcctgtaatcccagcactttgggaggccgagacgggtggatcacttgaggtcatgagtttgagaccatcctggccaacatggtgaaaccccgtctctactaaaaatacaaaaattagcggggcatcgtggcgctcgcctgtaatcccaggtacctggaaggctgaggcaggagaatcgcttgaaccccggaggcggaggttgcagtgagccgagatcatgccattgcactccagcatgagcgacagagacagactccttctcaaaaaaaaagaaagaaaaaacagattttaaaataattaaataggccaggctcagtggctcacgcctgtaatcctagcaccttgggaggctgaggtgggtggatcgcctgaggtcaggagttcgagaccagcctggccaacgtagtgaaaccctgtccctactaaaaaaatacaaaaaattagctggacgtggtggcgggcgctggtaatcccagctactagggaggctgaggcaggagaatcgcttagaacccaggaggcagaggttgcagtgagccgagatcgtgccatttcactgcagcctgggcatccagagcaaaactccgtctcagaaaaaaaaaaaaagtaaatagcatggttaatgttactgggttttaaatattaaaaacataggaaagaaaatacttccactccagcctgggtgacagagcaagactccgtctcaaaaaaaaaaaaaaaaaaaaaaagaaaatacttctaagtaatcttaaagtgtaaaagataatgggtaacataacattgctacaaatatagcttatcctctagtgctcatcacaagtgtttgtgtaatagaatatgaacttgagtctgtgacggcagaattgtcatgtacatttgaatgtctaatactgttttaaagagaatagcttttgtttcgatatgacttagcaattaagcctgaagttaactgttttcattgttgtcaaatttattgctagtagtgttacgtttatagtaattttcatcttttcaagttaccaatgcatggaaatgtgaatttctgtccttttaggaagtggtattttatcttttttttttttttttttttgagacggagtctcactttgtcgccctgtctggagtgcagtggcgtgatctcagctcagtggaacctctgcctcccgggttcaagtgatttttctgcctcagcctcccgagtagctggggttacaggccctcaccaccatgcctggcttatttttgtggagatggggtttcaccacgttggccaggctggtcttgaactcctgaccttgtgatctgcacgcctcggtctcccaaagtgttgggattacaggcgtgagccatggccccctgccttattttttaatacaattaaaagaacccagtaatcctactcctagacctgtgtcccacagaaaaaagtgttaaacatgagcgtgtagtactagggcattcgttgtagtactatccgtagtggcaaaacgctggaagcaaattaaatgcccattaatagggtaattgatgacttcagatatttccatactgtggaatattatgcagtcattaaaaagaatgttacaactaattgcttttcctctcagaagcccctctctctcactagagaaagctgttctcctttctttcttctgcctattaaacctccattcctaaactcagaaagaaaaaaaaaaaaagagaatgttacgactaattgacttggagggacttccatggtgtacatttaaataaaaggtagatgtgaagtggggtatattatgtgatcttaatttcataacacaaaggaaaacatatagatccgtagataaggatatatggatatggaggagagaaaaggaaaagactcaaaactcacagaatttttgaagaaatgtatagctaaaaatctaagaaggctacagtcaaggccttgaggccagaagacaccccatcaaaactgagtaaaactagcccagtgtgggacgcagaaattctagtatgctaccaaaattacttacggattgctaccagttccttagaaggaaaactgaggactaatatttgtattttcagtatagtttagaattcttaaaaaatgagcaaacaggctgtacttggtggctcatgcctgtaatgccaggacttgtggaaactgaggtgagaggataacttgagtccagaggtttgagaccagtctgggcaacatgttggagccccatttctacaaaaaacacaaaaattagccagacgtggtggcacgcgcctgtcttcccagctactggggaggatcatctgagcctgggggaagttgaggctccagtgagccatgatcatgccactggactccagcaggggcagagtgagactttgtctgaaaaaaacaaaaaatgaatgagcaactaactctggctttcatgatttgtgcttataaatctttttatttatttatttatttatttatttatttatttatttatttattttgagacggagtcttgctctgtcgcccaggctggagcgcagtggcgcgatctcggctcactgcaacctccgcctcccgggttcacgccattctccagcctgagcctccggagtagctgggactacaggcgcctgccaccacgcccagctaattttttgtatttttagtagagacggggtttcaccgtgttagccaggatggtttcaatctcctgaccttgtgatccgcccgactcagcctcccaaagtgctgggattacaggcgagccactgtacccagcctataaattttttttataatgccctgattcccattatttgatgtatttggataaatatgtcatcctgtaaattgaaggattaaactgataagagcagaaaacagaaattagtacactagttgatctggctcagatatagtgcctatgtatcaggtgctccatgaatatttgttggatgaataaatgatcataaaactatataaaaatgaagaaataacagaataaaataatttgttctatataaatcctatgaatgagattgagtgggctaatagaatcctttccatctcaaaatgttctggaaagtcttgagtaaaagactcatcaaaaaaataattctgctttgtgcagaaagaagggttgctgacctttgaaggtgctttttgagtctttaacattctttagtagtatattccccaaagttaagaaattctagttagattttaaaaaattgagttaacatttaaaaaacagttttgttgaggtataatacacgtaccataaaatttactcaatttaagtacaaagtttgatcagttttagtaaatttatatagttgcacagctgtcatcagaggctgcttttaaaacatgtccatcactccagaagggttcctgtgtcaatggaattgctgggttatattgtttaagtatttgtttaaaaaaacagaaacaaatctgcctaacttctgcaggctatatacgagttaacatttccatgagcaatgcatgagggttgtgatttttccacatccctgtcaacacttggtttgtcagtttgtttttatttagctgttgtagtggatgggtagtgatggtgtatggtggttttaatttgtatttccttcatgaataatgatattgaagattttttatatgtttattttccacccgtatctctttggtgaaatgtctttataaatttttgtgaatttttaaatcaagatcattaaccaaatgagcccctcatttgggctcaagtgatccttccacctcaacctcccgagtagctgggaccacaggtgcaggccacgcttggctaatttttgtatattttgtagaggcggggttttgccatgttgcccaggctggtcttaaactcctgaactcaagcaattggcctgcctcacataagtattctcttttattttgaggattaatttttgttgttgtgaaatatatcctacctgtaaaagagtgcttaaaatgtcgtatgtgtgctttaaaggataatataatggaaacttgtgttcctactgcccaggttaggaaatgggttattaataactttgaaacctcctaaatgcctctctcctactgcattttccttcctccacatcagatgtagtgtttcttcaattttatattaatattttgtactttttatagttttaccatatatgtttatatatatccttaatatattagtttttaaaatttgttattaaccttcagtttattcattatttcaacactgtatagtatcttattgtagtaaagtatgtcaattaacttatccattccactagatggagatcgggattatttctggtttttagttattaaaaacaatgctgctgctgggtgcagtggcttacgcctgtaatcctagcactttgggaggccgaggctgcggatcatgaggtcaagagatcgagatcatcctggccaacatggtgcaactccgtctctactaaaaatacaaaaattagcaggatgcggtgctgcgcgcctgtagtccctgctactcgggaggctgaggcgggagaatcacttgaacccaggaggcggaggttgcagtgagccgagattgtgccactgcacttcagcttggcagagcgagacttcgtctcaaaaaaaaaaaaaaaaaaagctgctataaatatggccaagactaaggaaaggtaagtgaggtgcttagggttcacattttatggagtaagagtaagtaccttcttaaggtttataccctaggttcttcacatgcctcactttagtcctagccctgagcattattatgtaggtcttctgatgcaatatctaagagtttctctaaggtatacctagaaatagattgctaggtaatggagtaactttattacttacaggaaactatatggtggttgtaacaatttatgcttctgccaccagtcatggtggatatgaaattatgtcttaatgtgataatttacattgcaatttttttttttttttttttttttttttttgagacagagtcttgctctgtcacccaggctggagtgcagtggcgtgatcttggctcactgcaacctctgcctcctgggctcaagtgatccttccacctcagcctcccgagtagctgagaccacaggcgcaggccacacttggctaatttttgtatattctgtagaggcggggtttcgtcatgttacccaggctggtcttaaactcctgaactcaagcaatcggcctgcctcagcctaccgaagtgctgggattagaggtgtgagccaccacacctggctgtttgtttgttttgagcctgttcctcaggctggagtgcagtggtccaatcatggcttgctgcaactccgcttcctgggcttaagagatcctcccacctcagccttctgagtagctaggactaagggcacctgccactatgcctggctaatttctaaagttttttttatagaggcagagtctcgctgttttgcccaagctgttctcaaatttctaggctcgtgtgatcctcctgcctcagcctcccaaagtgctgggattataggtgtgagccaccacacctggctgatctatctgtcttaaactggagaattgcatttttttctacctcctttcttttttttaaaaaaactgaatttccatctgttacccctccctttctgctcctcttatttcatgccttggaagttatactttgccttcctttaatgagtaccaaagaaattaaaaaatacatgtttactgtaagtccaggcctaaatgttgctactacagggaccatcaaatgctttactaccatctattgccatctgcaaatgtatgccattgttgtttagttttgtagttcttaatgtattttaattaaacaccacaaattatgctttttgtttgttttattcagtcagtagatgcttagaatacttgcttattttaccaattcctttgcttattccactcctttgttctgggattatttttctttttcctaatatattttcattaaaagtttatttggtgagaatctaaaaactctcaaattctgaaagttttaaaaatttgcctttgttgttgaaaattagttttgatgggtgagagaatctagatcaggtgttagcaaacctttttttgtaaagggccagatagtaaatattgtgggctttgtgggccatagagtctctctgacaactactcagcaatgctgttgtaggacaaaagcaaccatagacattatgtaaacatgagtgtgggtatgttctcacaaattttgtttatagacactgaaatttgactcaattttcatgtgttaaaaattattattttttgaatttttttaaccatataaaaatgtaaaaatcattcgtagcttgtagaccaaataaacaggatggatttgacctgtgggccatagtttgctgacctctggtctaaattaacattcattttacttagtacctgacactggagtaattattcttatgatgtcttattgtgatattgtcttccatttttaattgttgaagagccagctgtcagtcttttttgtttttctttttcttcttcttttttttttgaaatggagttttgctcttatcgcccaagctggagtgcagtggtgtgatcttggcccactgcaacctctgccttctgggttcaagcgattttcctgcctcagcctcccaagtagctgggattacaggtgcctgccaccacacccagctaatttttgtatttttagtagagatggggcttcaccatgttggccaggctggtgttgaactcctaacctcaggtgatccacctgccttggcctcccaaagtgctgcaattacaggcatgaggcacggcgtctggcctttctttcctttttttttttttttgagacgtagtcttgctctgttgcccaggccggggggcgatggtacgatcttggctcattgcaacctctgcttcccaagttcaagccattctcctgcctcagcctcccaagtagctgggactataggcacgtgccaccatgccgagctaatttttgtatatttagtagagacggggtttcaccatgttgtccaggctggtcttgaactcctgacctcaagtgatcctctcgccttggcctctcaaataactgtcctttctttgttggtaatctggtgatatgttttcttgtttggctgcttttaagagctgcttcttgtctctggtgcagttcgctatgatgtatctaagtatgtatttattttcatttaacctggtcaggatttgttgagtatccagaaactaaggattggtgtttctcattacatctggaaaaatttgagccattatttttgcttatattgtggtatgtcataggaagttgagaaaagaaaaattcatttgatggttttctatgaggttatagtggaaaataactatctcccttttagaattgagtgctagacagtttctgtgtagatgatctcataagcttccttttatcaaacagcgatcacttttttggtttggctgctgagaagtatggcatcaagtataatactcatatgaggtgtttaagaactgagtatatttcttatgcacattttactatatactataattatacattaaaaatgcacattgtaaatattataaatatgtgttatacattgttaatagtttggatagcaaaagtatgacttgacatttgttttttaaaccatatttaaagtaactctatcacaatatggatttaatggattaattgcataattggtgagctactgattattcttgttatttggatgcttctttaagttagcaagtttatattgtggtgcttcaatatagactacttatttcatttcagagaactcaatttcctgtatctactgagtctcaaaaaccccggcagaaaaaaggtctgtatgcagtttcatggtatgtgtatgtttgcacagacagatttctcttttatttatttatttatttttttttttggaggcagagtctcactgtcacccaggctggagtgcagtagcacaatcttggctcactgcaacctttgcctctggggctcaagcaattctcctgcctcagcctcccgagtagctgggattacaggtgcacgccaccacacctggctaacttttgtgttttagtagagatgaggtttcactgtgtttgccaggctggtctcgaactcctgacctcaggtgatctgcccaccttggcctcccaaagtgttgggattacaggcgtgagccgccacgcctggccagatttctctctcttgttgattcttttatctattctatattatttcaaaatgagtgttgggaaaagaagtaatagtctaaatgttctgtcacatctagcttttatttaatagagttattagatattaggaggttggtttgacctggaaattatttaaatggggtttgattattatgtaagtgtgtactaattttctgcttctggaaaaaccactttgtgaagttccaggtatctttttgctttgttggtttctagtttaattctattgtgggtagagaacattctttatatggtttgttttatggcccacaatgtggcctgtgttggtgcatgtcccatgtacacttggaaataatgtgtattctgctcttgtaggatgtagcattctgtaaatgtcaattaggtcaagttggttgatagtgttctgtatatacttacaattacagatattcatattcttactgatgtagttactgattggaagggtgatagaagagtgttgaagtgtgcaaatgtaattgtggatttgtttctactttcagttctatcaatttttgatttgtgtattttgaagatctgttgttggatgcatatacatttaggattgtctgatttcttggtaaattgacccgtttgtctttatataatattcctcttcaatttctgataatattccttgtttgaagtctactttgcctgataatattttagttttagttatttatttagctattttagttttgctttggccagtctttgaatggtatcaacatataattttcgtagagtaaaattccctttttttagtacaaattctgagtttcgacaaatgaaactagccatgtaaccactagtagcaccataatcaagttataaaagtttaattactcccccaaaagtcacctttactttgtagtaaaccacttcttccattcccaattgcgggcagccattaatctgtttctttcttcctagttttgcctttcttggaatgccaaataaatggaatcatacattattattattttgagagagagggtctcgctctgtcacccaagctagagtgcagtggtgtgattatagctcactgcaacctgaaactcctgggttcaaatggttttccccagtagctgggtctacaggtgcatgccgccatgcctggctaatttttatgtattttttttgtagaaatgggggtctggctctgttgcccaggctggttttgaactcctggcttcaagtgatactccatcttcggcctcctgaagtactggcattacaggcatgagctattgcacctgggttatgtaaatttttcagtggcttttaaacctcatataatgtttgtttgttggtttgtttttgaggcggaggctcgctctgtcacccaggctggagtgcagtggtgcagtctcagctcactgcaacctccacctcctgggttcaagtgattctgctgtctcagcctcccaagtagctgggattatcggcatgaaccaccatgcctggctaatttttttatttttagtacagatggggtttcaccacgttggccaggctggtcttgaactcctgacctcaagtgatccacctgctttggccccccaaagtactgggattacaggcatgagccactgcatccagcccaatatagggaggtattaagaaaagagaagaactatcatccttaagtattaacgggactttaacaaattaaaaaagtagtactttgaataaaaagctgtcacattttactgtgaaatccttagactttttttatacctctagttcaggttttttcagctttggcatgaatgatattttgagcaagataaatctttgttggagttgtcctgtatattgtaggatggttaacaacatccctggcttctacctggtagatgacagtagcacttaattgtaacaaccaaaagtgtctccagatgttgccagttattccttctggggcaaaattgttcccacttgagaaccactgctctggttaagtagtgtaatacttggaaatagaaggcagaaagttggtaagtgcataaagaattcacacagaagttggattagcaagctgagagacgttatttgaacaagtagcaattggaggcattttgactgagaatggatgttgtgcctctccctcactctttcctcctcagcttgagaggtccatattctctcaaagtttgactctttagttttgagggtgatgactgccaactgtggaagggataaacagatttctgtttggtatttttgtccaaatatatcaggactttttcaagaacaggcaatgaaattattgatcagaactacttggtggttctgagaaaataatatgctacatgaggctactgaagtcctcttccttttgccccatgatgtaaccttaggtgactttcttctggctttcagttgaagatcttacccatcattgaggtgagcgaactgatttactgcttgagtctattttcttccttaaaggagtcttcattgaaaactttacccattttggggtggccatagctgaggatgagttttgtccacaacctgagacaacatactcactatgtaaaaaacctgatctcagcttgatatctggttttagactaattgtttaatagaataatttattattgtaaaatatatataaaatttaccatttttaagtgtgtaagtcagtggcattaagtacatttacaaagttgtgcagccatcaccactgtccatttctagaagtgtttcatcattccaaacagaaacactgtacccattaaacaataaatctccacatccccttgcctccccagatcctggtaatctccattctattttctgtatctatgaatttgactattctaggtttttcatgtaaggtgaatcatacaatatttgcccttttctgcctggcttattccactcagcattttcaagattcattcatgttgtagcatgtgtcagaatttcattcctttttaaggctgaataatattctagtgtatgtatatatcacattttgtttatctgtctgttgatgggcatttgggttgttttccttagagtctttatatgtcagtaattcttaaagaatttaaaagttgtagaaactaggaattttgtagatattctagaaatatgtcatttcctgtactgtatataataatttattctacagactaattactgtgtatatatttggttctcagacgtgattttgattttgtagatgctgtacatgctcttcacttcattaatcttttccttttgctaattttggttcttgtgtatacagaattatagagttacaaggtaatttagttgttacctaattcaccctaaagtctacatgaaaccactgtcacagtctttgataagtagttaccaaatctcactatttctactgtgatagtgaatgactttcattgattagctttctgaaagaatagtttatcttacttgtcttggtatcctcacctctgagtctatttgtctattgtaatctggcttttgctccaccgctccactgattaaatggatgagctaagcatttttttttttttccactgcaacctctgcctcccgggttcaagtgattctcttgcctcagcttcccgtgtagctggtattacaggtgcccaccaccatgcctggctaattttttgtctttttagtagaaacggggtttcactatgttggccagactggtatcgagctcctgacttcatgatccaccccaaagcctcccaaagttctgggattacaggtgtgagccaccgtgcttggcccaattctgtttaatttttgaggaacaatgttaacttctaatttaaatggaaggtagtatatatctaatttttccctattatttttaatttcaatgctagtaaatctttaaatctgaaatacacactcttgaattttgacagatatgtatactcatgtacatatttatattcctgtaatcatcagatcaaattaaacatttttatcacttagaaagtttcctcatgcctttttccagtaagtcttctgcttcacttcgccagatgcaaccaccattctgatttctgcctgtataaattgattttgaactttcctataataagttgtgcttgaacttcacacaaagggagccatacagtatctactatttagcttttggcagctttcatacaacatgttgttttggagattcatccgtgttgttatatgtatcagtagttcttttatttaaaaaatgctgtttagtattcagttgcatgaatataccaccgtttgtccattctcctgttaatgagtatttgcaatgtttccagtttttgagtactgtgaaagtttctatgaacatttatttatttagagatggagtctcgctttattgcccaggctggagtgcagtggtgcgatctcagctcactgtaacctccgcctcctgggttcaatcgattcttcagcttcagcctcctgagtagctgggactataggtgtgtgccaccatgcccggctaatttttctatttttagtagagacgggatttcaccatattagccaggctggtcttgaattccttacctcatgatccgcccgcctcagcctcccatagtgctgggattacaggcatgagccactgcacccggcctgaacatttatttactggttttttttgtgtgtgcatgtgtgtgcaagttttcacttgaataagtgcctagggagtggaattgcttggtcatatgtgaactgtttgttttaactttataataaactgccgaagtattttccaaagtggttgtacagttttacccgaccgccagcaacgtgtgaggattctgtttggctacattcttgccaacatttgttactatcagtctttttcatattagacttgctggtgggtatattgtgttttattgtgattttaatttgcattacactaatgactagtgatgttgaacaccttttcatatacttattggtcatatcttttgtgtagtgtctgctcaagttttttgcctatttttaaatttcttttttccttattattgatttgtgagacttcttaatatattctgaatgtacgtcctttgtctgttatatatgtggtaagtatttccccccagcctgtgttttactactttcattttattaaggtatcttttgatgatcaaaagttttaattttgatgaaggccaatttactattatttttcttttgttattaatgccttctctgtcttgtctaggaaatcttgatccttaccccagactgagttgtgtgtcctctcccttttctgcattaatattgcagaaattaattttttggttttagaaaatgtctaatttggctcaatcagtaatttttgatatctttctattgaaatatatatacagaaaagtacatacataaatcataattgtactgtgcagtgaatttttacaaagtaaacatatccatgtaatcaccatctagattaaggtatagaatattatcagtgccctccaggccgcctccttattccctaccagtcattaaccacccctcccaaaggtagtaacttgtatttaacttctatcttctacatcagttttgcctgcttttgaatttaatgtaaatggaatcatgcagtgtgtactttttaatatctaacttcgttgctcagaattatgtttgtgagattcatttatgttgttgcatgtagtagtggttggttgttttcttccttgttatatatattccattgtggggctctacctaagtctattcattttatacttgatgaacatttgggatatttttattgtgatgtattatgaataatgccaccatgaagagtcttgtacatgttttttggtacacatacatacttaggagtaggattttcagggtcaccaggaaggatatatttaggctcagtgaatactagcaagcaatttttaaaatgcggtcaatataatccccatgtgtaaaataaaggtgtacaaacgcacacacacacacttgctcatatgcttatatgtgcatagaaattccttgaaaatactcaagaaatgcttcacctctggtaagggataggaatggaatgggtcttttgtttagtatcctatgtgccctttgaattttgttttactgtaagtatgtatttttaagaaaaccaactagttatttttaaaaatcatttgaaagtcttcctactttgatatatgaaaaacactggttttaaaaaaaataatagaaaagctttaaaatcattattatttttttgagacggagtcttgctctgtcgccaggctggagtgcagtggtgcgatttccgctcaccacaacctttgcctcccggattcaagcaattctcctgcctcagcctcccaagtagctgggactacaggtgtgtgccaccaggcccagctaatttttttttttttttgtatttttaatagagatggggtttcaccatgttggccaggatggtctcaatctcttgacctcgtgatctgcctgcctcggcctcccaaagtgctgggattacaggcgtgagccactgtgcctggccgctttaaaatcattaatgttgcgttgctcagttatgtctaattgacagcccaaacatttacattgtaatattagaaaatcctttatgattgggcagaaacttggtttaatgtgtcaccttggagacctgggttatagtcctgcctcttccattaactacttgttgaatgtggacaatttacttaacctttagggccttaatttcctcctttataatgtgagaatgttctctgaattgcataactcactggccttacgtgactattcagtggaataataagagagaaaaactttgagatacatgcacacacacccttaagaaggatataattgttaaattttgctttgaggaaataaaataatctaagctataaagtaaaaccataattagctaatcttttatatgacttttttcttcctcatttcaagctaatgagaagcaaacaaactggatagcagcaatataattaaaaaattataggccagcttctagcatgtattcttgagtcaatactgactcagcccagtctcttcctcttccttcatcatcatttatgtacctgaacagagtagatgtttctcttgatcctgggcctgttcgccctcagatccattccttgccttctcttctctttttggtatagtgaggagctgactctttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttttgtatttttagtagagacggggtttcacctttttttagccgggatggtctcgatctcctgacctcgtgatccgcccgcctcggcctcccaaagtgctgggattacaggcgtgagccatcgcgcccggccgaggagctgactcttgcagcctccttttcttcccaggcttccgtgtcagcagtttctggctggattagcaagtggaggaactggcaggagattagaaggcaagaggaaagagaagacagggcttccctccccgaccttcaggcctcagagtcgtagtggttttttgctcatgcagacttctgatttgtctcaccattccctgttgggcctctcatttcttccattgcctgttctctgcattaaagtccttgtgtttcaaatcctcaagtggctttttgttaggctttgactgatacagggctcaaaatgatagtaatgaaaatgtcttacatttatattcttttcaagatttgttatctcttttgataccccaaatatcctattgaggtagaaaagtgttataattcctgtttggcatgaggaaattaacatttattgaatgactattttcagattctttggattttcgggtgaaaattttaggggggataaatggaggcccagagaagtgaaataacttgccctaggccccatagaaggctggtattgaatcaagattgaaattctgcatgtgaaaacttttacgtgctacatgtctgctagtcctggaagaaatcctttctttgatgagtattttttttaaaggctttacttgcaatatatttacaaaagccttagttatttagtaaatttttcaatgaaaaatctgaaccataataattttctgcttagtacttatatagctagcatactatccctagcattaatcaaagtgtcatgtaaaggtttgatttttgagcctaagcagaatttgaaattcttctaagagaatttagcacctagggcaaactacaggggagaattcttgaggtgtcatgtttattcacttctggaattgtttaaaatatgtcaggtgcatccttaaagggagaaagaagggggaagagatgttacaaaagagtagaatggggcaagagaagtggcaagggagtattgttgctaggttgccagccttctgcccccactgtcttggtgatggtggaggggtagtgtggcagctgggatatgaatgaggtcttttttataactcactaaaagccattaccttgtcttcatctcgtcagctggctacctgacctctgtggtaacataggctcctgaaatgtagcattggagatgatcactgtgctttattgcaaaataggggagactctgctctgcatttacatgcttatgttttgtggaggatctttcaactagtaattctcataatacctgtgaaagcatataagaaccagtatctccatttttagggggagttggagtgagcaatgatttggaataccagaaattcaacttatatatttacaggtaaaattctaattgtaaattcaggattcatagattctagggatttctgaggtatccagaattccttcatctttgatgataagtagataataatggtaataaaaataacagcaacaggcccagcacagtgacccacacctgtaatcccagcactttgggagactgaggcaggtggatcacttgaggtcaggagttcaagaccagcctggcggacatggcaaaaccccatttctactaaaaatgcaaaaattagctgagcatagtggcatgtgcctgtaatcccagctactcagtaggctgagtcataagaatcatttgaatctgggaggtggagattgcggtgagctaagatcgcgccactgcactccggcctttatgacagaactcgactccatctcaaaaaaacaaaacaaaacaaaacaaaacaaaaacaaaatgcaaaaaaacagcaacaataataggtaacatttctttaaggcctactatgtaccaggcactatttgaacctctttatatattaggtaatacgatacaactctatgagaatgagtattttatttcctgacccttctatttaaaagtaaaaccccccacccggcactgtttctctttcctgctttatttttctccatagaaaaatatcactcataagtgtaacatactttattatctgtcctgtgtggtagtagcccctgccctcaattataaactccatgaaatcagggagtcagttttgttcactgctgtattcccagtgcctagaacagtgcctggaatcatggtaggtacccagcgaatattggttgaatgaatgagtcttggttttacagatgaggaaactataaatttcccaggtcacacatttggtaataggacagttgtgtacactgaaatgttctctaaaatatttgatggaacgaaaattagcttttggacagctacatctccaagagtgtgaaatgaccttcagcactggatttggtggattttcctttttctaatccctagagttccatttaatgagcgtttgggttcttgagctaccttacaaattgaacacttttttctccagctttcactcaagaaacacaaaacatggcttgtcctttttttttttttttttttttttgagactgggtctcactctgtcacccaggttggagtgcagtgcacaatcatggttcattgcaacctctgcctcccaggctcaagcaatcctcctaactcagcctcctgagtagctgggactacaggcttgtgcctccactcctggctaatttttttgtattttttgtagagatggggtttgtccaggctggccttgaagtgctggactcaagtgatccgtccacctgggcctcccaaagtgctggggttacaggcgtaaaccactatagctagccctgattgtcttttattgtgagattttaataacagctaagacttgaaaattaacattttataaattttcttttagactacttagtgatatactaagtatctaaggtttgtaatacttagtataaactcaaaagggttcagtgcctcattctcttttactctttccctttagtagataggtgacagaggactgggtcatgcagttgagacttggtccaagatgacttagtaagctacttgtcccagaactatttatttatttacttatttttgagatggagtctcgctctgtcgcccaggctggagtgcagtggtgtgatcttggctcactgcaacccccgtctcctgggttcaagcgattcttttgcctcagcctcccgagtagctgggattataggtgcccgccaccactcccggctaattttttgtatttttagtagagacttggtttcattgtgttagccaggattgtttcgatctcctgacctcatgatccacctgcgtggacctcccaaaatgctaggattacaggcgtgagtcaccacccccggaccctggaactatttatgacggtgcactttatgcacttaacacactcacatgtctttaagcttggtgactcgtgtggctttttcgaaggagatttgattctggaagtggttaagtaggatgtgaatggctaaggtctggtcattggtgaagcctaggggaagaaaagaaaggaaacacaagtcttagaagaatttcagatcggccccaacgactagaagggtggttctactaagaaaatgtgtgtagtcagaaaatgaagagtcagttgcttaaaattttactttttttcttgttcctggcatgtaaagtcatatccatactttctgttataatttcttcttacaaattccattgataatccctattcttggatagcaatgagcagcattacttcttttttatttttttaaaaaaattaaattttttgttgaaatgagggtcctgctgtattgcccaggctggtatcaaatttctgggctcaactgatcctcctgcctcagcctcccaaagcgctgggattacagttgtgagccagtgtgtctggttgtaccttttaatttttgtgttcaggcaacattaactctgagtcacagtaagctttttttttcttcctgtcatattatggacatagaagttttttggttttctttagattgtttctccttaggttgcagaacatcaagaaatggattacagtcattttcctctcttccccatgctcttccctttcttttccttttttcttttctttttttttttttggagacagaatcttgctctttggccgaggctggagtacagtgtcatgatcttggctcactgtaacctccccgcaccaggttcaagtgattctggtgcccaagcctccctagtagctgggatgtcaggatgcgccaccacaccctgctaatttttgtatttttttgtagagatggggtttcaccatgttgtccaggctgacctcaaactcctggactcaaatgatctgccctcctcggtctcccaaagtgctgggattataggcatgagccaccacatctggcctcttttccatttttaaaaaggactgtctccaacatattaaaattcacaaaaaataatataaacacacatgtactcactggctaggcttaataaaaaacatttagtcatgtttactttaaagctttttatttttttgagaaataggcattaaagagttgaagtctcctttctgtcttttcataattctgttcttccctcttccttccttgagatcttcactattcttgggttaatttggatctttctactccttgttaccacagaaaagtaattcttaatgaatttgaccatattttaaacttctgatttcagtgggcaggtaactcattttatggtttctgtattgtgagccattttcaatgactcaactagatttttttcatcgttgacttctcatttctgggcaacagcataatgttctcatttgagctatttctaaagattgtgtttaactatttaaaatatttgtggtactctgatcatcagatgtgatttttttttttttttgagacggagtctcactctttcaccaggctggagtgcagtggcgcgatctcggctcactgtaacctccttctcccaggttcaagtgatgctcctgcctcagcctcccaagtagctgggactattggtgcgggttaccacacccggctaattttttgtatttttagtagagacagggtttcaccatgtttgctaggatggtctcgatcttctgacctcgtgatctgcctgccttggcctcccaaagtgctgggattacaggcgtgagccactgcacctggccagaagtgatattaactatcttatatgtatatttctgttgcgggaagtcaggggccccaaacggagggaccggctggagctgtggcagaggaacgtaaattgtgattatttcatggacacttaccagttcccaaataatattcttataatttcttacacctgtctttaatctcttaatcctgttatcttcgtaagctgaggatgtacctcacctcagggccactatgataattgtgttaactgtacaaattgattgtaaaacgtgtgtttgaacaatatgaaatcagtgcaccttgaacagaataacagcaattttagggaacaagggaagacaaccataaggtctgactgcctgtggggttgggcaaaatagagccatatttttcttctttgcagagagcctataaacggacatgcaagtagggaagatatcgctaaattcttttcctagcaaggaattttaataatactctggagaaggaatgcattccttggaggaggtctatagggcatgtctgtcttatgctgttgacataaggactgaaatacaccctggtctcctgcagtaccctcaggcttattagggtggggaaaaaaccccaccctggtaaatttgaggtcagatcagttttctgctctcaaaccctgttttctgttgtttaagatgtttatcaagacaatttgtgcaccgctgaacatagactcttatcagtaattttgcttttgccttttgccttgtgatctttgttggacccttatcaggagtttctgattttgcccttgtcctgtttcctcagaagcatgtgatctttgttctcctttttgccctttgaggcatgtgatctttgtgacctactcactgttcttaggccccctccccttttgaaatccttaataaacacttgcttattttgcagctcaggtgggcatcacggtcctaccgatatatgtgaggcccagctgtgaaattcctctcttcgtactcttatttcttagccggctgacgcttatagaaaatagaaagaacctacattgaaatattgggggcaggttcccctgatatatttccttagtgacattcctgcaatctcctttagaaagtctttctgttcaccttctataaccagggaaggagagattgagaagagacgaaggatgattttatgtttttcagtcccagtcattatttgatgagaaactgatattacaagctttaaaaactcaagatatgtattcaacatgtagtagtagaacaagtatcttagtttaatagtctataaatttttgatgcactataatatattattgtagtcagtagcatcaaaattttaatgtgatattgcagtatgtttatggttagtttagacatgaggacagtgctaaaggagaaaatctaatgactgtgttgtttgttttgtcaaaatatgctgcctagctccagagtttcctattttggagaagcagaactggttgattcatcttcattatatccggaaagattatgaagcctgcaaggtaagagattgccataataataaaaatgagaggcaggatgttgggtaggcaactaacagtgcctgctaaacagagtgtggcagtttatatctcagtgataaaacatgaattccttcttccccatacttcatacactggttatcttttgctatggtagtgatgtttaacatacaacctcaatatttcagtggcccccaacaaacaaatattaattgctcatgggctttcagatcagctgtgggttggctgggtttgactgcaggctgtgggtcaggtttaggtgtgttccatgtgtcttctcatgtcaagagcaaacaactctcttggacatgttggtcttctggtggaggcagatgttcaactcagcatattaacttttttatctttggatagatgaaaaatggtattttgtcgagtttttttttttttttttttttttttgagatggagtctcactgtcacctaggctggagtgcagtggcatgatcttggctcattgcagcctttgtctcccaggttcaagcaattcttctgcctcagcctccccagtagatgggactacagatgagtgtcaccatgcccagctaattttttgtatttttagtagagatggggtttcaccatattggccaggctggtctcgaactcctgaccttgtgatctgcccgccttggcctcccaaagtgctgggattacaggcgtgagccaccgtgcccagccctgagttttattttttaatttctctcttactgcaaggttgatcatcatgtgtatatttaaaaaccatttgtatttccctttctctgtatctttggtgacataccatatgtgttacaaacttgcaggcagacagtggtagtactaacatgcagaatgtatccttggtgtcatcttttttggtatccagagctttgtgacccatctaaggtttttaatttatacccatggcatttatacctatggcaatgcacagaactaattcatactggtatgacaaagattcataccagtttttttttttctttttttaagtggagttttgctcttattgcccaggctagagtgcagtggcgcaatctcggctcactgcaacccccgctttccagtttcaagcaattctcctgcctcagcctcccaagtcgctgggattacaggtgcccgccaccatgcccagctaatttttttttttttttttgtatttctagtagaggtggagtttcaccatgttggtcaggctggtctcaaactgctgacctcgtaatccacctgcctcagcctcccaaagtgctgggattacaggcgtgagccaccgcacccggcccataccagttttttttgacaccgctgatccgaaggcagataccagtatgaatctttttttttttgagatggagttttgctcttgtcgccaagggtggagtgcaatggcgtgacctcggctcaccacaacctccgcctcctgggttcaagcgattgtcctgcctcagcctcctgagtagctgggattacaggcatgtgccaccacgcctggctaattttttgtgtttttagtagagatggggtttttccatgttggtcaggctggtctcaaactcccgacctcaggtgatctgcccgcttcggccacccaaagtgctgggattacatgcgtgagccaccgcgcctggccaccagtatgaatcttgaaaggttctctttctttttcatctgtgataatacttggaaatcttatcacacttttcttagcttgcctagttagattttagacaggggttggcaaactttttctgtaatgggccaacaatattttagggtttgtaggccacatacagtctctacatcatatttgttatcttattttttataaccctttagaaataaaaaaaccactgttagcttgagagctgtacaaaaatatacagggcctgtaagccctgtagtttgcaaatccctgttctagaagaagtaatcacaacaagggagttgaaattttaagaaactgaatgaactaatactttactaggcattattaatactctaggtttttttacatatgattcttgtccacgtctgctttttcattactatttgttttcttttttttttcagacagagtctcactctgttgcccaggctggagtgcagtggcgctatcttggctcactgcaacctccgcctcctgggttcaagcgattctccttcctcagcctcctgagtagctgggattacagacacgcaccactactgcccggctaatttttgtatttttagtagagatggggtttcaccatattggttaggctgatcttgaactcctgacctcataatctgcctgccttggtctcccaaagttttgggattacaagcatgagccaccgcacctggcctgtccatgtccactttttcttaaagacacctgaagaaacttaaccactgctcagaagcatttttctccctctttcaggctgttatcaaagaacagcttcaagagactcagggattgtgtgaatatgctatctatgtccaaggtaagacacatacttcttgtcttcttgctagagaaatacacttttcctaggttcttgaaaaagatcaggcaattgaagaaacaagttcaagtacagtcatgcaccacttaacaatggagatatgttctaagaaatgtgttgttaggcaattttgtcattgtgtgaacattacatggagtgtacttacacaaacatagatggatgatatagtgtactatacacatgatatagtctgttgctcccaggctacaaacctgtatgagcaggtgttataccgaatactgtaggcagttgtaaaacagtggtaagtgtatctaaacatagaaaaggtactgtaaaaatatggtataaaagataaaaaatagtatacctgtatagagtacttaccatggatggactggaagttgctctgggtgagttagtggtgagtgaatgtgaaggtctaggacattattgtatactaatgtagactttatgttgtatactaatgtagactttataaacactgtacacttagcctacactaaatttatttaaaaatattttttctacaatgataaattaactttagcttactataactttttactttataaactttaaaactttttggctcttttggggtaatacttaaaacacacaacaacattgtacatttgtacaaaaatagtttctttaggtccttattctataagcttttttctttttctttcttttttttttttggtagagagacagagtctcactttgttgcccaggctggtcttgaactcctgggctcaagcagttctcctgcctcagcctctcaaagtgctgggattataggcatgagctacgacacctggccctttatgctattcttaaaactttttatttttttacttttaaacttttttgttaaaaactacgatacacacactactacagtggtggtactaacatgtggaatgtgtccttgctgtcttttttggcattcagagctttgtgacccatctaaggtctttgtgacacacacacacacacacacacacacacacacacacgcacacgcacgcacgcactggtctaggcctacactgagtcaagattataaatatcactgtcttccacctccttatggaaggtcttcagtggcaataacatacatggagctgtcatctcctataacaataggaataccttctggaatacctcctgaaggatctgcctgaggcagttattcttttttttagtaagtggaaggagtacactctaaaataaagattaaaatgtatagcgtagtaaatacataaaccagtaatgtagtcatttattatcaagtattaagttctatatatatgtaattgtatatgctgtacttctatgtgactggcagcacagtaggtttgtttataccagcatcactacagataggtaagtaatgcattgcactgttttgattgctatgacgtcactgggcaataggaatttttcctcttcattataatcttaagtgatcatcatcatttatacagctgtcgaccaaaatgtcattacaggtgcatgagtttaaatgttccagaaaggttttattcagtattaatctttttatggaatctgaatataattactgtgttggatttgacttcagaaatgactagtaatgttaaaaaattgctatgattacccattttttagtttctggctagtgttttttggaatggatgcttaggattcctgcctaatgcagtgatttcagggccaaaagatgcttttggaaggattgcttgtaatcaagctaaaagagatgaagaagagcttgaggatttctgtaaggtgaatcaggatgaggggaagaagcctggaaataaacaagataaagcagagcataaattcagctcattagaaaccaaagataaggaccactcacttactttttttttttttttttttttttgagacagagtcttgctctgttgcccaggctggagtgcagtggtgcgatcccagctcactgcaacctctgccttccaggttcaagcgatcctcctgcctcagcccccctattagctgggattacaggcacatgccaccatgtccagctagtttttgtatttttagtagagacaaggttttgccatattggccaggctggtctcgaactcctgacctcaggtgatccacctgccttggcctaccaaagtgctgggattacaggcatgaaccactgcacctggcccactgacttaaattttcctctttagtggcataagtagcattcttagtttttccaggaactttctttttgactcttgggtgtaaataaatggttttgtttaccattcattgcatttgtagtcttcagattaacatataattttctgacataattgttaagatattgacaaatttaggacatcatggcaaaaaatgctcttattcccagtgtcacaagtatcagactttcagtgcctgataaattcttctggaaacataggcctaggaaaaacctctggttctaattggttgttacactgacaactgaagtcttaaatgttactttatcctttgccagaatctccatgttgaatttgaggtattgattccatttgccccatttgggggttcgctctgaaaactatcagttggaagtaaattatgataaatgaagcatctgatggggaagccccaaaatgttgttaatgtgaagagtttgtgtgataatttgcaaaggaactgattatctatgtgatggatcctgggagtagagagagaagtaggtaggtttgagctaccttgctaaaagacagttgagcttgtcagcagttttggttgttgtttcagcctgtccaaagccatatctgattgttttaaggatacagttgtccaaaggatttacttgatgtggtttcccagttttctcttctccaatttttctgaccccaggctccattcttcccagaacatggttttacttttttttgtattttctgtttcttggcagcattgatatttcgcctagaaggaaatatccaagaatccctagaactcttccagacatgtgcagttcttagtcctcagagtgctgataacctcaagcaggtggccagatctttgtgagtattggcaacctggaggccctagggcactcacagagaacagtgtaaaatgcattcctaggtccagcctgctgctggcagctgcatcagcctgatacacaagtgggggaatggtttaataggtacagtgggattcactctgaagagcatggattaagtttgaaatttgagaaaatgagataactagtgttaaggaactaagcattttaaacactgtgcattctagtttgatgggggaccaatattgtttatcatgtaaatagagacaccttgtaccctaagtcttctaaacttattggcaatccttggaatttttctcatctactcttctaacacttagtatttgtcacacagtaagtttttagtaaggacagagagttcctgacttctgatggttcaacttacataatttttcaactttacaatgatgtaaaattgttatgtattcagtagaaactgtacttcaagtatccatacagccattccgtttttcattttcagtatagtattcagtaaattacatgagatattcagcattttattataaagttggcattgtgttagatggttttgcctaactgtcagcaaatgtagttaagaaagtggagataggaactccatggaacagagtaagtgttctgagcatgcttaagataggctaggctatctatgatgtctggtagagtagatgtattacatgcatttttgaattacagtgttttcaatttacaatgggtttactgggatgtaaccccatcataagttgaggagcatctctatttgttgagtgaatgtcctaaagattcctagatggaaagaatctcaagtgtttataaactactaggtactcccttttcagtcctttgttccatggagttcctatctcccctttcttagccacattgccattcatacctgtgttgtttttgcatagagcttggttttccctgtttctctctaaactcaggatccaatatcaaggaaagagacttagtcttggaaggaaaggatgtgtccctaatgggtgatgataaatgatggtagttactgcttaacatggtatatcattaggcttatttcttttttggtctgcatttatagtacattgtagaagaaaaattccacaagactctcactaaaattggtatagaatgagaccaaggccttggaacagctgccagtgcaatccctactaagagagcttctgctgttagtgtatagcagcttcactgaccaaaccagcacaaccacctcatagagaaaaggcttctagaattctctgctggatgaaatatgattaaaatgtgggactagtagggttagtcttctaagaattttgaggtaataattatggaaaatatatcttttacagatttcttttgggaaaacataaagctgccattgaagtatataatgaagcagctaaactcaaccagaaagattgggtaagtagagaactttcagttctttcttattagtaaacttgctaatggttccatttatcatctggctgtcttatttctgaattcttacattccaaaaatgtcttgattttaacctcatacttaattcatgatttgtataagtataggatcaaaaaccatgtttcctcataactttgcaggcattgctgcatgattttctagcagtttgctgacgagcagtctcttaccagtctgattcttgttgatgacccctagaagctttgggtatttttttcgtcattggaattccacagtatcagcaataggcatctagttgtgtttcatgtctttttcccgtccccatctgtgtgacattcaattgactctttcattctgaagacccttgcctttctttgggtcagggcctttgagtagttctttatttttcccctccccttctctttgtgtcaattgaggattgtgtgtaaatgcaacagaaaatttgactaaacattggctttacaaattcgtttttgtttttttttttaattctcatgaaacaagatgtccaggtaagtagttgctggcattgatttggtggtcctaggatgtcaagactgagagtttttcctcatggttacaagaagactgctgcatccagcatcatatctgcattctagggaggcagaaagagaaagcaacaaggagaaaaggacagagcctatactgggaaagcacaactttcccagaagtcccccacagacttccacttatgtcatatcagctccccttctataaggaaggctggttaaatgtcgtttttaatctggtcacactgccactctaaacaaaattagggttcttttagtaaggaaaaagagaagagtaggtagcaggtaggcaagtagataactagcagcatctgccacactgttttccattctctatgagagatgttctctaactattctctacaactcttaacttgcctctcattttctacctctgtgtccttttctttgtgtgtggtgcgggggggtacagaggctcactctgttgcccaggctggagtgcagtggcgtgatctcggctcactgcaacctctttcttccaggttcaagtgattctcctgtctcagcctcctgagtagctgggattacaggcgcctgccaccatgcccggctaatttttgtatttttggtagagacggggtttcaccatgttggctaggctggtctccaactcctgacctcaggtgattcacctgccttgtcctcccaaagtgttgggattataggtgtgagacaccacgcctgaccctccttgtcattttattatatgttcaggacatgtattcagtcttatcttccatatcatcatttttgtttttagctatttgtattctgttatataccctatccatccaatattttttatttcatttccttttattgtatttttaatttccaaaaatcttgtcttttcttcaatgtctctgattcttgaagttcttttctgcttctcagaattatctttttcttcctctctgcattttggttcttctattttatgctgttggtatttttcaagtatttggtgattctcagagagacattcatatctgtgagtgaagaactagatttattagtacagagaattagcatggatttcctttgcagttcttacggggcactattatttttgaagtgtgttcaatttgttagtcgcttttcttctgtacatcggaagattgagttgagtctttatgccatggagtatgttatagctaacagccagagtgaaactacagatgaagaaaaattcatgtacttttcattcagtcggtttttcaaaaaatgagtatgtctgctatatgccaagcactgatctatgccctggagatgcaaagatggactgttggattataagatactcaactagaataggaaatgaaggaagaagagcaaggtttggaagaaggtgatggtaagaaatcagagttaaatcctgtctttcagaggattttggatatgataagttttaggttctgaggggatatctaaattgagatgtgtccagtaggattggatatagaaatctgaaactcaagtgttttggagtagagatgtgaattctggagtcagcaacataaaggtggtaattgaaaccattagattggttgacattaccctgcaatgagctgaggatgggaccctggaaaaaaagagttttttactttttttttgtctgtttgagacggcacaggaaaagttactgctttaatgcagggaggaagccctgcattctctatgggggccaggatcatgggggtggccagtgccacaaatggtcaccatacaggccagggaggagccagggcccaccaataatccctggaacatccctggatgctagcagttttttactttctaaatttttttttttttttttaagagacaaggttgcctaggctggagtatagtggggtgatcatagcttactgtaacctccaactcctgggctcaagtgatcctcctgcctctgcctcctgagtagctggggctacaggtgcaagccaccatgcctggctaaatttattttgtggaaatgaggtctcatgttacccaggctggtctcaagctcctgtcctcaagtgatcctcctgctttagcttcccagagtgctgggattacaggtgtgagccatcaaaaagcaattttgaaggactgagcagaagaagagaacccatagagggagatagggaagaggtaaagcaggagagctcagggtcacagggggaatggaacgtatttcttaatctatccagttggttgaaagagctcatttggtattactgactcacttgggataaccatcccattgttactagtagatgtgatcattcacaaaacagccattctttttttttttttttgttgagacagagtctcattctgtcacctaggctagagtgcagtggctcaatcttggctcactgcaacctctgcctcctgggttcaagcgattctcctcccccagcctcctgagtagctgggatttacaggcacccgccaccatgcccagctaatttttgtatttttagtagagatgaggtttcaccatgttggtcaggctggtctcgagctcctgacgttgtgatccgcccaccttggcctcccaaagtgctgagactacaggtgtgagccaccaccttttttttttttaactttaaaatttttctttaaaattttccccttcatggcatttttattttctttttagaatattttaatgattttgaattttacttttattaatagcccttacctaccctacatatttcataagtacctgtagaaaaccttatagtagctggagcatggtggctcatacctgtaataccagcactttaaaaggatgctgagtggggaggatcacttgagcccaggagtctgagaccagcctgggcaacatagagacccagtttctaggaaaaaaaaataaaaattagtggtcgtgtgcacctgtagtcctagctattctagaggctgaggtaggaggatcacgttagcccaggaggttgaggctgcagtgatgcggtgaactgtgattgtgtcactgcacttcagcatggaaagcagagcaagaccctgtctcaaaaaaaaaaaaaaaaaagaaacaaccttgtagccctactttcttggactcatcagggtattccacagtcttgctgcaacaggggaatagtaattcctcctgccattatcttagttgacttttggaacagttctgttaagtagggagaatttcccccattgacaagtgaggaagctaaggctttggaagatggaagttgctacagtgaggtagttgctgagccagaactggaattcagacctgtgatctaggatgatctaagattcctcgtcttaagactgtgatcttttccactgtaccaactgcctttgcaggatgtctgctgggttcccttacctcctgaaagataggatttgactctgatttgttctgttgccctttccaaatttcttttgcagttagtttgttaaaggtatattgctgccttctcaactatctatgtcaaagattttaaaaggtcagaggttagccttcaggacatctatttacttacctaccttaacaattcctactgtagagcaggacatttaaaggacaagaaaggctttatttctgccttgtctctctccatgcatgcattcttatagcatgacaaagttggcagtatacaagttttggaagcaggcctgagttcaaatcccaatgttctataatatggacatgatttgtgattgaataaaaaaaatttttaaatgtgcggcatttgtgagataattggaaattttaacgtaattgaatatctaatatcaagcagtcactactttttttcgagtgtgacgatgtgggtagtttaagaaaaaggccttatcttttagaaataaatacggaaacatttgtggataaaacgttgggctgttatttgcttacaaaagttgtgggagtagatggggtgtggattggatggttgttgggacaggatgattagtacctaattctgtctgcacttacgtatgattgaaattctccctaggatgtagaactaaaaaagaaaaaaaaaatcccaatactctctgtcttaagttaggtaatctactcaacctctctgagcttcaatttccttatctgtaaaattggaaagattataactatgttgcaggtttgctgaaaattaaagtaacatatatgaaaacatctggcataaagcctgatgttagtaggtgctcaaccaatggttgctgttttgttgtttttactatttttggagacttggaaaacattaaatcagttgttatctctgagcctgggggtccatgtttcctcagacagggacacatctccactactaatagggtagttcttactatgtttcccaagagcattttccttacccttgctttctccttttccaaagctaccttaaataaagggaggtttattataaaggaatttgagagtccataaaacagtatcaagagatgcaggttggtcttttagtgaagcagaactggaacgcttcagcatccaaggtagctactctgccttttctgcttcatcttttctttctgtagatcaaaggttggcaaactttttttgtaaagggccagttaataaatattttaatttgtatagcttcatacagactctgttgcaacgacttaactctgcagttctaatgcaaaagagccatacaaaaacaatagttgtgtctgtgttccaatgaatctgtacttataaaaaagggcagggaatggatttggcccatggaccatagttttcccatgtcagctctagacttctgcagatggctccaattacatgtattccatcacagcagactccaggtggcgctgtcagtcctcaagttcacatcacctagtaaatttagtacttgtaactaactagctctcttccaattccagattcctagggaaaggacttcagttgtgtcaggtgtcactatccaactgtgttgccttaagggcggaaatgtgtggctagcagccctctcagcaggggctgtgggtagtctctcctgagaagaaggagcaaagggtatgggtgatgggcaactcttaaagaaaaaaggtatggggatgggctgggtatgtgccccagggttccccatagatccaggaagatcacctgtttattctgcttttatttcttataatctgtatttttttatgttgaggaacttatttttaacaattaatttgagtatgaactctaataaaaagctgactgtaatgcatagtttaaagtttaaaccttgccgagcaataacaatctctagatgtctgttgtttcactctaatacttactgtggaattacacctgagttgttttccttcttttttatgagcctaggagatcagccataacctaggagtttgctacatatacctgaagcagttcaacaaggtaatttatagaagtggtgatagatttcactgagggtgcacttgttgcagaagttgttacattgctcatttggtattatccctagtgcttgcagaggtttttggaactgaaaattgaaagtacctttatacatttttttctgttttaattctcacttgtcattattcatctgttgttttctgcttgtaataagaacatggaaagttctagaaatatgagggaatggcagtttttctcctttcttctttttctctacctccagttaaatttcccagtttagaaacagatgcttaataaaacatacatatcaaaaagtggacccttaagtcttaaaggtgtgatcatgaccatgtgagctatctccatgccctgacggcaacttagtttttagggtcattgaaaataaattttaaattttaagtggatctgatttctgagttttcagttttaattttatagttattttccatgatgagaaattatatttcactgtgattaagctatagactcctatatcagagaagacaagttgagcttacctcaaatttggtactcaggtaagaaaaagtatatatcataattgaggagtagacaaaattactgagagctctaaaacttagtgatgagagcgttgggtagtttccttcatagagctcacagttagtgattgtgaagttttattctcctttctccgatgccaccaggactgagaatctgaattggttagtacccatttgacaatgtttagtttgtgtcaatttgcagactggtgtaactagtatcccacactggtgtgaaaaaaaatatgcacattagcagttggggtgtaaaagtaacttttctcctgagataacaatatatatacataaaatacatttagtgggccccttaggttttgtagatggatctatagttttatatacttggttaggagatttttctcttcagagacaatttcaaacaggcacatttctattcacaggattattctgagtcaggggaaaagaaggatttgtctttggttggatctgtgctgagaagaaatatatttagattttactgtacagctaacaggctaggcaaatacaatacctggcatttatataaatgcttgttgaatctgtgaatgactaaacaaagcccttttgtttactaggagaaggtaagctcctccagagcaaggagttggttttataaactcaaatatatttagcatctagaacagcaagcagttgggtgaataaatgagaacaatctatttattcatttatcatcacattgatggggaaacctggcccaccatagggaaggttgtgcacttggtcagtgttacagctgggatttagtttagtgtagtactctacactgtactatgatggcccttttgacttatgaagtatgagtcataggtgtgaatatcaggcagaaaacattcagaaagattaatcgtcttgtataaattcttccaagtggctccagaagcagatatcccatgttgccagctgtcttttcaacaaggacagttttggtatgttttggtctttgggtagtgggggctgtttgctgaaatgtgatgttcctatgtcaatacagcagaaagtgtctttacattagccatataaaggtatagttcgttcagtggtagtgatttggttttctttattttgttaaacttgtcaggcacaagaccagttgcacaatgccctgaatcttaataggcacgatctgacttatataatgctggggaagatccacttgctggagggagacttggacaaggccattgaagtctacaagaaagcagtggagtaagtgtatctgtttcctttaaaacagtgagaaactaaaaaaattgagtggatatgtgaactcccaagcctaaaagagtgaatatgtttgattaattacttactgtatgagttaaaggttaagctgaagtttaagagctcccagtagcttcaataaggtagactgtgtttctttcttacctataaggatgactgctgctttaggttagctgggcagctctattctacaaggtcagccagggatccaggtttcttccttattaactcaccattccttaggctgttgtctttacctgcatggttgatgctgaatgtaacatccacatccaggctgtggtggaaggagatggtttgggaagctaagcatggaataagcatctggctatatatatatatatatatagagagagagagagagagagagagagacatgatcttactccatcactcaggctggagtgcagtggagaacacagctcactgcagcctcaacctcttgggctaaagcaatcttcctacctcagcctcccaagtagttgggactacaggcatgtgccaccatgcccagctaatttaaaaaaaaaaactgtttttgtgttgacagggtcttgctgtgttgcccaggctggtcttaaacttctgggctcaagcgatcctcctgcctcagccttccaaagtgctggaattacaggtgtgagccactgcacctggccttggtaataagttttaaatgacccagaaattgcacacatcgttcctgcttacattccatggttcaaaactacatgatagttacaagggaagtgggcagacatgcactcaagaagaaggaaataacagatttaagagttggccgacagtctgccattttggtatcatatgttaataacagatcttctgttttcagagatattattagggacagaaatctcctgattcagtaaaaaacaaaacaaaacaaaacaaaacatttggccttattagcatgagaccagtatcttttttcccccttccccattttcccttccccttccccgttttccccttccctttccccgttttcccttcccccttttctcttccccctttccctttcccccttcccccttcccccttcctcttccccttcctccttccctcttcccccatcccccttcccccatccccctttccccatccccctttccccatccccctttccccatccccctttccccatccccctttccccatccccctttccccatccccctttccccatcccccttccccctttccccttccccctttccccttcctcctttcccttccccctttccccttttcccatctcccttcccctttcccctccctctctcccttccttcctttttctctcttttctttccatcctttccctccctcccattcccatctttctttgtttctttcttttcttcctttcttccttcctttctttccttcctttcatttatttcaacagtctcgctctgtcgcccaggggtgagtgcagtggcgcgatctcgcctcactgcaacctctgcctcctgggttcaagcgattctcatgcctcagcctcctgagtagctgggactgcacgagcacgccaccacccctggctaatgtttgtatttttagcagagacagggtttcaccatgttggtcaggctggtctcgaattcctggcctcaagtgatctgcttgccttggtctcccatagtgctgggattgcaggcgtgaaccactgcgcccagccttgtgttgttacttttaaatgggatagctgtagcaaaatgccttgtctcatttgtttggtcccttaatagaatgtctggtctgtggttcaaggcttattattcctaataattagattctgaactaaacttagatttctattaatttgttaatcatctttgtcttctaccatggtagtaaattttctggttatatcagtcacagcactgctttctgaattttcttcaaccatattttgtgtctaaaacagaaaaatcccttggtttgttaagctacagaacagacttttgtcatcaagaggctgtatatttgggcaagtagtaaggagccatgtaacatgttcagtgcctctgtggtgctaggtagtagccctgatccctgacccctgccttctagaggttagctctttgagaatagcatacataaatcccaaggggaacattcttccagtaactgatcaaggactttggtcactaaatttcctaagggagaaatgtggacagctaaaatctgaagccttactgagaagatagagaccattgttcatgacctacagctttgaagagagtagtcatgttgtagtggggaagccaatattgctagaattacagaagttacctggctttggggagggaagtgatcaaagtggatgtttattatggcagaaagtgaaaggcggattcccagttgaattgagaaagctctgtttggtcagctcaggcctcccctggctggggctttgcatcttctggttcaggtcttcctataggtaaccagtgccctatatcattccttagaagcagaagacattgttcatagccctttggtgttttactgttgaaactgtctgatgatcctatggtcagatcatctcaactcagtgttgccttggttttgtgacaaagacaaatactagtgagggattgagcaggcaatccctgatgtgagtattttacttacatcagtgtttactcccaaaggtcagtagcaccttctttcctaggattggtatgtatcttccttcttttgtttagtttggctacttggtatagctctttgtttaagtggagagaacagcattaggggccttgggatcctaaattacatagaaaattatgctgcctggcattgtgagcacaatgaggatagaaaaaaaattccacaagagaggactggtgaaactgtgtgtgttctaggctgacttggtttataaagcattgttctttaattttatcagtgtgaccaagacagtcatgcaaaacattctataggttctttcttaggacttttaccctaagaaaggaatctgaattctaagcctcatttttcttgctgagcagttctccttatcaccagggttgagatgacctacttttgatggcaattcccaaattgccttcaggtatttccacggggaggaagaggctcagtggggtctgtcaagtattgcacgagggcatattactgtgcatgtgtcttcgtgtttctcatctacatcttgtttccctctgagcatctctatgttgcaggttctcaccagaaaatacagagcttcttacaactttaggattactctacttacaggtaatgaaaactctgtactcattcatgcactgatgttagaaatggttttgggtttgtgtgtatggtggttttcctgcattctgatatttattttattaaaggtcatataaagttcatgaactacactctctctattcgatactctttgctaaaggaattaattttctgcatttaaattggaagcaattctattttagcctagtgcaattataattcttatctaggctgggtgtggtctcatgcctgtaatcccagcaatttgggaggctgaggctggtggatcacttgagctcaggagttggagaccagcctgggtaacatagtgagaccctgtctctacaaaaaataaaaaaattagccaggcatggtggcatgcttctgtagtcccagctacttgggaggctgtgatgggaagattgcttgaactcggaaggcagaggttgcagtgagctgagattgagtcactgcactccatcctgggtgacagagccagatcctgtctcagaaaaaaaaaaaaattcttatgctatccaggaaagagcatatatgagaaataactctggtcttggaggctgttattttgttgtgaggagagaaacagatacaagtgagcacttagggctttggggcaaagccatttcttttgatctttcttcccagccagagtcttattggaaagagagaaggcaaagtatacttttatctagaataagaagttttctgtcccctcaacattcctgaatgtgaatgggattcttttagctccattgattctctggctgaggacccagggcccaggtatccaaggggcttttccctcttccccaatatacacatttgccaagttccttggtcagctgattctgcctccagccctgcctctgtggtggcctttatgtctatttcatttttctttaaaaggaatcaggagcttaaccctgggtcttcctgggctttggcttgggaggttggctccacgggagatgaggatacccagctcatttcctgcaaagaggcattaatgtggaacagtactagtgtggcagagatggttcttatcaaatagatactttgaccttatcaggtgacaaattaacaaaaatagaaggaaaaccatgactggggatttttagttttctttctttattatctggtaactgtagctgctttttttttttttttttttttttttaaagtcaagagaactcaaaaaagccagagcatttctgttctgggtgaggttggccagactgtttttttttttttttttttggagacggagtttcactctttttgcctaggctagagtgcaatggcgtgatctcggctcactgcaacctctgcctcctgggttcaagcgattctcctgcctcagcctcccaagtagctgggattacaggcatgtgccaccatgcctgggtaattttgtatttttagtagagatggggtttctccatgttggtcaggctggtctcgaactcctgacctcaggtgatccacccaccttagcctcccaaagtgctgggattataggcattagccaccacgcctggtctggccagactcttttaactgccgtctccttgctgatgtaaattgtcttgtttgctttttttccaagctcggcatttaccagaaggcatttgaacatcttggcaatgcactgacttatgaccctaccaactacaaggtattacaggctgtgaaggctctggccttcatatagacggtcccactgctcctagaggtgatctgaccctggaaagcaaaggaatagcttcttaaatttggatacctgagaaatagaaaaaatataaataaaaggtggctcttcttatttgaaaatagtgtcaagtatgctctacttatcttctaaaagtgcacatttgttataatagacgtgtaacccctgcagaaggcagatcatagtgctagtaaagcttatgtgttacttaggaaattagcaatgcctccacaactattgtcaaaaataaatctgcggcccggcgcggtggctcacgcctgtaatcccagcactttgggaggctgaggtgggcagatcacgaggtcaggagatcgagaccatcctggctaacacagtgaaaccccgtctctactaaaaatacaaaaaaattagccgggcgtggtggcgggcgcctgtagtcccagctcctcgggaggctgaggcaggagaatggcgtgaacccgggaggcagagcttgcagtgagctgagatcacgcgccactgcactccagcctgggtgacagagcgagactctgtctcaaaaaaaaaaaaaataaaaaataaaaaaaataaatctgctgggcatggtggcttatgcctgtaatcccagcactttggaatgctgaggcaggaggatcacttgaggccaggagttcaagaccaggctgggccacatagtgagacccccatttctacaaaaaaaattatccaggcatggtggcacacacctgtagtcctagccactcggaaggtggaagagggaagatcacttgagcccaggagtttgagtctacagtgggctatgatggcaccactatactccagcctgggtgacagagaccctgtctctaaaaagaaacaataattatgttgaaatgacttctagagtcctaatgatttgatactacaactttttttctagatgtgactttgggaatgagaaggaatagcatcaaatggatgaacatcattgaggagatgcagcaagacaagctgtttattaaaggatacaaactgaattctgatttaggaagtaacattagactgtcagctcccaccttgatacctttccttagagaaatgaaagggctgggctgatgaagcctaaagctgactcgccctctgttttacggtagaaagaaatttaccttaagtagccacgtacaggtgtatttcaggtatctagaacacttggtataccaaataggggctgcagagaacagattaaaggaagtttttacttaaagggctctggtattcattctgaaatactgactttcctggctagaagtaggaaacagatgggtaaagcaagtaacattttatctttttttttttttttttttttttttttttttgtgctgtgccagagagccacagtgtagagtgcaaggacattcctcaggaacatttgtcccaataggttggatatatttatgtccctggaagaaattttccagtcccatctatgctgatgggcctgctgagtatagactcaggaaagctgccccactgctacagccttttgggaatgactgaatgactttctctgtgccatgttttcaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggtgagtgtcccctcatgttctttgtttgtatttctacatgtggttattgggtctgtttagcttgcccttctcattgagtgccccttctctctcataggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcaggtaagaaacatttatgtggaaaactctctctgccatctgtaatgagggaaaaatggattagaatcatagaagatcagtggctgtctcataggagccattcccttagagatcctgtaggaatctggattactgtcctggagcttgaagaaatagaaaaagatgacaaaggaacttggttgtttctaacttgggggagtttgactcagagaccaacaggttaaataaagatcatccctagttcaccttttaccagttttttcctcttgccttgacaattcatttatgtatatattgagtccaactaagttccagacagcaagtgttaagagcttgggttttaggtagggtcctgcctctactacttattatatgtacctagggctgatgtgaggattgcatgattaagctctcaattaataatactggttttgttgaaatactgatttttgaaaactgttggttttactgtggttatataattggtctattattatcaatattgttgttactataattggcccctaggtgatacttccaagtcaagctaccttatgttgaaacccttatctcttctgagcatgttatatagaatgccattctcttcctgaaactccattttatgccatgcaaatactaaaattgatcataaaaataagttaaaattaatcaaacactttaacaattatgcacaaccattttaaagtactgactagtctttctaggaatttttttctccatatacatttacttactaaatgtaagacccaaagcagatttccatgtcctcatttggcagtcgtcttccagtggctttttgttcattactgtgggttcttatttaaaagagaaagcttgcaaaagcaattgtggttatttgagggttgcctgaatacaaagataactttaaaaaaaaaacataggttttattattattcagatatggtatgggcaacagatcagaagacatctgccactggaaagatagtctgttacaattcctgagaaggagggcatgctacaccgtgcagggccacatggggaagcaccaggtcaatcaggaggtagagggagcaaggggtaaatgtgggcacaattctttattgtagttttcatgggtagaaatgccctccccggggcaagaccgggaaagcaggttaaccaggttggggattggccagtttgaataatttcagtgggctctgggctatagggctgtctctaggtgtctggtacctgaccctcgggtgactaggactagggaatattggcccagtgtcagggcccagtaaaggaggcagttaagaatatgaacactgggttggtcggtctgcatacagaaggtactcttgtaggggttatatctaggaattagctgactgtgggagggacagtctccccagggtcagtaaggccccagatgtcaaaacatcagaataaaaaggctaaagtggggtgtgatggtacatacctgtagtgctggctacttgggaggctaaggcaggaagtttgcttaagcccaggagttgggagtacagcctgggcaacacagtgagactccattcctctctctttttttaaaaattttattttaggttcaggggtacatgtgcatcctgttacacaggcacgtgtgtcatggggattagttgtacagattatttcatcacccaggtactaagcctagtacccaatagttatttttttctggccctccccctcctccagtaagctccagtgtctgtttccctctgtgtctccatgtgttctcatcatttagctcttatagtgagaacatgcaggatttggttttctatcctttattaatttgctaaggatggtggcctccagctccatctatgttgctgcaaaggacacgatcttgttcttttgtatggctgtgtcgtattccatggtgtacatttacattttgtttatccagtctaccattgatgggcatttaggttgatttcacatctttgctattgtgaatagtgctgcattgaacacacacatgcatgtgtctttatggcagaacgatttacattcctttgggcatatacccagtaatgggattgctgggtcgaagggtagttgtatttttagctctttggggaattgccagattgctttccacaatggttgaactaatttacactcccatcaacagtgtataagcattcccttttctctgcagcctcaccaggatgttatattttgagtttttaataatagccattttgactggtgtgagatggttatctcactgtggtttcaatttgcatttctctaatcagtgatagagtttttcatatgcttgttggctgcatacatgacttcttttgaagtgtctgtttatgtcctttgcccattttaatgggattgtattcttcttgtaaatttgcttaagttccttatagatcctggatattagacctgcatggtttgcaaatattttctcccattttgtacattgtctgtttactgtgttgatagtttctttagatagctgggttctaatggaacacagaaatgtaaacagccataatgtaagagataacagcgatgctaactttacaaagtagagatggcattcaaactggatcctgaacaacaagctaaaatggaatagcacagaatggctgaggagccactgtgaagaaaggcatgcagccatgaaactgcagtgtcccttgctgttagtgggggttagtgttagagaatatgatgggagatgaatcaggaaagatattctggggtcagattatggaggtcatgcgtacagtgcaaggactttatcttagaggccatgtttgtccagctgtcttcctagatctcctcttaggtgcctggtaggagtgagtgcatagctggtggggaggtggaatgggcagggcttccagagcagctgtttttgttttatatattaggtgtcaaggaaatactgattttaaaaagtggggggagtgttttactgctaaatgaaagtgtaaagatcatggttatagatgtggggggccagtgaggattcctaagtaggatggtaatgtggtcagatttgtaaggcagtgagatacctggcagcgctgtggaaggtggaatggaggcaggtggggactttgacactggggaataaatggaaagcctaaaactacttgggcctgaacaagggcagtgtcagaaaagaaactgcaaaaaaaggatgcatagaacctggcaactgattgactgtagaagagatggttgaagatagcaccaggtatctaagctgacttagtaaactctggtgccatgagctgacagggtgaagtttactttgggggtagtctttaatactccttttgtcttctaagctgagctctccagctgcagtgctttctttgttgcagtggctctgaccaatctggaagatatagaaaatgccaagagagcctacgcagaagcagtccacctggataagtatgcactttgttgagaatggtactggcgggggttggactctccaaagccatgaggtggtgccatacatagcattggtgctgcctgtgtcagcccagctgttcctctatggcattagtacatagcagacctcagtgtggagggatgtgtctcctaagtatgtggtggctcagcaggaattgacactctgagaaaatgtttccagtcctaaactgagtaatcaggaggctagagaatgtcagaactggcagtgggcttgggttgctgatagctatgggctagctggaatatcagatgggactctgggctgtttaattcaagataaaacttgactcttccaggatttactccgctggcatcttctagacagcagggtagagatccctttttcaaccctggcctaggtagtctctgttgagggctgagatgccagatttggtcccaataccagctttgcttgttaggccattaactccttgattcttctccacaggtctgcttagcacgtatgtacctaccttgctgcataatggagaaatctctacttaaccagttttgttttgtttttgtgtaatgagaaggatctctaaatgaccatttgttgcagagcccccagctccatagaatctctgtctgccacaggtgtaaccctttagtaaacctgaactatgctgtgctgctgtacaaccagggcgagaagaagaacgccctggcccaatatcaggagatggagaagaaagtcagcctactcaaggacaatagctctctggaatttgactctgaggtatgtcttttattagctcccaagagtcataagtaagctctcaggagacttttaaaaatcaagcccagatcatccaaatccaaggtattacacgttcatggctgttctggctttgatgttcctagcagcatgagttcatcaattaataacagcctgagaaaaactttcctagaataataataaaaggaaattcaggcttactgagttgttattgctaattcaactcatcaaagttgaggtctgtgtctgtctgtagcttccttctatttcactttttttttttttttttttttgagacggaatctcgctctgttgcccaggctggagtgcaatggcgcaatctcagttcactgcaacctccgcctcctgggttcaagcaattctcctgcctcagccttccaagtagctgggactacaggcgcgtgccaccacgcccagctaatttttgtatttttagtagagacggggtttcaccatgttggccaggatggtcttgatctcttgacctcgtgatccacgtgcccagccctatttcacttgttgtaggaaatgcactgtttggcccggtaatgcaccaggcttgaattgttgggttttgagatcctatgtgaaccaccatgccatccagtaaaggcaatctgtaatctctactgtttgataagtacttcctgcctcaactgctagtacgaccagacactatttcagctaaaaccccagctcgaagaccaaagaagtgggttggcttgtctctgacagtcacgcttttgattcttttacttcctttgtggacacaagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtaggaccatacagagctccatgaagacctggcaggtacaagccacatgtgtctgtcagcagagattatagctttcagtgaggttctcttcagactcatatgtccaacgtagtattggccacaaggggagaaaaaaaacacagggtggctaaattggcacttgtttccttaaggcgagctatgtagtaggtaacagctactcacagacttagttggatggtctatacactggtctttccaattttagcaatatgttattaagtatatcctgttatgcaatgtttaatttttactgctttatcagaagttgacacgtaaatatttttcagtgactcattgaaggcaaacttgactgttgctttatttctcagttatagtcttcccttatagttaatgggtcagtcccactggttccagaaaatatggggtttcctcttgaactctaacagcaaaaaagaatgatttcttctgaaattgtggaacatgaggattcaagtttttattttgttactaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctatg

SEQ ID NO: 37781 - DNA, 202154 bp, Homo sapiens
gacgcgctcgtggggaaaaggcagggagggggtggtgtccccagccggtttggggggtgcgttgcccggagacggaaagtttgggagcccgagcaggctcggctgcagcctcggggagggggtccagcgggtggcggccctggggatggggaaggagcaggagctgctggaggcggcccgcaccgggcacctcccggcggtggagaagctgctgtccgggaagcggctctcctcaggctttgggggcggcggcggcggtggctctgggggcggcggcggcggcagcggcggcggcggcggcggcctcggctcttccagccaccccctctccagtctgctcaggtgggtacgcgccagggccgggccgctgcctgcagaccctttctcccccacccgtctcttgggtccccagagagatcgggggtcctgagactcgggcggggtgggcttgtggcgtgcccggggcgaggcaggcggcccgcgggccagggtaccggagggcgcgcaggtccgagtccacgctgctccgggctcgcctggtctcccgttctgacccggctgcgaagaatggtgggagtgcccaggtggcagcctccgccgcatggcacagccagggttcactctcgctcgctacagggtgccagctatcgtagctcacaaaagccaattaagagcaaatatgtatatcttatatatatatatatgagatctccctcacctcctgcagaaactcctacgccttgtagaatctcgaggctcctctggaggaaattctattgattttcttctctgaggaacttggaaccttccaccaggctacacaggacctcgctttatttttttttttccctcgagacggagacttgttctgtcagccaggctggagtgcagtggcgcgatctcggctcactgcaacctccgcctcccgggttcaagcgattctcctgcctctgcctcccaagtagctgggattacaggcgcccgccacgacaccaggctaatttttgtatttttagtagagacggggtttcaccatattggccaggctggtctcgaactcttgacctcaggaaccgcccgcctcggcttcccaaagtgctgggattacaggcgtgagccaccgcgcctggcccctcgcttttgttttattaaaattgcctctggatgtatcattttcaagatgttcgtctttgagcctctcttgtgcttgaagttcaaattgtagttccttgtagtgaacctcattggattagtctaagtggcatatgcaggattcatccaggggcttattcatctagaaataaaggcagagagacttgtttaggaaaccgaaggatgctgtaaacttttccaaggtctgttgttaaacgcttcaatctggagctgtaaggaccgagggaaaaacatcagttttgtgtggcttcgaagggggattgggggtgctttgttagtgtgagttaaatgtgttagttcagcagcgctttcatagcctgatttctttttccttccttgttcttttgaggtttttaagaagtggaagttcatttagaaatgccttcgttagcttttgttccccattactttatgtaacttcagtttgagtgagcttggaccatataagcctaaggcgctaataaattgttattaatagatattaagcactgagtaccaacccaggtctttacaggaagattttaaaaagcaatataagtaggtacttaagatttgttgaagaaataaaagtatcagttgcaggacaataaatttctaaataaatggatggtggatggtattactcgctgtaattgctagcagctcagagaacagagacatcatttagggatggagtggaagtcagggcttccaaaaggagggagacttaagctggccttgaaggatgtgaggatttgggtaggtgagttatgatgggcatgtttcaggtgggtaccccatgatcagaggcacagaaatgagaatggagacttatttggtgctccttaggcaacaggagaagaacttcctgcctgcacccttgagaggttgggcataataaaggtaaataataatggatgggtatacttccatatatcatgtttatattctcagtccctagatcagtgcctgacaacttacaggtgtttaataaatgtacagtgaatgcatgaattgggttttgaatcttacctggatttgccactctgcagttctgatgtctgagaggtgacaagactgtacaggtttggagatgcctctgtctttaatgagttgatgacatagcatttggagattttccagagatatcttaaccctcagcatatcctgctaaagtgagaagtttctcatatctcccaccctcaaacacaggtcaaattattcttttttttttttggagacggagtctcgctctgtccacagtctggagtgcagtggcagtatctcagctcactgcaaccttcgccttcctgggttcaagcgattctcctgcctcagcctcccaagtagctgggactacaggcaagcgccaccacacccagctaatttttgtattttttgtagagatggagtttcaccatgttagccaggctgttctcaatttcttgacctcatgatccgccggcctcggcctcccaaagtgctgggattacaggcgtgagccaccttgcccggcctcaggtcaagttattcttagtgcgctcactcggagactattgaaattctgctgaggatttaactgccatatagttaatatagttaagcaagactaggaaacctgttgagcacaatgcttctactttgggcctcttgctgatgtgtcctgtctctgccataaagtgtgttaactctctattccctagagttagagagctggctcaccttgacttgcttctgtgtcttttgtagagagggtaaatgcctaatagcttcccaacctctcattcctgtgactcctaggggcagggaggatctggaggcactagttacactaattagaggtgactctggttaaagctagtaaaagatttctgagcaaatgagaccatgcctaggtcagtatgtcctccctttttagatgtggacatagtgaagggtaggttacctctgctcccaaccctctctcccctaaagaccctggattatttaatgagagctgtggaatcatagcttcagatttggcctttgtattagcggccatattctacccctatttgtactgccaactgtaacttgcctgaagtaaagctggcagaaataggagcttacagttgcagtggaataattgttccagaccacacatgtgtttgtgtattcacctgtttgtgttcccccatcccgtattccacaaaggctttgtgtttattcttaagctaaaaaatgccctcttctcttacccatcccttttcctctacacagcttgggcttaggttttaacttcttaaagcccttcctgatgaccctaatacacacagatctctcaagcttccatgtctttggagcacgtcatctgtagtgtactttgcttgcctagctttcacagttgatcgctttggcctgtcagtataatgtttacatatagcaaccctcaccgattgatgctatacctgagaatcagaaagtcagcaaagaagacttctactagaaaaacatgttgttacaaactttgtgttcttctagccttccttatttactggatatttattcaggaacagtatagcattatactgtccactttttcttagcattaagcatgttatagcattaagaccacttgtttttgtgtcagacttcctggattcacattccactgccaccactgactagctgcttgacattattcaagttaaccactttgatactcaatttctgcatctgtaaaatggggataatactatctgccttataggtatcatcttagataatgtgtgtacgggacttaccataattcctggcatattctaagtcctcagtcttagtcatcctcagttcagcacatacggttttgctgtgttgcacctgttctgtgcaaagtaccatgccagacacattatttatttttatttttgtagagatcgtgtcccactatgttgcccaggctagtctcaaactcctgggctcaaacgatcttcctgcctcagcctcccaaagtgctgggattataggtgtgagccacagtgccctgcctgacacattttaaatggtgttttttcatgcttggggatctgttttccaagcatggcagactagaaagagtaaataagggagaggaatcattcatatacccaatgtttacccatgatatactttgtgccaggccaagtgattgctagatgcactgcaaaatatgtctgagacctgggacattgtacgtggtctgtcagaattagcccctctcttcatacatgttctgttcccttacagagtttatagtagtatgatacgtctgtgtaacaggccaacaaaaaggagacagagaaagcacacaaatttagcataatttatcctacctcccggctgtttgaagctattaacataggtgtatatagccctatatacctatgtaagccccaagcatcagtttactgtatctttgtgctatgatttatgtttattatgactgttagccatcaaataaagattaaattatgttcaatatagcttgttagtgaaagaagaaaaaaaatatagttttctatccaaaatggtttaaatataatttttttacttaaaaggataagcaatagattatctagaaagcacagttatccagaatgtctaggcttacagaggctctggattgcatggattatactttatataatactaactcattttctgattgtttaatggatgcatgccttcggtctataccttgggagcttgggataggcattctatcaaacttcttaacttacagtattttttagttctgggcacgtagcgggcactcagattctcatgtaacaagacagtttgctatgtttagagttatagtgaaatactgatttccaagaaagaaactcctgtataagaatattgtaagatttggttaaaagtaaattctatcaactaaaaggccaaaaagatctgagaaaaggaaatgttaaaaccaatcatggccaggcacagtggctcacctctgtaataccaacactttgggaggctgaggcagctggatcacttgagcccaggagtttgaaaccagcctgggcaacatgctgaaatcccatctctacgaaaaatacaaacattagccaggcgtgatggtgtgcacctgtagtcccagctactcgggaggctgatgtgggaggattgcttgagtctgggaggttgaggctgcagtgagccaagattgttccactgcatttcagcctgggtgacagagctagaccacgtcctcacaccaccaccccccaaaaaaagaagaaaaaagaaaaccagccacaatagcttcaaactgtaaattgagttatgaactaaatactgatgtatatgaatggaaaagtaaagtgaaatgtacttcttagggttcagaagcacagagaaactaaaccgaagatcacagttgaggagattatgttatggtttaggaatattttatgcttaatttctcaagcatgagaagggtgaataagaaaagaggaagccaaggagacttgctggagaatctgaaaatttatagatagtagcaatgaatgtggctttaaactaatttttatgctgccatttcattgggggaataaaagaaaaagaaaactattccaaaacagatatgaatttcccaagatgtgaaaatgttctgaaataaggaatgaagcatgaaaaattttgaaaaatggacctcatttggaggataataacagattctcccaaatgtcagaaaatatggcaagtaattcattgttgtaaagaaagcttcctaatatttatttaaggactttggtttttttttttttttaattaaaaaaaaaaatttaagagacaggagtcttgctaatgttgtccaggctgaccttaaactcctgggctcaattgatcctcctgcctcatcctcctgagctattgggactgcaggcacatgccaccatgccaggctagacttcttcctcttgttagtgttattattttttaaacagtgattagcataaccattctattgaaatggtcctttattcattcccagaatggatctgaaccttggagattataatggcgtgacagccttttctcatgctgacctttttacttttgcccactactgtgccagatttcttttgaaagtgcctattttgagcaaaatgattttaacatcttaaggaagagggcaacactgaccatgtaaggattgtagaatggaagggcctggaaacagatcttgtggatttgaatttgtctgatctaagttcctgctcttctaagagaatgcaaaaacaagataaaatgcaactatccactagcatagcagttttctgggtcttccactaaactatcttaattaattaaaaatagtttttcaagaatgtctttctttttttttttttttttttttttttctgagacagtgtctctctctctcgcccaggctggagtgcgatggcacgatctcgactcattgcagcctccacctcccgggttcaagcgattctcctgtctcagcctcccgagtagctgggattacaggcgcacgtattttagtagggacgggatttcactgtgttgcccaggctggtctcgaactcctgagctcaggcagtctaccctcagcctccggaagtgctaggattacaggcgttagccaccgtgcctggccttttttttttttcttttttttttcagagacagtgtctcactccttcatccagactggagtacagtggtgcaatctcagctcactgcaacctctgcctctcaggttcaagtaattcttgtgcctcagcctcctgagtagctgtgattacaggcatgcaccactgcacctggcgaatatttgtattttagtagagacaggggtttcactatgttggccaggctagtctcgaactcctgacttcaagtgatctgcctgcctcggcctcccaaagtgctggaattactacaggtgtgagcccccacgcccagccaagaatgtcttaaaatactccctttaagtgtgattttgttgggagggcagccctgttcctgcattttggaattgctgtacttacatttttgctttctctaaagcagagtgtggttcccatgttaaaaaacaaaaggaaacaaaaaaaggtaacatgcttggaaatgacttttgtggtagttactttatatgtaaaaatctagaaggtgcctaatcttaaactgagtaaggcatttacttagaattaaagataatttacccagcctgggcaacatggcaagacctcgtttctacaaaaaataaaaaaactaggccaggcgcagtggctcacgcctgtaatcccggcactttgggaggctgaggcgggtggatcacctgaggtcaggagttagagaccagcctggccaatatggtaaaaccccatctctattaaaaatacaaaatcagctgggtgtggtggcctgcatctgtaatcccagctacttgggaggctgaggtaggagaattgcttgaacctgggaggcagaggttgtagtgagccaagatcgtgccattgcactccagcctgggcaaaaaagagcgaaactccatctcaaaaaaaataaaaataaaaaattagctgagtgtgatggcatgcacctgtggccccagctactcaggaggcagagacgcaaaggtgggagaattgctagagcccagaaggtggaaggttgaggctgcagtgaaaagaaaatttactacaaagtttaagatttaaagtcagtggtctccctttttcctgcatcctccaattgaagttcagtttttactttcttagttgcaaaaattagagacaggaaacaatgaaacaagcttgtgatctgaagaatttgacttgtatctagtagcttcagcatgttcacgggtcataggaggttatggtcccagtgaaagttacattcttggccagaaaaatcccttcaggaggttctttttcccacattggattgttcaccccaaacagctgtgaattctggtttgcaaaaggaagtccaggctatttctgccctagtctttcatagggaaagtaaattactgggtttttagcccagaaacactaaggaaaccccagaagtagacagtggagagtttgttcttagaaaaatcaggctctcctgtgggtaggaacttggtctcttttttggagagctctcagaaaatatttcccacactgatttccaaaggattattgggagattttctgtggtagagaaaattatatcgtataatatgttacattcatagaacatcttcacataactttggtgtggttagagttaatggtagtaatactggaaattatatggtatgtcttcatatttatcctttctcagtaatttgtagatcaagtttgtttagtttacaaatcaaaaaagagtttttaaaacaagtcagttgtctctgctttgaaacaagatagttgtatctgtttgtgatattattaccactgatccaggaagcagaactgcctcctggcctacttaagtggtgaggacatactatggtggctaaggatcaggttctgacccaactctgccttgtgacttaggcaaattaagtcacttttctgcgcctctgtgtcttcatatatataatgggcctgggatggtgcctatcttctaaagcagcattaaatgagctaaaggatgtaaggcatataatgcctggcacatggcaagggtttggtaaccctcagctgctagaatcatctaatgggagccaggtgcttgccacccttgatgaatcagagtgaggaccctgttaaggacatatcttttattgatgttgccattttaacatttataataattcacagcagaagctcccaaccttttaaactatgaagagtcccatagttttaaaaagcctgaaaattggcaatggtggcaaagttacaaagcaatccaggtccacaatcctttgtttgaaaccttggggccagatatgttttcagggtgctgactcaatattgtatattgagtccctagtgggactgtggcagcaccctggaaacattgtatttctacagcaaaacctgtaaatattgactaaatgggataaatatgaagccgcttcatatcagcgtaggtcaggttttgcagctaaatgactgctgctaacttatgaaaatatattttcagagctttttggatttctgaattgttgataagggactgtaaacctctgcctttatggtagaaaaattgcaagacaaagaaatgcactaagaagaaaataaaatcagttataattttaccacctacagaaattaacttgaaattttggtgtacaatcttgtttttttctgtgcaaacttttttttttaacagaaatgacattattttgtatatactttgtctcatgttttcacgaactatattgtgaaaacactttcctatattttctgtcctcctcaacctcattttaaatggatgtgatatccgtggtatatatgaattgtaattaatttaacccctttcctgacatggaacatgagtttgtttttcgttttttgctattagaacagctctgtgatgaacatgcatgtggataagtttgtgtgtacattctgcttataacatttgatatattcaatagaatggtaggtgtagtttcaacattcagccattgcagaaatcaacagctgaatattcaaattgcacctcaaaatcaacaagaaacatacatgttgttgaatttgaggactcatagtaattctgaggccccttacatctcctgggtccttctgactgggaagtaatatactgatttatggttgctaaatactacttatattcagaaagtaacctttgtgcaagcccaggactttttaatggttaacttaaggctttactggttctttttcatagaccaaatgtttagaagagggccattaataatacaaatgcatggagcaatatgctccaagcagaataaaataaaaacagctttatggcccagcatggtggctaatacctataatcccagcactttgggaggctgaggccagaggatcacttgagcctaggagtttgagagcagcctgggcaacatagtgagacccagtttctattaaaaaaaaaagtaattaaaaaacaaaaaaaatagctgttattttgtaaagtagagatgaggtcttgctatgttgcccagtctggacgcaaatttattttttcttttaaattatagttgagacctatttacaaaaagactgatggccagaaaagattacaaaacaaatcagttcagagctgtttacctgagtgtctgaaaggttcttagactttctgatgtggtttttagaactttaactctttgctgtacctggggaggagccccagtcttggctttgctcataactatccacatcatgctcaccactcttcctctgatccagcctggtggagtctgtgcattggcttttgtcctcaatggggccagccgcctgattcttgctttttcaggttgccctgcagccatgatcaaacttcaatgcaaagtccagcccatactgtagtatttgaagtcagtaactcaatagctcagaaatgttgctactgacagtattgtgggtgagtgtgtatgtgtgtatttgggatgggtgggatggtttcacttcttgagcacttaatactttgctctgtctgtgccaagggctttacatacatgtatttgctcagtttacctacacaacatgcctgcaaggtaattattgttatttccattttacagatgaagaagcaaaagttaagagagaggttaaagtgactagcccagggccacacaggggagtgcagagcctggcatctttgtgattccaaaacttttgcttataaagcactgcatttggccacttggagaatcagtctctttggatgagacttaagcgaccacttactatatgcttaggtaaaattttgctgaaaagattaattagggatttatttaagtttaatagttgcttttataccacttcatgctatacccttctaagcactttacaagtattaactcattttgtcctcataacaactctctctgttttttttttaataacaaaaatagagatggggtctcactatgttgcccaggttggtctcaagttctggagctcaagcgatcctcctgcttcagcctcccagagtgttagaattacaagcatgagccaccacacctggccataacaactgtttgaggaatacactagtagtattgccattttactggtgaggaaactgaaacacagagagatgaagtaacttgccaaggtgcagtaagctagtaaaagttagagcttagttttgaacccaggcagacaggccccagagtctttgctcttggttattatgcaactgggacttcttccttttacccaagaatgtaacacaaagtcctttgggaagactttgactacatacagtgaggtaggctcattaaaaaaaaaaattggcaaattccctggaacacaggaaagttagataaagagaatgcctttacgtctatgccaaataatatattagtttagagaatgtgggggacttccctatagctcccacattgctttttcggacttctagaaaattctcatctcatgtaggtgcacgtgttcatgaattttacctgtgagaaaatttaagtggtccctgtgccccccgcaaccagttcaaaatgataaaaattagttttggacccataagctacataaactgccagatgcactaccagggccaaagtttgtacaggggaagtgaatctaaacaattggcaagaaccaaaagcctgtgtatttgaagttatttccaactctgttttttttttttttaaacaattcgctccctcattagtgattaacaaccaaaatttgcattctcaaataattagttggcccataaaatgtttttcagacagtattatctggctggttcaaatgatggttgatgctgtcttgaagcctaggattatgggatgggaaatgttactttccataatccttggtactttaatcttcacaatccttcaatacaggtattagtgcccattttactgatgattttctagtggttaaatgactggcttagaactgggctgaggtggggttttttttgttgtttcttttctgagatgaggtctcaccctgtcactcaggctggagcacagtgatgcaatcacagctcattgtaacttcagcctcctgggctcaagcaatcttcccacctgagtctactgagtagctgggactacaggctcatgacaccatgcccggttaatttttgtattttttgtagagacggagtcttgccatgtttcccaggctggtcttgaattcctgggcttaagagatctgcccaccttggcctcccaaagtgttgggattacaggcgtgagccatcacacccagacaggactgaggtgttctgtttgtgaggcctttaagggtcctattttatgcagaatcatggctaccaaaaagacgtctgtggaagtataaggtggaaagtataaggagaaggtagtattctagctaagtagctctgaaaatacctatgggtcctatatacctaacagtaatagaataggcctattactttttacctacaaatgaaaatactttagatattgaaattggcagagattccacatttgttactttttaatctattgctatctccataattgtgtgtttaagactcagctggagaatagttttcttgctagtcactcatcagcagtctctcttgccatctttagcagacccagagcagagtttcaaaagacttttcaagtagatgatccagggcttagtgcttcattttaaggtttaagtttttcttttttgtttcttttttttttctttttgagacggcgtttcgctcttgctgcccatgctggagtgcaatgcgtgatctcggctccctgcaacctccacctgccgggttcaaacaattctcctgcctcagcctcccaagtagctgggattacaggcatgcgccaccatgcccagctagttttgtatttttagtagagacgggatttctccgtgttggtcaggctggtctgggactcctgacctcagatgatccacccgcctcggcctcccaaagtgctgggtttacaggcgtgagctaccgcgcctggcccaagtttttctttttaaaagaaggagtgtataaaaaatcaggtccagtacttttactagatatgttttgtcgaccaaattgacagagctgtctttttaaaagatgtctttttccaggccaggtgcggtggctgtagtcccagctactcgggaggctgaggcaggagaatcgcttgaacccggaaggcggaggttgcagtgagccaaaatcgcgccattgtactccaccccgggcgacaaagcaagactccgtctcaaaaaaaaaaaaaaaaagatgccttttccttatccattatgatctgttagacttgctattgtcttcagttaccatcatttccggttacctttctctttaacatatgttcttttgtaaaatttatagttcatttacagagaaaactgatgaaaatagcaatccaggtaccctagcgtcttctcattcaattggcagatatttatgaagacctgattcttttgggtgaaatttcacagtcacttaaaaatatctgtgtttgctgagaggaatgcattataccaaattataagtttggtataatgctgctagtactagcagaatgatatagtagaagctaaagccaatatttttttggatgtatgtgtggggcgttcccactgtaatccataaaacccatttccagtaacttctgtcttctgtgttttttatcctaatattgttactttcaaattggctcattgtggggtttgattgtcattctgctgcaccaatttgcccataaacctctgtatctctttaacaggcaaatcatcatgtagaaaaacttttttttttttttccaagagaggatcttgctctgttgcccaggctggagtgcagtggtgggatcatagctcaagctctcctccaacctcactcagtcttttgagtagctaggactacaggcatgcaccaccaagtttgcctaattttgtttgtttgtttttttaaattgagacagagtctcgctctgttgccaggctggagtgcagtggtgtgatcttggctcacaggggcctccacctcccgggttcaagcgattcccctgcctcagcctcccgagtagctgggactacaggcacgtgccctcatgcccggctaattttttgttcgtttgttttgtttttgtatttcagtagagacggggtttcaccatgttggccaggatggtctcgatctcctgaccttgtgagccacccgcctcggccttccaaagtgttgggattacaggcatgagccactgtgcccagcccatctgcctaatttttaatttttttatagaggtggggtcttgctttgttgcccaggctggaatgcaatggcacgatattagctcattgtagccttgaactcttggcctcaagcaatctttctgccttggcctcccaaggtgctgggattacagcactggctgaagaacattttctgatggattgaatcagctgtgagtttgggccacaaatctgggactttttaaaaaatatgaatacagtcgtccctcagtctccatgggggattgattctaggacccctcgaagataccagaattccagctcaagtcctttatataaaatggcgtagtatttgtgtaaaacctgtgctcattctctcgtatgctttaaatcatctccagtctaattataatacctaaatacagtataaatgctatgtaaatagttattaaaacatattttttagggaacaatgagacaaatagcctgtacatgtttaatatagatgcagccatccattttttttctgaatattttttttccatggttggttgaattcacagatctagaacccatcaatatcgagggctaactgtattatgtaataacctaataaccaccaggattgcctttcctataattaaaaaaaaaattatgggctgggctcagtgacacaagcccgtaatcccagcactttgggaggctgaggtgggcggatcacgaggtcaagagattgagaccatcctggctaacatggcgaaatcccgtctctactaaaaatacaaaaattagctgtgtgtggtggcgcacgcctgcagtcccagctacttgggaggctgaggtaggagaattgcttgaacctgggaggtggaggttacagtgagctgatatttcgccactgcactccaccctggtgacagagcgagactccatatcaaaaacaaaaaacaaaatgttttgcacttcctgttgctcaaggtgacatctgattctgattttcttttcttttcttttttttcttttctttgtttttcttttgacagtcttgctctgtcacccaagctggattggagtggcatgagctcggctcactgcaaccttcgcttctcaggttcaagtgattcttctgcctccgcctcctgagtagctgggattacaggtgtgtgccaccacgctcagctaatttttgtatttttaatagacacagggtttcgccatgttggccaggctggtcttgaactactagcctcaagtgatctgcctgccttagcctcccaaagttctgggattataggcgggagccactgtgcccggtcaacgtctgattttctattggtgatgacataatgaggttattggagtcatcacatgatgaatctggctggcattaggtttcctcattaccaggaactgggccttgtgagattttgacacttaccacatcatgctcaccactcttcctctgatccagcctggtggagtctgtgcattgacttttgtcctcaatggggccagccgcctgattcttgctttttcaggttgccctgcagccatgatcaaacttcaatgcaaagtccagcccatactgtagtatttgaagtcagtaactgagtagctcagaggtattgctactgacagtattgtaggtgagtgtgtatgtgtgtatttgggatgagtgggatggtttcacttcttgagcacttaatactttgtctgtgccaagggctttacatacatttatttgctcagtttaccttcacaacatgcctgcaagataattattgttatttccattttacagatgaagaagcaaaagttaagagagagcttaactgactgctttttgtcattgttttgcttgtgaataacattgttttcacctctttgattggtctttggtttcatgtggccgtcagagtttgagtagagcaaaatcttctctccctctttcattgatttttattttagccttcagtttgatgtgtaactacctgaacgaaatccttaagtttgagttaagccttaagtctgttcttgttgtaggattttggcttggttaaggtctgtctggatcactggggtctggcaagtatccatttctcagttttatcctctggtctctgtgcttgaactctgaagggaagaggacatggctagacagaaaaaacagtacgcaggaaacattgtctccaggaacttttctctcttagagtgcatactggctctggggaagggcctgagtgagcagtgcccctcggggatcttctgcctaatcccacctcaaccaccatctagccgtatgatcttgggaatattttttactcttcctgtagctcagttttcttaccattaaaaaatgggtggcagggggcagtgtttttagcgtttcctggcagaggtccaaggaaaggtgcatcagtgtgtcttaaaacatctgcagagttagactggggaaaggagcgactgcttactgtcctcttactgtgtgccaggaactgtgcaaggccttttacatgcctggtgcgaaaggtcaagaagagaaagaggtctgtcttctcccttcatccatgggagtgtgtgagtgggaggttgctctctctgctcgtgaaactttcatcagcaaatactaattagtgcttaattactatatgttgtgcataccactgtagcagataacttaggaacacaaaacttgacaactcccttaagaaattggcttggttatctgtgagttttcactatcaatgactgaataaataagtggggcagaacagacaggtctttcttacagaagaattccaattataaatgtaggaataatgaggggaatagaaaatcaccattagcataccatagtaataattgctgcaggcaagatctaccagtgaagaatgaaattgggtgaaagctgaaggagaaacaatatttatatggcttcaaagtatcttccccagaatatttattaattcctatggcagcttcaaccgatgtccacttgttctttggtagtcctctctctaggagatggaatttaattctcttccctttttgagtgtgggctagacttagaaactggcgtccaaataatagaatatggagagagaacagtggtaactttatagtgggaaaatctggtagccactgcctttaccgagtaatgaaggttaacatcaccagtgataagtcatgctgatgtcacatatccccagatgtgatgtgatgaaaaggacactttgcctcttgtgttccttccccaaatccataacctcagtctaatcatgagaaaacagaaacacaaattgaagaacattctacaaaatactgagtagtactctttaaaattgtcaaggctgagaaagacaagcaaagactgaggaactgtcacagagactcaagagccaagaccattcagtgcagtgtagggtcctggaacaagggacatgaatgtaaaaactagggaagtatcaacaaagtctgtagtttagttaagagtattgtaccagtgttaatttcttaagttttgatcaatgatttcttaagttttgatcaatgtacagtcatccctgggtacatgtggggtattggttcgaggacccccatctataacaaaatccttgtatactcaagtcctgaggtcagctgtgagaaacccaagtatgtgaaaagtcagacctctacacacacaggttttgaatcccacaaacgctatattttttatctgcgtttggttggaaaaaatctgcatgtaagtggacccaagcagttccaacctgcattgtttaagtatcagctttactatgattctgtaaaacgttgacataaggggaagctgggtgaaagggatacggggctctgtgctatctttgcaacttttctgtaagcctaatattatttcaaaataaaaagtaaacaagcaaagggcctatttgatagaggctctgaagtcaagctgcctggtttcatatcttgcctctgccacctaccagttgggaggtatagatagctttctgaattgctttgccttagttccttcatctataataatagaacttctcatataaagttgtgtaatgattaaatgaggtaatgcatgtgaagtacttagaatagtggcaagccaggcatggtggctcacacctgtaatcccagcactttgggaggctgagttgggaggattgcttgagtgcagaagtacaagactcacctgggcaacacagcaagaccctattgtaaaaggaaaaaaaagaacagtggctggaatgtagtaatgacggctgctaatattaatatttatacagaggaagtccagcctccttttagttactcagccattgagccagggatgtaaatagtgctggaggagtttggaggaagaggctatggtaatggagtagggtggtctggagacccctctcctagactacttgtacccctaggaagtggggccctacctttcaagaaagccaaagattcagatagctgatagaagattggtgtggaggagggcagggaacagctagaggcagaggtagagaagcttaaaataagaaagacctgtttgcccagcagtgagtaagcggctatccagcaggagtcagcggaggtgaggttggtaaggttggctagtgctggatcgtcatgggattggatgctggcttgatagagtctaagaccttgtgtctaggccactttatctctaagtgctttatttctaagcctgagagagagacaattcaaacaataaaaaagttgtttcagtttcaacaggattgtggttgtactttgtttgttggttgaaaaaatatgttgtgacagaatgattatgaactcggtaactctctgaaataaacttgtgttttattaaatatagtagcttctctgtaccttaggggcatcataatatattattctgtgacatttattctgcctactgctggtgcttggtgtacgaatgcatttgctgaccctttacaataacaacatggccccaggacagagtcaccgttttaagtatgcagacatgctttttgacttccaagcctcatcttttgggttgtcttctgtcacaggggagtgtgtttcttttattagtaaagaaaaaaaaaagaaaaattattgtaccactagaaatatggctaaaaattattgaagtataatttacatacagttaagcacttggatattaaatgtacagaccaatgtattcttacctacatacacatctgttatcatcatgaagataacattccagtgccccagaagtctcctttgtgtcacctgctagccaaaaatgccgtccttgaggttatcactgttctgaccttgatcaccataaatttttgcctggggacatgtttctttttctccaccgtacacccatgttcatgcagaacagtggagtgggagcagggcagggtctgtatgtgccaaatactacactagacacattcccagacttaaataaattctcccgtaaaacacagacctgggcttatataacttgtctaaactcaatcccatgtcattgatgccaaagtcagtgttttttccattgcgccatgctctatgtcttcaactgacatttgccataatcattatcattatcattaatgaaaagtcatctgacacttgccagtagtttatatgatcaaagaacatcagttaacacccagttctcatttctaagtgcgtttaaatggtcaagagcttttaacataactctcttgggaagcagaatgaattaagttaatttagaaccaaaagataatggcaatttcttcatttaatgagtgccttgtttgtgcaagatcacgtgctggccaacggagttatagagagaaaagaagtctcaatcccagctttgtgatcttctgatgggggagatagagaatagtgtgatgagtgctatgaaacagagggatgctggagcatcagagaggaaacaaggggcagggctggggaaatgttcctccccgaagggatgaggtctgggtggagtattagaactaaaaggagttgtacagacaaagaaggggaaaagcgagagttattttaagctggagtgtgtgtacagtgtggtggctcagtgtgtgcgaagaatgggtgtctggaagcattgtgcattgagacgactgcaggtaactgcctggtatgtaggagggagaggggttctgtggagtagaaagagattagctggggtagtaacagaggtgagatgcccatgtaaaggagttggattttacattgacagtagttatggatttgcaatttaggaagatcacttcagatttttggaagatggatcaaaggagttgagattaactaggagtgcaaaatgattagggcctgaaggaaggcagtaccagtgagtatgaagaggaagctaaatttgaaatattcaggaggaatgaacaggacttggtgactgttgatttgcagttgagtgggtgatctctcctatgactttgcatctaaataggatattacaggcgggtcacagtggctcgtgccctgtaatcccagcactttgagaggctgaggcgagaggattgctcgagctcaggagtttaaggccatcctaggcaacacagggagaccctgtctctacaaaaaatttaaaaattagccagatgtgatggtccctgcagtcccagctactcaggagactgaggtgggaggatcacttgagcctcggaggtggaggctgcagtgagctgtgatcacactactactacactccagcctgggcaacatagccagactctgcctcataaaagaatgaatgggctgggtgtggtggctcatgtctgtaattccagcactttgggaagctgaggtgggcagatcacctgaggtcaggagttcgagaccagcctggccaacatggtgaaacctcgtctctactaaaaatacaaaaaattacccaggcgtggtggtgggtgcctttagtccagctatgcaggtggctgaaacaggagaatcacttgaattcaggaggcagaggttgcagtgagccgagattgcaccactgcactccagcctgggtgacagagtgaaactccatctcaaaaaaaaaaaaaaagaaagaaagaaaaagaaaaaagaatgaatgaatgaatgaataggatattacaacataaaatgggagagtggggttttgtggaaggactggagttttgtaagggataactgaaatgaaacacttttttccctctctagtagaagggtagtattcattttagaacagctccattacttattttggtgtgcacaggagtttgtagatggagacctacagtggtatggtaactatttttttaagcaggcagataagtcaaacttttggtttatcttttgtttatcatggtgaaagctaagtctccaaatggttgtttttgtttccacagcaaagacctgtgaacctctgaactgagtgggaattagtggtatgaaagaagaaaagacaggcccttcctactcctttcagggtttatgtagttatttatttaccgacatgtgtgcagaaagccaaatcggtactttttgtgaaatggaatatagtttagattcaaaggattttatcaagcttaaagctaaccctgtttttgctttggcctgtgttctgctgtaataatctccttccttgtgcacaggataacagtgggggggatccttaaactggcaggggtattatttagccacccaggccttcttcaatcacactgagagtcctggttcttggctatgagaatgtctcctcatgaggctcaaggactatgtgcataggattgaaaacttctagaaaaggcaaaacaaattctccaggctttgtgattggcattgtctggagtcctcaccctgaacggtcattaagaaacccaaattataccctttatgctgaaaggaagcttttctcttcagctagccaaaatttagtcgtctgcttatgccaactcccgatttcctgttactataaatccttgacagtttagaatgaagaatggtggtgtgtagggcagagaatccttgttcaaatgaatagcagagcaatggcagtataccccttgggtcatatataataaaactacaggataggtttcttgcccttgaaatctcattgtaatagtgctgtgagccaccaagagtttccgccattctagttttcaggttgtgttcaggaaccattaatactttcgcaataacacaagttcttgttcatccagggatgtttatttcagcgttaaattgtaagtaaacaagcatgctacaatttatgaaagctgagtatgtgacctctgttcagtgtcaggatgaaatcaaacgctcataatctgacaccttgaatgatttgcgtgatcattgttgtactgcatgattattaggtaaacagtttatgtaagtaactataattagttataatttttacatggccaaatcaaatgttcacagtttcttgtttatttatttgttggttctccagcatctgtaattagcatcactgtcagcatttttcattgatacctgtgtagactgtgtcctcatcacttgctggttaccttatgttaaaaaaccaagtctaggttttctccctagcagtcctttagaagggacgggtggtcctcggctctattctctctcactatccaacctcaacctcagtagggtcttcagggagtaggagctccagaccctgggaccgtgtggcctgcccagaggttcaacagcacactgttgggatgagagagaggccccttcacctctgagaaggaatgaacaacagattttattttagagtactgtatagattgaaataactgaacatttctcacctaacagatagtaaggatttcaatagacatttatttgcagaattagttttctaccacaaagtcgattggggttagaaaaaggggtgcactagtagggattctttgatactgtggttagatggtcattgaaaagaaaatgatacattttggatggattgaaaagcgaaattgattttggatgacatttttgactggcttttgtgtatttgtgtggcatgcagcagtgaatggctgtgtttggtggttagatgcagaacatttcttgtggttctgctggctgtgtgtgtattgcctgttttgattgtggttaacctgactcaccatttggttccttaaggttgagtttcctttcctgtcctttatgaacatcgtcaccttgttcaaaagggaactttatcctttcttttcaaacgtttactgagtttctgttctgtgttaggccctgtgttaggagccaggtacagaaagatgatcaaatatcttgactttaaataatacctttcacatttacctctttaatctcaggtagccctaacaaccctgtaaaattgaaaaaggttgttcatgtaccccccaatataaataactagtcacagagaaatgaacagacttcaggttacacattgtaatagtgactgagctgaagccttagtgttttgaccccacccctacccattcactagttaggagagtctaaataaagtagggttgtttgtttgtttgtgacagggttttgctgtgttgcctaggttggagtacagtggcatgatcatagccctctgcagccttgacttcccaggctcaagcaatcctctggcctcagcatcctgagtagctaggaccacaggcatgtgccactatgcccagctaattattttagtttttgtagagacaacagggtttcaaacgcatgagctcaagtgattctcccgccttggcctctcaaagtgctaagattacaggcatgagttaccatgcctggcctaaacaaaatagtttgttgttgttgttgttgttgttgttgttgtttttgagacagagttttgctctgttgcccaggctggagtacagtggtacaatcttggctcataacctccgcctccctggtttaagtgtttctcatgcctcagcctcccaagaactgggactataggcgtgcaccaccacacccagctaatttttgtatttttagtagagatggggtttcaccatgttggccacactggaagtgatctgcccacctcagcttcacaaagtgctgggattacaggtgtaagtcactgtgcccagccaataaagtaattttttcttttgagatggagtctcgctctgttgcccaggctggagtgcagtggcgtgatcttggctcactgcaagctccgcctctcaggctcatgtcattctcccgcctcagcctcccgagtagctgggactacaggtgcctgccaccacgcccagctaattttgtttttgtatttttagtagagactgggtttcaacatgttagccaggatggtctcgatctcctgacctcgtgatctgcccgccttggcctcccaaagtgctgggattacaggtgtgagccaccttacccagccaatagtttttgaatctaaaattgatcaatcaggaagcatgacatctacccaaagaaatttatgtagacatttaaaaaattcatacaaatgattcttacactgggctattttatttttaaaaaatcattaaaaacattagaatttaaacaatattaattaaggactcattgtttgcccaataaaaataatcgtcacttcgtaaatcaccctaatgaacgatttagtcatcataatttgatttagtgttttcaggacgacattgttcagtgtatttttttattggtttggaaggtagtgagtaagatatttctaagggcaaaaaggaaacagttttgaaaattcttagctaatactgagttggccaggatgggtgaaacagagttaaaggaatgtgttggccccttttcttgtgcacctagaaatcctccagggcccagtaaccattttaggtttattttattaaaaaacaggcctttgggcttcctgtgttattgattcttcagtttctgcagaacttagaaggaaaatttaccccaagtaaagtgagaagagcattaacattgtaccatggatgcctaaaatggtatttattagacacaggcctgttcaaaggctctgagtgtgggagcaggggcagcagtaaagttgtctcttcctggtggtcttataagagcttctgggagcagcagtcagagggcagagctgacctgctgtgcttaagagaacgtggactttgaggccttgccaaactgaggtgattgttccaccttgggcaaattatttaatgtatctgatttctttcagctataaaatggggttatattttattctaaaatggaattttgcctatcgtatatatagaagaccattctgtttgaagtaggaagtattagctagctcatcacttatattcatttccagggtcatttgaagtctatctacctgacgagaatataaatcccatcagggctaaggccatgtctgtttgtttttctcactatgtctccttgcccctaggtcagtgccatgggcttggtaggtactcagatatctggcaagtgaaggagtccccgtaattagtactgcagctgtcgggaaaaagtgtagacttgccgcctataagcacaggtctgtatttgtcaacatcttagagctttaggcctatgtaggttttttgttgttgttttgttttttaagagacagggtcttgctctgacacctaggctagtgagcctcctgccccaacctcccgagtagctaggactacaggtgagtaccaccgcactcgactaatttttaaattttttctagagatggggtcttactgtgctgcccaggctggtcttaaactcctgggcttaagcagtcctcctgcatcagcctcccaaagggcagggattacaggcatgctgtatctttgtttttttttcttttggttagcaagtaacagtttgggtttttatattcccaagatgtctagaggatttctttcttctacttcagcttgattgatgaaaatgtcataatgaagtgaaagaaaaggcttgctgtacttccattttgaggtggaccatcatgtttttgaagccttgttctctgagccactctattttgtttggggttcactcctagtttaaggcagagctggtactctttgttcccatcttctcagagaaagtatttggtttcaggtcagagctgttttccttttagccacctaaaagcctctgaagaatttggaggtaaagaggcttcatgtctggatctttttttttttttttttttttttggagatggagtcttgctctgttgcccaggctggagtgcagtggtgcaatctcggctcactgcaacctccacctcccgggtacaagcagttcttctgtctcagcctcccgagtagctgagactacaggtgcatgccactaggcctggctaatttttatatttttagtagagatgaggcttcaccatattggtcagggtggtctcgaactcttggccgcaggtgatccatctgcctcggcctcctaaagtgctgggattacaggcatgagccactgcgcccagcccatgtctgcatcttacttgttaacacgctgaggaaagtctggacatggagatttatggaggatgagaccaagtctcaaccacagtatacttttcaacaaatattgctaattggagttaaagtgttcgttaatgtgaaaataaaattactttggattgagactgctgctggagactgctgtagaagaaaaattagacaaaatgctctctataaagcctctattttaagaagaatgattcagagaggaacataggtccaagaaattttcatcaacaaatgaaaactgaactgccaggtttgccagatgtcttattttaaggaaatttttcctcatttggtctcttgtaaaagtcttccttttgcctctgaaatataccctgtccctatgtaacttaaaaataaaattttcagagtgttcaaagttccttctgtgtaggatttgtaattctgtgtaattcagctgggaattgtattgcataaaaataaaggcaaaaaataaccacattgttggattacagagttttgggaaatttccttaatttatttagtatagtccatcgtggtctgtcactcagcatttgttgagtgcctgctgtgaacagacaccgctacttgttctttaaggcggcagcaatgtgccttaatgtggttgtcctcattaatgttctaccctatggtcgtcctaccttacatggtataatagagtagaatggctgatatttaagggagggcctctcccctttatttagacacacaagtcctgggcatctctcttttggggacaacataaaacacccctgcctagtcctttatttggtccaccactaatcctatcccagcatcctgtgtaggcctccatggggcctacatactctgtcaggggaagagccaggagagaaggaagaaggctttgaagagccagccccagcagcctgctgacagttttccttctctccccactgtggaaggactgactaccagtggagaggtggcagcaggcttttggctaagtggagaggctctctcttcctgtgtagtttgtggagaggcagcgttgactcaaggtacagttagaagtcagcgatgctttcttttgggactttccatgttgatgacctcttctctttaagtcaaaccaagctccgctgccccacagtgttccaaattacttatcaaaattcctatgaccactgtgtagctagattcaacttgatgttataaaaccagtttttgtaagataatctgtattaaagtgcaagtgaaatggcactctgttaaactaacctgaaatctgatgatgtgctgtgggaaaagagctgtttgaatagaggttctttgcttccttccagctgggtggacaggaaagacatcctgtccctacagaactgactgccactgctccatatgtcctccatgctcactggcctcttctccggacctaagacccgaaggcctatggcccagatgggtctcacctctccaagcatggctgcccagcttagggaattatagatgtttctgttctggccaaggaggagctgagagtgggggctgataagcagcttccagaactctgggattgtacaatccctggagagaggaggagactgtctcttgttaccagctgccctcctttcacctggtagtatacagcctcttcctaaagagccttactcaacccccctcactttttctgtctcagactcactccagaaatgtgttttctgttccttgttctgccctctctgccgtgttctaccctctctgccgtgttcctaggaccagaccctgctagttccttctagaaactgattttacccatgattgaaaccaaagccttaagattctgtgggtgtggaacaccttctggttgaaaaccaaaggctgtagaattccatgcagatgtggattgttgattccattttgaaggtaggtgtgatgtgggagaagtcgtgtgtgtagtggttcggagtatggtttctggagccagttggcctaggttcaaatgccagctctccacttagtggtaagttaaacttcctgtgctacagttttctcacttccaaaatgggggtggtaatagtatctacatacacagtcaccatgagggtcaaaggaaataatacaaatgaagatgttccaaacagcacctggcacgtggtatgtgcttattaaatgctagctttataactattctgcgagtgaagctacggggctgatcaaatggctgccaccaagctcatccccagtgcatgtctatgcattctatgtagaaaatcacgatgaagaaaagaaggcagcagaaggtatctcaggatcggttccatcagaagttacgacgttgagcatattgtctcaagatctccttaaggatggctactaaatctgtttcctgaattgtattgtctcattaaaagtattgtttccttctgatctgttgaagcaaaaagctgacaacacacatgaaattttttttttaacggaacaccatgtaactatagcatattgactgtgactttggttactgttacattttgagctttatatacactttattttttttatttaattttttattgagacagggtctcgctctgtcacctaggctggagtgcagtggcgccatcttggctcactgcaacacccgcctcccgggttcaagcgattctcccacctcagcctcccaagtagctgggattacaggcgcctgccaccatgcccggctaatttttgtatttttagtagagacacggtttcaccatgttggccaggctggtctcaaacttctgacctcaggtgatccacctgccttggcctcccaaagtgctgggattacaggcatgagtgctgctcccagccttatatacactttaaaagacttgatcctgaaaaagttttagttgtggttggtaaaccacaatgtttgtagttcaaaaagctggaaaacagttccttgtgaaggttcccccaggagattgttgtttctaacagaaaattaaatactgacctggagcaccttttcagtctcctggcttgccttgagtccaaacttactgtgtctttgagacttttgcagtctggctcacttctcttcccacactgctttgcactagatgcttcaatattaatttaacaaatattaagtgccttctctgtactgggaacgatgccatttgcaattcccttgaacctgggccctactctgtcttgcatctagacctctacacatgcctctttgcctacagaacttcccatgcttcaatctttaacagcttttgggctcattttagaaaatgcagttggtggtggtgaagtgcctagactctggaggctgtgtgggttcaaatcccagctctgctacttgctagcagtatgaccttgggcaagtttcttaacctctttggttcatctttaaaatggtggtaatgatagtagctgtctaactgtgttgttctgagaattaaatgaggtaatccacagtgcacttagtatattcttagcacatagtagcttcttggcaactgttagttagctattattatcatttttatgtgtcacatcctgcaggaagtcttcccagttctgcttgagggggcccttccaaagtactcccagagggcctgttctagaactcctgtcattgcctttattatgctatattgtaatttcctgtttgcttatttctacccacttctagatggcaagctccttgaaagtaggtaaggtctgtcagccacagccatatccgcttgaagatgttagggtaggttttttgttgttgttagtttttgttttttaagagttcctaattaaattgctattgatttattgatgagtgggtctgcttgcctgttttgtcataagtaaggaggtttaaaattgtgtttccccatcttctcattagagtagttttttttgttgtttttctttctttattttttagagacaaggtcttgctatgttgcccaggctggagtgcaatggcgcaatcatagctcactgcagcctcgaacttttgcgctcaagcagtcctcctgccccagcctcttgagtggctgggactatagatgtgcaccaccatgccaggctaatttttaaattttttgtagagatgggggtcttgctctgttgcccaggctggtctcaaactcccggcttcaagaaatcctcctgccttgaccttccaaagcactgggattataggtgtgagattacacctggatagactcagccttcattaaggcagtttttaaagatgcaccaaggtgtttggaatgaagaatgctattcattaagcctactttgtgtgaggcattaagtaggctttttagatacattcttattgaatttgcctcctaactcctgtgaattgggtgctaagatacccatttaagaattatgtaaagttcctaaggagagcctagtgatattttaaaaaaagaaaagaaaaataaaagaatgatgtaaagtgctcagagtcattcggctctaacctggttctgtttggcttcatggcacataatattttcactcaccgccttgctgagcacttgttggctgactggttccctgcccaaagctgctgtcccagggccttactacctcttctctagggagctgcacaattaaacttcaaaaatgatcattaaagggattcattctttctgctggggaggtactgagttggctatggttttatattgtgcagttgcaatacttgaatagcacaaaacaatgagactatcatgcaggcagataaggattatggacaaacacaataagcattggaactttgaggagaagagagctgcatttttatagcttcatttcttcatttgtccaaaagttaaaaatagaattaattatgccccataggccacctggatttctgattgatacagaaaacttacacaacatatctaaaggatagcctatgtcaagactttctttatcaaaatatgcctttgggtcaaatcatagtctcttctgaacacattttcgtttgttttttatttttattaagcctcttccttagtggatgaacatggttttttaagcaacaaaatacacgggcttagaaagtagggtttattgtccctgtagaaagcctttagattagtaggataagctgatgagcaacttaatgtctactttctatgctaagaatcactagagttccagcctttttataacatcgctacattttaattttttatttgcatatttagaaaacaataacttggaaatgacacagtctcagatgattagcatccatctgctgagctatttctagtgcaatgggcctggtggacctacatggtaccaaaggaatcttcaccctatctggtttgtcgttagtctctcacccaagctgaggggcacaaggactgctgagaggagcttccaaatgtagcagctgatgaagactttgggtctcactttgtcatccaggctggagtgcaatggcacaatcgtagcttactgcagcctcgaactcctgggcttaagcgatcctcccactcagccttctgagtagctaggactgaggtgcacaccgccatgcccagctaactaaaaaatttttttgtagagacaggtctcgctatgttgcccaggctggtcttgaactcctggcctcaagcagttttcctgcctcagcctctcaaggtactgggactacaggtgtgagccactgcttctagccaggacatcttaattgacttccttttttttttttttttttgagatagggtctccttgtgttgggctcgaactcttgggctcaggggatcctcccacctcagattcctgagtggctgggatgacatatgtttttgaccaagactctgaatataaaagtaagaagaacacagttgcaactaaagttgcttgttcacttattatattttaagcactgtgttgatgctttacatgtaccccatgtaaagccatatgcattggcactgttatccccattttacagatgaggaaactaaggtgagagaggctgcgtaatatgtctgaggtcatagagctattgagtggatgagtcaggattcattctggcaccagaggtcacattccaagtactacattgtactgtcagggctggagattttgtaaacctaccaattcaagctattgttttcacacgttgttttggccacagacattgccttcccacctcaatgagcacacctggctttgcattttaagcagttttgcagaggtcatatctgtctttgcaggatgaagactttcctccacacaacataaaagcccttatagctctgtgactcatcctgacagacgatgagataggttctgctgtgaggttgactgtgtccctgtgagcaaacttgtgcagagaaagagagcatggaggattgaatctgggcatttcttttttttttttttttttgtgacggagtctcactctgtagccaggctggagtgcagtggcgcgatctcagctcactgcaatctccacctcctgggttcaagtgattcccctgcctcagcctgctgagtagctgggactataggcatgtaccaccacacctggctaattttttgtgttttagtagagacggggtttcacctgttggccaggatggtcttgatctcctgacattgtgatccgcccctctcggcctcccaaagtgctgggattacaggtgtgagccactgtgcccagcctccaggccatttctttagcccaggggcaaaggtaggagccatagaaggcaccacagcaaaagccagtaggagctgaagaagacgtctagaaagactacgatgcgtggtgagaggaaaggttgcccaaccgtactgagggcttcagagatcaaggagaaccaaaacagaattcagattttgtgattgaatacattgctggcctttgagattatgttccattaaagtggggaaaagtgagtgttgccttgaggggctttgcagcgaagccacgggtggggagtctgctatcaagtatagaatactgactttaaaagtttgtgttccaaggtcaggaatagttgaaataaggtaggttgagggaccttgaggccaatgaaggctttttcgtctttgggaacccggttctgaccatgtctaaagtcaacggaagaacctgatggaaagggagaaatcaaagatttctggaataatgttagtagttatcacatattgaatgcttactgtgtgccaggtacaggcagaagagcatttcctgttctatcttattcagtctgcacagcaaccctgggaagtaggtaaccagacccccttttacagatgaggaaacagaggcttagagtttaaacaacttgccaagactactattaaattgtatagttttaaactcaggtctatcaagctatatcatagatatgattgagtgagcaggttatgggggagatagagcctgagaagagaggtgcttccttcctgtgagaccagaggaaatgactcctgaattcagatggagagaggaagatggaccaactctttgacccttttctaagtgcatgtattgtgcccaatatctggctcattgctcaggaccgctccccatggcctctcactgctgcatactcaaagagccagcaaactgtttgcagaatgtctacacttttttctgatggccaagtcgtcttacagaggcaggggctccagaaatctagaggaggttgcaaaaaaattagctgtatggacagtggatacactgggaatgttggcttggccccatggcctcccaggatctattgcacttgacatagaatagagggggctttttcgtgtgtgtgtgtgtgtgtgtgtgtgtgtgtgtgtgtgtatttttcttttcccctgtatttgtgggtgttaatatgaaccatccagccaggtctgtgacggctgagaagttggtcagggtgtggtttttaaatacattttcctttaggttttctttcaactatcttcaagtttcttgttatgatgcatttataggttccagagacctgaatgttatagccctcagttgtcattatagtcctcataaaaaagttgaagatttgtatacattctctactccaaaagcctctgcagtggtgagcatagctagctgccttccaaaaagtttctacaaaggcattttcctgtttttctcagcctttaaccctatctaaaggagacattctttggggtaactggtttagtttaagtttctcatttccctgcagcactactgtttctgtaggtggtttggcaaccattggcacagggtcttttgaatttccaaatcggtgactcctgccatttcaagaaaatctgtctgaaatgacaaaggacctcctttgtcctttgaggaagagacaaaatgactggagaaacaaaggcagaggaatctgttagtgtatttattcattgtttacaaattagaacaagcatcggaatattcaagattcctgatttcaggagtcctttttgaaatttttttgaggcagggtcttgctctgccacccaggctggagtgcagtgtgccatcttggctcactgcaacctcagactccccgggcttgagtgatccacttgcctcagcctcccgaagtgctgggattataggcgtgagccaccacgcctggccgatttcaggagtcttaattgcctctactatcactttttttcccctgcctaattatatagatcttttgcctctttattgttgaagactaattttttaaaacaggcaactcagcagttactgtaatatttatttctactgggcttttcaagtgttcttatatttcttccttgaattaatttacaaggagacttaattcaccttactggtctgtattagccgtagtttcatattaacatcttgtttttttaggtttgactatcttagtaggctttttctttctttcctgtcctctgtaaatgattaattaaaagtctttttgttttgggcattctataaatgctcttttagtacagttttctcccttaagtggtgtcattcctctccacagtctctgcccatagaatggctttcctcaagtcctatgtggcagatgacatcaagggtgaggggaaggagagtctggttgggccctggctgtgagcagcaaatgagcatgtcattgggccttggggcaaaggccttcaatgctctgtacgtgagaggagcataaactgttggacccggggtaagtgagtagccgacttagaacctttctagagaaatagctgagaaagcctgaaagaggcttaaatgacaagacatggaggaagagcctccttgccaggaattggagaatctagttcagggaaactttgtccatagaaccctgagaatggtgtatggggtatgagggaaaaatagttttagcctgatactgggtgcggagagggatactctgtgggattcagacccaaaggagctttctttagttattttggagaagtgattctcagccagggcaattttggcaccttccccatccccttctcaccccaggacattggcaatgtccagagatgtttttggttgtcatacttagtggggtgctactggcatctagtgaatagagaccagggatgctataaatttcatacagcatacaaaggcagcctcccatgaccaagaattatctgactaaaaatgtcagtaggcggaggttgagaaattctcctttagagagtcttgaggaattttcatcaggaatggaattcaagttaggaagtaaaactagaggaggctgtaaaaggctcaggtcttgttatatgtgttaacctgtcctaggccaatgtgaagtaaaattataactaggactggatttgtgtagttccctctgtggtatggtttgtattttctgatgatgacaaattatagtaaagaagctttgacattcccagctatgggtgtgccaccgtgcagaggacacaggtgaaggatgctcacctgtgagaagggcagggcctgctggggtcttggactttcaggggcaaacctccattctctgggtggcagcagcatgggaaattttcctgtggtagctgagaaactgtgagggccacctgaggcttccctggaccattcatgcctgtgatggggtgtgtttaagggagaaagagaatccttcagattctcttcttcatagagttcccaaaatggaaacttttgtatttggtgaccccttctgacttgtcatgcagctaattcgaataccttaaaacaagaatttctcattgtagaatccttgacccctgggctgtggactttgaggtgcaaagtatgcagacaaagacagacaaagtgtggtctgtctctgtgcttgaggtagatttttatattggaacacttacattaggtagatgttatttaaaaggtgcaatggctcattgcagccttgttaacactggtgcccctcactcttccaggaggagaaaagctcttttttcatttgctgctgagcaccagagccagtccctgattgggggcttgagcttgcttcctgtcatcagttacagaatattagatagtgtgcaactttggggcttggctgtggggaatgtaagtgactcagtagcatggatgctggtactgagtcacttacaattatggtacagtatgaagtagtttataattatttagtggttaggtgtgtggctctgacaccaggttgaattctggctccaggatttcctgctgtgtgaccttgggccagttaacctatctgtgcctcagtttgtccatttgtgaaatgagaataattccatcagatagttgtaaggattaaataattgtagaacactttgaatggtacctggtatatacagagtactaaatcatattacgtaaaatggtgtggtgcagagtataagtgctggaggaattcagaaatggagaaggtaagttgagggatgtgtggtcaggagaggctttcttggtggggcttgaaatgggttgaagatttgagtcaggctctaagagaacaatagtagatggtgttccagacaaggggacaatgtgcataaggacgcagaagaaattgttatgtcctagactctgtaaggaaactgactagggtaatgggaaactagattgagtatgtgattttggggatgggaggtgagggatattgataaatgggcactaaagattagtttttatacaggggcaccagatgctcatttgggccactagggatttctgagctgtgaaatgaccaaaggaacttgaagttcaagcagatgagtcaagtgtggattttcagggtgggctgaagtgaggagctgtggcacgggtcggaaagccagccaggaagccgttctgatagttcacctcattggagctggactaagtgacagccttgggcataaagaggcaggtgtaagtcttggtattgttttgaaacagtactgtaatgtacaggatttgatgactgatggaggtgcaagggagacaagtgcaaggtgacctgagcctctaatcctgcctgaatggctgtgtaaaaaactggtcagagggaggagagtgggcaggaggagctggttaagggaaggtttagtgtaaacaggagagcagttcctcacccaccccttacaaccaagaggagcccattttccaaactgagatggcttcttttgggctgcagtttgaatccaggagcagtaggcaaggctggcattttccccattcattcacagggtatccagctccacctggtccacttgatgcagaccccacatgcggtactggcttcttagtggctactattcaaccttactgccagctccctctgatcctcttgagccaaaggcttttcagagtgtccagtgggacttgggcttcaaacctgttttcccttcataaggaagcctgtaaatcttgatggagattgggaatattgtcttcccatctctgtatgcatgaaccacagacttctgctatttccaatctctgcgtagccctcctgcttagaagacacagcacagtggaagaagagagcagccttttacagccccaggcctcacaggatcctctgaaaagactcggagcttcatgctcagaatcaccctgtcaggagcactctgtcacggaaggctgtaattttaggataagaaagagccctggtttcccccaggccaaggctttatcccaaactcccaagtaaaagcattatcacagcagggtggattgagttaaggaccttatccatgtttgctttgtctcaattatttttagaggagtctttttttttttctcttttttgctcactgctttgtgtcccacactgttctaatactttccatttaatctctgattttcacaacccacccctattaggagggtagagtgttactctgttttgcagatgaggaaattgaggcacagcacagttaagtttgcctggagttgcacatctggttattggcgtggctgggatttgaatcctggcaggggattctggggtgtctgctcactcactgtgtttcaccatctcccttcagttagccagagctgccattttcaaggtggcattttctttttcctcttttgagttctaatgaagaagttgttttaggaaagtcacatggtaacataagagggagcaggtgcttttttgagtcccatgggcctggtttgaacactggctgtgcccacttatactagctatgcacctttgggcaagtctgttcacctctttaagcctcagtttcttagaaatctcagaaatctgtttactaaagatattatggaaaagtgagcaggtatatgtttagtggctgtgaggtttggggttagttatttaaccttttctataaggtgaagatgctaatgcataccttcataaaggctttactataaagcacttcgaatgagatctggaatggagtaagtaaggaatgagtactgttggtactagcaggctttcaatactttttttgtatgtggtggtagtaatggtttcatttggtcctttttggttacattttatgtacttttgactcttataagcaaaagtaccttgcatggtaggagttgataagattataatagacgaatgaataaatgtattccacccatgtttgatttccctgtttagcagtatctgcctggaaaagctcccatcattctcgatcatatttgcagatatgctagatggggaacttggcttgctttccattcacctgtgccgttcacgtgtctctagtttggcatacagatatctattctagtggtgcagttttgtttttcatcaatgtcatttggaatacttagcaatctgccactttgcttagattttttggttcttatttctttatccttttgaaatactctacctttttattgtaaagaccatcctgattaaccatgacttttaaattatgaagattcataatcacactgctaaaaagtgccttttccattaggtctttcctttctttccttctctttctttctttctcttcctccccttctccttcccctccccctcccccttccccttttccttcctccttctctctctctctttctctttctttctttctctctttctttctctttctctctctttctgtctctttctctgtgtgtttgttttgctttgttgcttcctatccttcattgcttaggccttactttctatcctacttatttcccctatagtcctggcttattctccacattcctgctctatgacatctgaaattcatgaatgggatttttctttttagttatctttcatcgatagctgttacctttcccccttggattccagaagatcgttttactaaataaaaggttttggtcttcatcctgttatgccaatgggtagtttccagcacaggaagttggttttcacatctaatgggatcatctcccaatattctgaactctctccaagtctattggaatattcatcatcttgtttttaatattgacctttacacttttttcattaccttactgtggggggacttagaggtggtaggtacatctctcctgggctatgtttggaggctcagcaacataagtagatgaagcacagaaagatggaatgaggaagggaagcttcagcaggaaggaaggtgaacggattgtctatgtggtgctgccagcccaggctgtggagccttagcagaacagggttcagactcggccctgttgcacattccctgtgtgtgtgacctgggcaagctgttttattcttccaaatcccaggttgctttttgtgtaaaaaagggatgttaatgtttaccacatagagttacattagggttgagcgagatgtcctctggtgggctctggtttgtctctcctctttcctttatcttttctctctgttctgcttgtttctggcaaagccattttctctgtttttgtgcagttcctctcatggaaattatttatacttttttaaacttgggaacgttatatctcctaagaagtatcaacttgcctcgtttctgttaccacagccactgatgtagctgaggccccttcctcgcttgtaagctgctcatcagaaatgacacttcttccctgttactttggctgagggaagagttttatgcttatctcacataaagtctttttttttttttttgagaaggagtgtggctcttgttgcccaggctggagcgcaatgcaagatctcagctcactacaacctctgccccctgggttcaagcgattctcccgcctcagcctcctgagtaggtgggattacaggcatgcaccaccatgcctggctaatatttttgtgtttttagtagagacagggtttctccatgttggtcaggctggtcttgaactcccgacctcaggtgatccgcccgcctcagcctcccaaggctgttttcttttttttttttttgagaaagtgtttcactctgtcacccaggctggagtacagtggtgcgatctcagctcactgcaaccttcgcctcccaggctcaagcgattctcctgcctcagcctcctgagtagctggaattataggcactcaccaccacacctggctaatttttgtattttttagtagagatggggtttcactatgttggccaggctgatctcgaactcctgacctcaggtgatccacccaccttgacctcccaaagtgctgggattacaggagtgagccaccgtgcccagcctaaggctgttttcaatattggaccttttatgccttcttagctttgagagttctcagaagcaagttttatttttgcatagaggacccctactctctccccttctgctttttttactctctacaaatggcattacttcatggagccacaatcttaggtggtttttaaatcttcaaaaagctaggagactcaaaatggttagaggagggaaattgctgtactttttcttccaaccagtctagggcaagggaggaagcccaatttgtgtagcactctttccttcatggaggataccccctataatctaggtgcaagtctgggaaaattcatgctcagatgaacacataggttggctcattaaataacacccgtttctgtgaaggacacttgcagagagctaaaaggcaggaaagttggtgagtaagaagtacaaaacagtagattaataaacgtgtgattattcctttcagtattcagaatttaatgagcatatattacagatacaaatctgtatcttaaaatagttgatagcctctagagaagggatggggtggactgttaggtgctgaggccagtggccaatggccagttggatggccttgaggtggttctgacaaattttaaggtacagagattggaggacctggcacaggagtaagcctgacttcagttcgagcctcaaatctgccttggacagagtaatttttctcttttaaccatattggtttttgttttgttttgtttttgttttttgttttgagatggagtctggctctgttgcccaggctggagtacagtggtgtgcgtctcagctcactgcaacctcggcctcccgggttcaagcaattctcctgcctcagcctgccgagtaactcggattacaggcacccaccaccgcccctggctatttatatttttaacagagatagggtttcaccgtgttggccaggctggtcttgaactcctcaggcgatccgcctgaggatctggagtgcagtggtgcgatcttgactcactgcaatctccgcctcccaagttcaagagattctcctgcctcagcctcctgagtagctgggattacaagcgtgcatcaccacacctggctaatttttgtatttttagcagagatgaggtttcaccatgttggccaggctggtcttaaactcctgacctcaagtgatctatccgtctcaacctcccaaagtgctgggattacaggcatgagccaccatgcccagcagttcttcttttttattgccaaataatattccattgtatgagtataccatatgttcatccattcatcagttaatggaaatttatgttgtttccatattttggtttttgtgaatgatgctactttgaacatccatatacaaagttttgtgtagacctatgctttcatttctcttggagtgaattgctgagttatatgttaactctgtttaactttttgaggacctgctatattgtttttcaaagtggctgtatcattttacaatcccaccagaaatgtatgagtgttccaatttctccatatactcactgacatttgttattgtccattttattttatcctagtggatataaagtgatttttgatttgtctttccctcatgactattactattgaacatccttctgtgtgcttattagccatttgtgtatcttctttggaaagatgatttttcaaatcatttggacatctttgaattgggttacttgcctttctgttgttgagttgtatgagtagttcctctttggaagttttatttggcagtctggaattcaaatttatgtccgtgatcattctatcactacttttgtggacgaaatgtctttggcgaaatagattttttttgacacttgctattagtaatggaagcatagaaagattttaaatgcatagaatgatggagaaaaggctgttttgttttgtttttgagatggagtttcgctcttgttgcccaggctggagtgcaatggcgcgatctcgtctcactgcaaccaccgcctcctggattcaagcgattctcctgcctcagcctcccaagtagctgggattacaggcatgggccaccacgcccggctagttttgtatttttagtagagacggggtttctccatgttggtcaggctagttgcaaactcccgaccttaggtgatccgcccgcctcagcctcccaaagggaaaaggctgtttttaaataaatttatacatggaaaaactgtaacagtgttttggaagcaactgcccttccttcaaacagttgacttccttggatagcataccagtgttctagtttcttccaacccttttgttgctttgactgacatcttccaaaagaattgtcagggctaatgcctttgaaaaaatactaacaaattagatggaattaatgcaattaaacattatttttatttgagagtcttgtggctttctttgaatacggcagtcaatagctgatattttagggctgctgttcagaaattgtggacctaaaccaagataccatggtgttaggaggaatgaaatggagacgggagaagaatggaagaaacagccagataactgtgtacgttggagaattaaaagctttgttttttctcttatactccatacaaattaaagcattttccagagaggtgatgtggaaggaagccctcaatttagttccccaggcactttatttttatttatttatttatttatttattttggagacggagtcttgctttgtcacccaggctgaagtgcagtggcccagtctcggctcactgcaagctccacctcccgggttcacgccattctcctgcctcagcctccggagcagctgggactacaggcgcccaccaccatgcccggctaatttttttgtatttttagtagagatggggtttcactgtgttagccaggacggtctctatctcctgaccttgtgatccgcccgcctcggcctcccaaagtgctgggattacaggcgtgagccaccacgcccagccacccccaggtactttataacactaggtgaaattggttttttagtcactgaagtcttttgagcttgccaagagcttggttagctttaaatcattttggcattactctaggaccctgtctggttattatcagttttctcatttgaagttacatatcattcagcggtcatgcttacatccgtttccctggaatctcatgcaagaagaaaaaaatccttgcttcatagtaagtgttggaaagtgggcgtcgtgacaagttggctctgacccagcttcccttgctcttacacatgtgaaacctgtttcttttggctagggccaagaacctgtcgacatctcagctaaaacaatctagtcttattcccctctcttttcacctcccaccccacccccagcctatttttctccttttccttcacattttattttataaggctgttgtgggtcactttttctagttatttcaaacattggattcttcaggtgtcttctttcatttgtttttattttccttcttagaacagtggccatgtgaagccattcatatttactctaatgtaagaaaatcattttgagttttgtctgctggacatgcttaggagatttaactctgttttcattcttctggacagtgataggctggttccctcttgttttttaaagacagtttcttgatgtgtcgcttaggctggagtgcagtggtgtgatcatagttcactggaacctccaacaactgggcttaagccatcctcccaccttagcctcctcagtagctgggactacaggcatgcattgccacacctagctaacttttgaaatttttgtagagacggggtctcgccgtgtttcccaggctggtctcaaactcctgggctcaagcattccttccacctcagcctcccaaagtgctgggattacaggcgtgagccacttggcctggctggtttacattttttaatgcccgtcttcagagtcaaaactgggattgccctggtgttagtttgcattaaaaattgctgatatgagatttatgcagagctgggacttgctgatattgttggactttgtcatctgtacttgaaatatgagaaagggaactgcttaaaatatctgggctccctttccggtagctttagttgtttcccatctttaaaccaaatgctgaaggcataacataaattaatgtattgctaaaggccgagtggataaaatacacaacagctttataatattaaaagcttcattggtacttaacgtgttcagctgccagctgcataaggagaaccttgaaagaaagagggtacaaattacttatttaaaatactttctcctggtgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatactttctcctggtgaagtggtggtgagattagcatgtccctagttgctggtaagggaatttcaggaacttgttttagagtgcagagaaccccctgatctgtagtgtgcattgaaagagtacacattatgccaaccagctcttaccttcaatggagaaattcaggccagggcagcagcagaagtagaaagacctccactgtcactgaggtagagactctgaagggcgcgagattctgattgtgcctgtcctcacagtggagggaggcctttggagggccttttttgcctttgtagcaggcgggaacactcaggtctgtgactgtcaagcggaagctggtgaaggtcctccaactgtagatggctcaggatatagtactgaggtcattatctttagattttctatattccttccaggctgagggaaacatgtccagtcttctttcaacagttcatttgcttccattgccaggccttttatgagaatgttctagtgcttagaatatgtttccttccttaatggtcaaagtgctaccatatttttaaacacaccctgggtttctaattcctacaagaaggctctaatacatgataatggcggtgatagctcccaaggatattcggtttcctcacttttcattcactccatctccaacatgtacaggatgaatggcccctttgctgataattcatgtgaaatatattccccgtgacacctagatgagcaaatttattgggagctaaaattctataagaaactacttttatttcaaaaataaagcttaaaactgatatgtagcttcatctattcagcaaacatttgatccggtatctactatgctggatacctagcagatacaaagatgaatctcatgtaggtggaccttgatctcaagaggcttagagtctagaaagatacatacatgttacatacatacatatacattcctatacatacatacatattacatcctttttactctattaaacaggtaaaatgcaaggggaattcagaggagagaagatagtcattttggatgtgtagtgctgaaaggcagactgacattatggctttgggctctggagtcagaatgcttggattctggtggggcgcagtggcacagccctgtaatcccagcactttgggaggtaggggcaggcggatcacttgaactcaggagtttgagaccagcctgtgcaacattgcgagacctcatcttaaaaaaatatatatatatatatttttttaaaaagaatggctggattcaaatcctgttttagaatttattatcttagggcccttgtatgattattttacttctctaagactgtttcctcatctggtaaatggagataataagtacctatttcacagggtaattgtgaggcttaaacaatgtaatgtaggtaaggcccttactgtggaaggaagatcagacatgctattgtggaggctgcggcctttgaaggaggaggagaattgaggcatgggacagtggggagaaaggtgaggaaggcagaagaaactgtgctggtttagagaatggctaaattttgctgaatcaatggggtataaaggagagataaagatagtaagatcagaaaaaagaagttgtggctggttcacacaaggcatgaaatccttcattgggttgttttgacctcatctcaagattgaaggatgccaccgaaggttttagagtgggcaagtaataatcagactctggcattaggagaattaatctacagtgtctatagtgggaaaacttattaggacaaaatcagttacacctcatagcctttactgctccctaacttggtctgatttatatcatggacactttcttttgtcattgaatttcctagcatatgattttaaatgatgcttccacagcttctcccaccctaccccacacctccctctgtagtgacctctcttccacttagggcacctattgacctgttcttttctccttccttccatctaagctgggaaaggtctgatatgtcatttattcataattaaataaaatgcagccaaagcaaatacattacctctcatccattttaaagcacattataagccatttatttttaattgcagtttaaaaagcttttctttataagaatttcaggcatcaagcaaattgggaacaatccttttatgcctattcaactggccctaaaaaatcaatcttatttaggcttttttggaataagagagcaggaggagtctccaatatcctcctcaaagacagctgtcctctcctttgaggaatggagtgaaattgctctgtagaaaaggctgtgtcattgcccctgccctggcacaaatcagtctgttccttatgtacatacacttctgcccctcagtggataaatgtgtgtgtgtgtcacgtgccactagtggccatggctctgtgccatgcacataaccgaacacactcattcttccatccctcccccaagaagcctattttggtcaaatttgaacttttactttttacttaagttttatttgttttctgattctgggatacccagaaatggtccccacgttgcttttgtttgtttgtcttctcctctctgagtttgaaagagtcttataaaacaagtatttctgggccgggcatggtggctcacgcctgtaatcccagcactttgggaggccaaggcaggtggatcatgaagtcaggagttcaagaccagcctggccaacatggtgaaaccccatctctacaaaaactacaaaaatttgccgggcgtggtggcgcacgcctgtaatcccacctacgcggacggctgaggcaggagaattgcttgaacccgggaggtggaggttacagtgagctgagatctcgccactgtgctccagcctgggcgacagagcgagactccatcttggaaaaacaaacaaacaaaaccaagtatttctttgaaactcatctcataagtagttgcaaaattggagtattacttgactgtcctaataattatgaattttctaaaaatatttgattttagattacttaaggcttagagcactgattttaggttcttttggaggtagcatttaaggagtataagggagccaattaaagaataccttctttattgtctctgttctaggagcccttccctacagggccaggccctttacctcacaggttggagcagatcagaatgcacacctcctgtggacagggcaatggaacccctccagcagcctcactggagtgatttcacaagtcttctcaataaatttacttaatttgatcctgtgtatttcatcaggtttgtggagtttgcctgcagatcttgttgattcagtgggcatcttagttgtggtatgcattcagtaaatatttttattgtgaacaagtgcagtttgttttagcaatattataatatacactatggtgaagtaattagttgccttctgctatttgctttcaagtaatcggaaataagaagtatttggggccaggcacagtggcttatgcctgtaatcccagcactttggaaggctgaggtggttggattgcttgagcccaggagttccaggttacaatgagctatgatcgtgccactgcactccagcctagatgacagagtgagatcctgtctctttcaaaaaaaaaaagaaaaggtttggggatatgctaaggagacttaatgcttttcatttacagcattcccttggtatttgttaatggctgttctgcttagaaatagctgcagagtagatgatggtgcaaaaaatcagccatagtggcttgaagatttcaggaatattttctacttctgtggctttttcacatcctgttcatctaagaaatatggttgctgctcccagccattgtgggcagtggctttgggggaagcgctatagtgtgagcacaatgaattttggtcatcttggtcctggttagatggcctataatgctctcatttccagagttggtttctcagagactgttcacttgtctttcaggccaagaatagttacaagataagcagtggatttaaaaacagagtgtattttgcactgtctgatgagtacattgtgtctccgaagttgagattccacatagtgagccttggaaaacaactgctggtaaattcggaagataaagaaaagattaattatacactccttatcttgcggagcactttgtgttgactgatgtagttcactgacccgaagatggaaccaggaaacctggaatgtgatgttttacattgtttctgttgaaaaatgtacttaaccaatgtgcagagtgttcagggcaatatacttggaatgacctttgtccttgaggcacttgtgggaatctgcttgtgacacacctaacaaggatgagaatttggaggaaaaacagaaatgagagatgatttaattttcatcagtccatatactggagaaatattttttctaatgattcttagatatcttttctatatgttggatataaaattaagtgaaccaagattagtagtgctattgagtctaacttttctaagacaaaagtattatttaaaaattattaaaatattggctcacacttataatcccagcactttgggaggccaaggcaggcggatcacaaggtcaggagttcgagaccagcctagccaacatgatgaaaccccgtctctactaaaatacaaaaattagctgggcgtggtggcgggtgcctgtaatcccagctacttgggaggctgaggcgggagaatcgcttgaactcagcaggcggaggttgcagtgagctgagatcatgccattgcactccatcctgggcaacgaggatgaaactctgtgtcaaaaaaaaaaaaaattaaaataatatatcctcatgataaaaaagtcaaacaatggcaacatctatagtatttctacctctaaaaaaaattttttttttgagatggagtcttgctctgtcacccaggctggagtgcagtggtgccatcttggctcactgcaactccacctcccgggttcaagtgattctcctgcctcagcctcctgagtaggtgggatcacaggcgtgtgccaccacgcccggctaatttttgtatttttagtagagacagggtttcaccatgttggtcgggctggtcttgaactcctgaccttgtgatcggcctgccttggcctcccaaagtgttgggattacaggtgtgagccaccgcgccagcctaacaattttatgtatttatttttagatttttttccatgcttatacaaatatattccatttttattttgatgatgttacataatccacaacttggctttttccgttttttttcctctgctgtgtctctaacgcttaatatattattattattttttatttttttatagagataggatttagctatgttgcctaggctggtcttgaactcctaggctcaagcaatcctcccacctcggcctcacaaagtattgggattacaggcatgagccactgtgcccgcccaaactgaatacattttgacattaattgagtttttataatgaattaatgttgaatcagcaatttttaaaaaatctaatgaacatatagcttctcttctttattctgttaatgggaacattggattctctgatgctcaacactcctgacattccttggggataactttcgtcattccttaaaattgacagccgttcattctttaaagacatttcagggatgtcacaaagcagcagaatatatgtatgacctgggctaggaaacctgagagggacatggtctaacttgtgctgggaatgtgactgacaatgtacgatgtactgttcagagccagaggaaatgatactgagatccagcacctctaggagctgttctctatgtagttgttgttattagaggtgatgctattaattagaggttaataatatcattagcctacaaagtattagattcgaagtaacattgtcctagttgtaatcttgaggattatgcatactgaggggtttgaaatgctttgactgtcttcagttttgggggtttattatgtttcatttgctttcatagttttttgaggatagcttaataatcggatgaagtttctcatacgattccccaattaaactacttgtttcttttgagcgctaggccaaaccttggccatctcttctttctttcgaggaagtgaacattttctctactttaccaactctctctagaacaactggtgaacttggcagtgtatgacagaggaattggagatttgctgtgaacagccatcacaagtagccagagcttcagtactcacttgagtttaaggtctagatttgaggttagtagcttaaatgatgtgacttactggcttctaggagctaagatggagttccagtgtttacgtttcatactccaaatctgaagagtgagtgaggtggtggatgatcactaacagtttctttgagctctgtgagattttgattttgtatgaatgcacccacttctctcagactggtcccttaattgagaactgaggtcttgcagatagggagtgtaaagttaggatcttgatttgtatgtaaattgggctgaccttgttgattcatgtcttttttcatcctgatactgatttttttttttcctcctgtgtttgggattgtgcattgtacactttcttctgtcattggtatttactcttagggagtgtgggattttttaaatagacttggtttttttagagttgtatttgttgatgttgtttcttttcttttccccctcccctccccatccttcttttcttttcttttttctcttttcttttccctttcctttccttttctttcccttccctttccttccctttccccttcccttccccctccttttcctttcccctttcccctttccttttccttttccttttcctttccttttctttctctccctctgttggccaggctggagtgtagtagtacagtcaaagctcactataacctttaactcctgggctcagggcctactcccacctcggcctcccaagtagctaggaatacaggtgtgcatcaccatgctcaggtagttttgatatgcggtcttgctcctttgcccaggctggtcttgaactcttgggctgaagtgatcattctgccttggcctcccaaagtgctgggattacaggtgtgaaccactgcatccggcctacagcagttttaggtttatagaaaaattgctcaaaaagtacagagagttcccatatacttcttctctctcccactcacacagtttcccctattattattaacaccttgcctgtgtgatactaacatctttaatgtgtggtacatttgttataattgatgagccaatattgatacgttattaactaacgttcattagggctcactctgtgtgttatatagttctatggattttgacaaatgcctcatgtcatatatctaccattatagtattaaatatcatacaaaataatttcactgcccaaagaatgccctgtgctccatctattcacctgtcttccctccccgttgaacccatggcaggcactgatcttcttaccatctctatagttttgcttttactgaaatatctagttggaatcatacagtatggagcctttccatcctggcttctttcacctaacaatatgcatttaagatttctcgaagtctttttatagctttgatactttatttctttttattcctggataataagcccattgtatgaaggacatcttggtcgcttccaagttttggcagttatgaatagagctgctataaacatttgtgtgcaagttttggtgcagacataagctcatttgggtaaatacccaggagcatgattactgaatcatatggtaagcgtatatttagctttgtaagaaactgccaaactgtcttttaaagtagacatataggctgggcgtggtggctcacgcctgtaatcccagcactttgggaggccaaggcgggcagatcatgaggtcaggagatcgagaccatcctggctaacacggtgaaaacccagtctctactaaaaatacaaaaacaaagttagccgggcatggtggtgggtgcctgtagtcccagctactcaggaggccgaggcaggagaatggcgtaaacctgggaggcggagcttgcagtgagctgagatcatgctactgcactccagcctgggcaacagcgagatgccatctcaaaaaaaaaaaagtggacatattattttgtactcccacccagcaatgaatgagagttcctgttgctccatatcctcactgtcatttggtgttatgttttggattttagccattcaaatagatatttagtggtgtcttattgtagttttaacttgcatttccctaagtgacatttgaattcgatattgagtgagtgtcttttcatatgcttatttgccacctgtacatcttctttggtgaggtgtctgttcagatcttttaaattaggttgttttcttattgttgaattttatgagttcttggtatacagtttttactcagtatccgtgggggactggttccaggactctcctgcatataccaaaatctgtgcatacccaagtttctcagtcagccccacagaatctgcacatatgaaatggtggccctctgaatatgcaggttttccatctgcaaatacggtttcgttgaaaaaaatctgcatgaaagtgaatccatacagctcaaatctgtgttgttcaagggtcagctgtattttggatatatatcctttatcagaaatgattttacaaagattttctcccagtctgtggcttgtcttttcattctcttaactgtttttcacagagcagaagtttttaattttagtaagtccagcttatcagtgttttcatggatcatgaaagtcggtgttgtacctaaatagtcatcatcaatctcaagttcacctaggttttctcctgtattatcttctagaagttttataattttgcattttacattaagatctatgatctattttattttattttattatttgaaatagggtcttactctgtcacccaggctggaatgcagtggggagaacacagcttactgcagccttgacctcccaggctcaagtgattcttctgcctcagcctcccgagtagctgggactacaggcatgcaccaccacacctggctaatttttaaaaatattttgtagaaatggagtctcccactgttgcccaggctggtctcaaactcctgggctcaagcagtcttcttgccttggctgcccacagtgctgggattacaggtgtgagccaccgcacctgaccttgatttattttaagtgaatttttatgaaaggtataaggtctgtgtctagattcactttttttgcatgtgatttccagttgttccagtaccagttgttgcaaagaccatcttatctccactgaattggcctttgctcctttgtcaaagatcagttgactatatttgtgtgggttgctttctgggctctctattctgttccactaatttatttgttcacccatcacacactgtcttcatcactatagctttatactggcatacctcatcttttattgtgcattgtagacactgagtttatttttacaaagtgaaagttgtggcaactgtgcactgattattaattattgatttaatttctttaatagatatagacctattcagataatctgttcttccttggatgaaatttggtgggattggctttcaatgattggttcatttcatagaggttgtcaaatttatgagcatatatttggctataatatttcttcattatccttttaatatctatgggatctgtagtgatggcttctctttttctttttgatattagtaatttgtgtcttctctctgtctcctcctctctttatttttatttttatttatttttttttttttttgagacagagtctcactctgtcccccaggctggagtgcagtggcatgatttcggctcactgtaacctccacctcccaggttcaagcagttctcctgcctcagcctcctgagtagctgggactacaggcgtgtgccaccacgcccagctaatttttatgtttttagtagagatggggtttcactgtgttggctggggtggtcttgaactcctgacctcagattatccacctgccttggactcccaaagtgctggaattacaggcatgagccaccgtgcccggcctctctctctttttacaaaattttggggctgggcacagtggcttatgcctgtaatcccagcactttgggaggccgaggcgggcagatcacttgaggttaggagttcaagaccagcccggccaatatggtgaaaccctgtctctactaaaaatataaatattagtcgggcatggtggtgtgtgcctttagtcccagctactcgggaggctgaggtgggagaattgcttgaacccaggaggcggagattgcagtgagccgagattgtgctactgcactccatcctgggtgacagagcaaaactctgtcttgaaaaaaaaaaaagggggggttaatctggctagatgtttatcaatttcattgattttttaaagagaaccaacttggaagtggggttttcgttcatgttatagtttataaccataatgtcttggttttgagtcagtccctaaattttcaccagtaattgctgtacctgcatatgcacaaaggtgtaagtattaggagctaatacagaaatatcaatacaactttttagagtccatagactttctaaggctttcattttcaacagaatagttttatgaaccaacagttagttaaatctagcagaccgtcaattgaggtaggtggtgaataggaaagactagtatagatttagcagtcaggcagaaagtgtttgcatgctggcttctcatgctaactctgtgtgcttgcacaagtgacttcacctttctgagcatgttaaagtttgtaaaatgcaaattcttattttactatttggtatgaaaagtagagttaatgtaaaatattaggtgtctagtatgatacttaatatgatacttaatacgtagtatagtagactctttttttttttttttttttttgagatggagtctcgctctgtcatccaggctggagtgcagtggcgtgatctcagctcactacaacctctgcctcccaggttcaggtgattctcctgtctcagcctttcgagtagcttgggactacaggcgcccgccaccatgcctgactaatttatgaatttttagtagagatggggttttactatgttgggcaggctggtctcgaactcctgacctcaagtgatctgcctgtcttggccttccaaagtgctggaattacagacgtgagccaccatgcccagcctatacatagtagactctctgttgcgtctcttgtgcttctgaaatagaatatctattagactcattaaagaatctctgaattttttcatccaccaggccattaggaggtgataggactttcctcttgttctgtgatatatgaagctgtatttcttcccatatagaattttgactgttgcaaatggctgcctcttgtaaatttaaaatctggaaaacaaaaagctgtttatgggaaagccctctgattctagaactggttgcctttatgccctcagggtcaagtctcgtactcctcagttgggagatgttacacatagcatcacattgccttttagccaggtgtttttctaggttcttagtcatctcaagtgagtacttatttttagaactactctaaggacagggtattgggtgccttttgagaaaactagaaaaagaatttggcaaatatagcaaatttgggaggttgattaaatacagatctcagtagaggtcctgagacaggctctgggattaaactaaatttaaacatattacaattagagagacaaagaaagtgagaaaaacctggacttagttaaaatcgaagtttgtttgttttttttactttaagttctagggtacatgtgcacaacatgcaggtttgttatatatgtatacatgtgccatgttggtttgctgcacccattaactcatcatttaggtgttttttttttttttaatgttccaaagtaatgtgctttgttcagccattttcagtaatagaagttgcaactaagtggctacagtgcttattactaaattatgtagaaacaaccatttaaaaattagtttaagcagaaaagctttaaggcagcaaaatttgatctgtataacctgtaagtatatattttcagaaataaaatgtttccttcaaggactgaatataacttttagaaaagaaataatctgcttggggaagccactttggctacatagaactaaagcagagaggaggtggccagtaaaaggattctgagaagagggtagctcctcatatcctggctctcttgattcaaagtaaataatggcatttgagtaagaagtctttgccatgaactaagtgccaggcaggtctgagtttagccccagttgaggggttacttgctgttcatcagtcccctcaaagtgctctagcttcctttgcaaaaaccctgtaaacataacctcacccccattcctttcatctaacctcaagcgtaccaaaaaccattcctcacacccagatttagagacttacccaataggaaaatgattctgagctgtgaaaagtaaacaaaacaattgttttgtttatctgtccactggactgaatgttcacggatcttggtaggtcacttcataaagagaagtaagggaagaaaggcagggaagatgatcagagaagagctgaggacaagtgtcatccgaggaagtcaagaggattcatcccgggcatggtgtagtgataagaacatttcactgggagacaggaggccttggttccaatctggctcagccatttactgtcctttctcctgactgtgtctgtttcctcatccgtaaaggttttggacaagatggttttaggcatggggttagtgagatgaataagacaaggatgtttctgataaaggaaacaagcttgttgtaaacaaagaaaatgtagtattgtaaatgctttaagtaggagtctataaagaagagctgtggatatagttaactcagtggggctttgaagaatgcttgagatttcacaaagattaagatgggggaaagcagagagaacagcctgtaccaagagatggatggtgcatagctgacacccaaggtatgtataagagtagggagggtgatggagccagaagggtacctggggttagatgtggaggtccttactgcatgtcaggctaagaagtttttcccattggtaagagagagctctgaagctcttaagtagaaggaaaacctgattagttagcatttaaaaagtaggatagtgacagcatcatagagaatgttttttggtttttctccatggaggaagagacttgaggcagtcaagctcattttggaggttatttcaagagtaaggcagtgactttggaaataggaagggacaaatttatgagctgttctaggatataaaataaatatctgggatttagtgaccctcaaattgactcattgacttcccctaacctcagccatggctgggttaggtaggagtacataactgttaggtacaattcgtacaatgtcttctaaagtccactcgcctttgaaatcactgagccatttggttccttcccctggggatgggtactgaagttgtgtgagcaagcttgttcttagcctctttaattgaagagctccattcagaagcagtggggagtaattgatgttcatcctctagaggctgaaaaaatcaaggaccacaggaagctttttataaaggaggccaaacccagaaataaattttctccagaactccttcttaaaaggattcttaaatctcataaccagaacgctttctctctctggactagatctggcttcacttttaaaaagtgtttgtgtgtatgttgttaaagaaaaaattacttctgacacttcttaaaatggttcagtccttgaatccaggagcttgaggttacagtgagctatgattatgctactgcaccctaacgtgggtgacagtgagaccctgtctcttaaaacaaacaaaaaaggtaaggaagaggtttttcttttctctcttttttttttttttttttttttgggacggagtcttgctctgtcgcccaggctggagtacagtggcgcgatcttggcttactggaacctccgtctccctggttcaagtgattctcctgcctcagcctccctcaggtagctgggattacgggcacccgccaccacgcccagctaatttttgtatttttagtagagacggggtttcaccatgttggccgggctggtcttgaactcctgacctcaggtgatctgcccacctcagtctcccaaagtgttgggattacaggtgtgagccaccgcgcccggccaggaagacgtttttcaagactattacaataagagagagagagatccggcttaactccaaatatgacaagggcaagtggggattgatagccaaggagcaaggtgaaggggtcagtgggtagaaagcgacttaaaggaaacatcaaggctagggggattctggctaaactgacctgacaggattcttgctgaaggcaggccaaagacttagacatcaacagtggaggatgaggaacttgatcagatagcaaggatgggggtgggtggtgggtgaggctggttgtggggactcaaacttacttagcaggattcttgctaaaaccgggctgggcaggtgaaagatagaaggtgaggtggcatggaggcaaggtcaggccctagagggctttgaggagcctgactgaagtttggtcaagcagagtctttgccagtgtgtgttttattacaaaagtaatatatgcctcacctccagaactaatttgtcttcaaagcttggtatgtagccttccatatgtttgtataagcttagaaaaatactctgttcctacagaaatgagatcatactgtacttactgttatgcagctgcattttccacgtcgtagatcttcattgtgtttcatgtcagcacactagacactggtctcagtctttagaatgccttgcctcgttttatagattatttacgaaaattgtaaactggaagtaattcatattttatattttaaattatttatgttcattactttaaattatattataaattatatttatattttaaattccagtttataacttttttacatacattatcccatttgttgcataaaatgatcctctaggggtggggatagggcaggtaatatgtccattttacatagaggttacatgatttattagactttgcagctaatatgtgtcaagtccaggattcacacgtgtcagttgcatgtgtgaaaacaattttagatctttgacattcagcttacatataaaccacatgtggaatactgtttttgtctgtggtgctttgggacttttaggaaatatatgtggtgtatataggacctagactctgataataaatttcatttgagacatttatcccttttaagtgtattattaatttctgtattgaaaattcttgtcattttaatgtccccaaaatgacaaaataatcatcttaaataataagattaaatgaattcagtcagtttgtagcaatactttcaatacttaccttaagtaacagactttgtcagctaattggatttctggaaatgttaatggaagtctctcagttaactacctctactcatgtccctctgggactcatttcctccctagaacatcacgcctctctttctcagtattctttattggtttcctgggaccctggagggaaagaaaaggcaagacaggatgaatgaggagtggggaatgtgaggcggggcggaaatgaaagaatatgagctgtggagaattcaccttattcaggaatgagaaaaacagcaaggaaaaaagccatttctcaggaagctatatggcatggtggtgaagattttgagttaaacccaatgtcaccctttctagctctgcgaccctgggtaagttatttccgtccatgcttgtcaatttcctagggtttccttacagagttcttatgagaaggaaatagtgggttatctaatccacttaaagtatacttggcccatagtaaacatttaatcgatgttagctgttatttctaagctttttagatgcaaagttccaagaaaggagtctgaaagtctggatccagtaaaatgaccatataatgtattgttcaggccaggatgctgttaataattgtgggacaacaaatataagccagtatttgtgatttccctaatgggggaggcatctgtgcccccaaaactctgactgattaaggcaactttccttcctaccacagcctaattaagctaagcctctggactttgacaagccagggagcaaatcattcttaaaaactctttgacagatagacaaatacacactcactcactcactaaatcacaaaagaaactttgctttttctttctaggtaacatgtcttaaagtgatatgagtctgtacaaattttactaaatatttgtgcagtattgtttacccaataaataacttcgaagaatatatttaagttctttttttttttttttccaagacggaatctcactctgtcgcccaggctggagtgtagtggcaccatctcagcttattgtaacctccacctcccgggttcaagtgattctcctgcctcagcctcctgagtagctgggattacagactcgtaccaccacacccagctaacttttgtatttttagtagagatggggtttctccatgttggccaggctggtctcgaactcctgacctcaggtgatccacccatcccggcctcccaaagtgctgggattacaggcgtgagccaccatggcccagcctaagttcttataagtagtttctgccacttaaaaacaataattttgacacatcttaaatagttaggtctcctcatgcctttaggtgtagatttttcttacctgttgagttctcagtatgtgccatatgcagtgcttaattggtggtgaggatataatggcaaacaaaacatatttgaatctgcccctgagttgcttgtggtccagtgagaaaggcaatcaagtaatgaaaaatgcagagctctaaactgagattgttttaatgaaggcaaagtacaaggagttctacaggaagttcttgaagagcctgacccggcctgggaaggtgaggaagaagttccctgaggagagttttgctcaacactgaatatcaattaaaaaggcaagatgggatgggggtctgggaaagaggcagaaaggagcttggtcttctaggaaagaaggttctgtatgtggaatgcagaaaactgggaaatgtctgttttttaaaaaatcaaccaggctccactgtgatcccacactcttcccactgtttgcaatgcccttgcttccctttttcttgctaatggcattccattcatccatcatcactttacagtataattttttgttttcatgtctctgacatcctttaggacagggacttggtcttatttactcattgtaagatgtttagaatagcacagcaacctttcttcttctttttccctctccccatagtgccaggtacttactgtgtgcttgctacttgggaagggggcacaagacaggcacagtgcctgttgtcatggagcatgcactgtaatgattgttttgctcattgagtaaatacgctgaatgactcacccttagaatcagaattgtggactctggaggccattttcatagagtttcagcagttctgtgccttctttacagttgtgcaacagaaacaatcaatgctcaagggttaagaagccactaataaagtaagttgaattaaataagataaaggccccccaaataatagtgaaggcactggagatataaggcttgttaaaaatataatgtatatgttaatcctcatgaatacatcctaattacagcagagaactcttgtagtgttgtccactttgtggtggtgtgtttctcaggctgtcctgtccgtgttcatattggaatgacaatttcacactgtactcattcatgtgctgttcactatccacctttctgttatggggattgagagggagccggtgtctcacttgcccagtatagcaataacttaaaataataatccttagagcaaatgtacaaggaggtttcaaacaattcgtcattgctcttgggaaacctatggatttgtgcgtgcgtgtgtgtgtgtggtattgtgtgtgtgcattcacattgcggacaagaaacagaaggggttagaacagaatagcaagaagagcaacattggatataactgctatgtttatcctgaagataactgtccttggcaggatagaagaaggaactccttgctggctttgtggaacaaggaggccatccttccaagtttctcgtgtgacttgtgtcacgtgtgcaattaaaatggagtgtcacctttcttgcttgtgtctctcttaagagggagtaaatttttccaagtcactgctttgcagaacatgcttaaacacaaaaccacaaggttcccagaattatagatttcatagttgacaaggtcctgcccacctgtcacgtagcgtcagcatcctttgtgcatcagtcccactggaaggccgtttgtgcacacctgattcccttcctgggaaagcagccatttccagttcttagtgctttcttcttctggtgtttcctccatattactgattgttaggcttatgctgttgtttctttattttaaaattttaaacatcctctattagtcactgttagccttcttacactctctgtccactgcctcccccttcatccttcaagtatatcacagcttttagttacatcagtattaaatgcttatgtttatgttattatgactattagtattatttacctgctgaaccacttacactataattctatttttttcttgtacaattaattaattttcttcctgttgatttttctgagttttcttttttcttttcttttcttttttttttgagacagagtctggctctgtcacccaggctggagtgaggtggcgtgatcttggctcactgtgacctccacctcccaggttcaagtgattctcctgcctcagccccccaagtagctgggattataggtgcccaccaccacacccagctaatttttgtatttttagtagagatggggtttctccatgttggccaggctggtctcgaactcctgacctcaggtgatccgtccacctcagcctcccaaagtgctgggattacaggcgtgagccaccacgcctggccattttctgagttttctatgtccagcttattcttacttcccaaatcacaactataatttttaagtattctttttttacatcctaggcagatacatcagttgatcatgttggtttcgtttccttctgcagatgcccccctggattcccagcattctccagatatggtctctaggcctgctgtgtagctgattcccttcaccccgtttcctggatacccatcttcctctttctcggtttgctcatttgtttggtagagcacatcctccagtcatttcctgataaaagagtgtgtgggaggtaaagtttgagaccctgcatgtctaaaaatatccattctctttttatacttgactgattggaagtcatttcacctcagaattttgaaagcatttctcctttgtcttatggctttcagaggtgctattgaaaattctggtggcgcttaattctttgtatgcaagctgtttttttactctcaaactgtgttctctttatcccatttattataaaatttcacaatgtgacttttaaaaaattcttattcattatactgagcacaggatggactcataagcggaagttcaaggaaaatttcttaaattatttctttgatgatctttttttctctcttctctggaactcttggtcctcgaattttatctttcctatttccaacctctatctttggttccactttctgagaagtttattctactttatcttctggatcattatttatatttttatttatattattatttttaatttccaagaacttttcactgatcctggtttttgttttttgttgtttgctttttttgttttttaatcctgttcttctgtgataataggttttcatttttgaggttttatttggctccttgtctcatatctttgagtcatttttttctgtttttttgggttttttttgtgtgtgctctgtcttttcatgttaaagtcttttcctcaaatgtctggcaatccttggttgtcacttgtattaaagcgtgagacactaaaaagctgattggatgttctgtatagaggtgggaagagattgtcaaggataggctttatattaatattatatagggttatgggataggagcccctcctgttttattgggaaatccccgaaagccatcatctgttgaacttttctgtggtatcatttattttctccaagaaagaatccctcaacttttctgtgtagggatgggagtggagctcccattccagcattatggaagccaagtggattagggggtgctgggatctcatcattcaagatagagactttcattcagggcctctgatttcagtacagttccttcccctaccttctactgttcctaatattcctgcgtctagatccaagctggttcttacagaataaatcaaccctctcctgtgcaggtagaggagtaatagtccctggctgtcctggatgtgacagcagacctggtggtctaacacctctttatacagaatttgtattaagtcccagttttcagcccctccccgtccctggcctcctctgccacctggtgcccctaatccctgagccttcccaagggtgcctctgtgaattggcatcgccttcacaggctgcagagattcacttttttctcagctctactaacttacctactttttatctttcaaaaaggatcaacattttatgttcagttatcttctcctgttccttttgcctttttgtttgtttttactctgtttttaatggggttcaggagagagcagaaataaaagtacatgctcagtttgttaactgaactcttttggcactgttgtggggcttctgtgtctgactgtttcatgtctgtgttttgtcttcccttgaagattacaagcttctctgacagtggggatggtttcatagactccttgtatctctccttttaccctcaactgttaagtatgtagaaagcattttaggaaggatgtgtcaaattcatttgagtaagatgaaatcttttctaaattagactgatttgagagagtgtttccttgtgttggaaaactgccagcctttcctgaggttcagagataaatctcactttgcaacaataaccaaaagaagaaaacattgaaagcctttggcagaaaaaggctgatgagacaaaactcctgtttagacattatgatttaatgaagaattgttggagagctgcctaggacctctcttccccctcaagtttattgctccctctttacagggtctgtgatccagaaggcctttatctgacttgatgctttgagtcgttgacctcctgagaactaatgcaggaggagacccacagagatgcacgctgttttctctaaacattcagtgtcaagggactggagaaactggaaggaacatgcactagagtcagatgtggaattttgtttccgttctcatgtaatcaactatatgacaatcagcaagccatttgaacttcagttttcttacctgtaaaatggaaataccggtatctgttttccttcttgatagtatgcttgtaagagtcaagtatgggtaccatgcatgcaaatgcatgtaaacatttagacattgtcatttcaagttatttggtgtgtaaccatggtacaaacaaggatgggctttatataacataggattatgggttccagaccctcatatcgacctactgaccagacatctacatatgggagtcaaaattcatttcagcctcaacaaattcaaaataaaactccctcccgctcccttctcttctcccctacctcacgtcaccacagtcacaaaacaaagcaaccctggttttcccccagaattctcactactcactgagtagcctgattcaaacagccgccagtgcaccccaacctgcatttgacaaggtcctgtcttttctattgaatctatccttttttctctgtcctctttacactgcatgaaggtgtttacttcatgcctgaattactaacttcacctgggctccctggatctagtcacacacttctcttagtgtatcatttacacacctgctcagcataatgatgaaaaaaaattctgaaatatgtcaggccatcacaacagtatagtgaataacaaatggaccatctgagtacccgcctcccagctgtcaacagaaggatttttctaaaacacccatctgattattccccgcttgaatctcttcagcggcatacaggaccctttctgatttgactctgccggcctgttcaaccttgcattcaccatccttccacttgtatgctccagccactcgtagttacttgcaggtgtcccactttgctgagactactcaggggacagtgaatttggatgttgcctcttcgtttctgcctggctgcttccttctaaactttaaggctcaacttaagtatctcctcttctgtaaaacctctctgttcctatttcccttaagccagtttgtgtacttccttcccagaatgtcacacactgtacagtattgtcatttgtttactggtctgacttcctcactgaactcaagggtggggactgtccagcgctgtggcatcaacattgattggattcaactggattggacacttctggcccattgagatgccattacttgtctgtgtaaagtaagcaataaagtagctgggctaccacatgaatcatgtttactgccagctaaggccacttagggtatcattcagtccagaaatctgacctcacgcacatgaaagtggcctgagcactttggttctaacttatggttcttctgtcgctgtgttttatgtacagacatctcagatgcagtgttcttgtatgtcccatcaagagattgttgccattcttaatggatataaatgtagtaggtttgttatactgcatagagaccatgtcatactggggtaatgttggttcagggttggcaagaatctgatctggtaagagggaatgagcagattgctgaaaactgaatgttagaagttgcaccctggtggccctgggccaattccttacatagtgctctgttcttggaaacatgagggatttccctaaaggacttataatatatggtatgaataagcaggataaataattcactgtggctcaggatcagataggataaatattgtggtgaagatgcagtggatgatctggaatatctgagaagggtgaaattaatagcagccagtgcaatcaggaaagatgtggaggatcaggggacatttgagttgggccactttctgtgcttgacagaataaatatcccatttgtcttgcttttgcgattcttatttgatttcacagagactttaagcaattttacctcaagttttcgcttgagttttgctaggtctgaagagtggtaagtaaatttagctatgagtgttgatggatttttgaaatcagataggaggaaccctgattctctgttaagagacttagtttctgatcacctcagtttagcctttagagcctgtgcctccccttgttttgaaagtgctcccctttccttcaagtgtggactttatgtcctcctccgttttctacccctggcagtgaacactactaggtgttcagcggatgcctgtggaactgaactcacctcgatgtcctttgtgatgtcctctggcatctctgtgggcggagctccctgctactcccctctccagccacaggtcaggcacgctccttcccagggctcctgtgtttgatgctactctgcctgtctacctcagaccccctcacggctctttactttattcagatattctcaaagatcaccttcttagagaggtcttttctgatgaccttatctcaaatatcactcatttcctttttatccccttcctttgctgcctctgcttcctttgctcacttttggcccttatcaccacataggcatcataggatctatttgtttgcttattcgctcactctctccctcctcctagaaatcaagctccatgagggcagactttgtctttttccatctgcatctccagcccctagaaggcgcacttcacgtgtctgctgagtacatgcgtgagtagctccataaacaggacctcatttggctccttcaccaaatagagtgggctgtttctattcatcaaaacctccaaatccagcacagtgcccggcatgtctacacatgcaatcagtttttaaaggaatggagagaggcctttgaggggggattcaaaagccacagggcctcaccagtcatattcttccatgccctccacagtgctttagatgccatcccaaaacataggtgccgccgaggtgcatagggcaaggcttgctgcgcttcagcatcatgtgaaagcaggttagcttttttgacatgctaggcctctcaatactattatacttgctcaaacttctagaagtttccatgaatgatttaagtcctggggagcccatcatggtagactttacaaatgcagagacagtagtgtggaaaatcaagtgaattgtccaaggtcaaaaaatgacaagtggcggaggcgagttttgaagtcagtttggctaaccgcagagcccaagctcctaacttaggttccatagcttcatcacgcaggcttgctgtgactgctccaggacccattaagatcagtctgagcatttgtcttgcaagtcaagggcagctattgcatttctgcacaatctttacaggttaaactttgcttaggaatctcctaggctgtgtttaaggttgttttctctggttcttgatgcattatatgctgcttttgtttgtcggtgagcagccctttggtgcttacagttttagaaaacctaataggacagctgtgatagggaggaagacctagattgtaagtaactcttttcttgagctgccaaaaaggaagaaacttgggtggagggggatgttactaccatcctgtctgaagctgaaataccaaacaaggagattagagttctccagtttcgtttagattttgtttaatgtgttccccagtccccaaaacttctagatgggcttttggaggagaaggtagagaaaaagaaggaaaaaaggcctctggttggaaacgttgctgctttttgcagtgaagtcactatcttttttccttttcttttctaattgttttgagggagttttagtgctgacataggatgtccaaacttaatcacctttaaaccagtcatggaggcaaaagttagaaaacgatgaaaggcttgcttcatcctgcctttttgttaagatcaaaggcagtttaaatcttagtttcagggctccttggggacatgaactgagagggctgagatagttgagttctaatagaactaaattggtagctgataggcccgcactctcagccgctttaaccagccttggtgtttcctctttctcagttcttcttaattattctagtcatcgcgttgctgctgaattatgtccactacatattcacttcatgttgttgttccagttagatcagacagtccttgtttggccaaatgccatgagctccatcaaagagagtttttgatctgccgctgatttcgtgtgtgatttggggcaaataatttgtttttagattcttagtgtcacctgtgctataatgatgatattttctcttgtgtggcaatttgaaaataagtgtgacaatggtacctcacagattttccagatccatgtcacttgccatcaccctgatccattgtcaggcatagtcatatactttttggtttggaaaatgaggtcattgtacaaatgtgttaaagagatttaattgcatttagcttcttgtttagaaagtgctatagaagttcaggcttagtggaggatggggtatcacgatgtccctcaggctcctcaccttgtcttcaccatccttagttggcaatgaacaaatagcctagatatcgaaatacatgtatcttgctttttaaacatttatttttaattgacaaaaactttatatatttgttgtatacattatgatgttttaaaatagctatacattatagagtggctagattgagctaattaacatatatattacctcacatatcatttttatggtgagaacacttaaaaaccaactcttggccaggcgctgtggctcatgcctgtaatcccagcactttgggaggccaaggcaggcaaatcaccaggtcaggagatcaagaccatcctggctaacatggtgaaaccccatctctactaaaaatacaaaaaaaattagccaggcatggtggcatgcgcctgtagtcccagctactcaggaggctgaggcaggagaatcgcttgaacccgggaggcagaggttgcagtgagccgagatcccaccattgcactccagcctgggtgacagagcgagactctgtctcaaaaacaaaacaaaacaaaacaaacaaacaaaaacaccagcgcacttagtgcttttttctttctttccttctttctttttttttttcttttgagatgggatcttgctctgtcgcccaggctggagcacaatggcacgatctcggctcactgcaacctctgcctcccaggttcaagcagttctcctgcctcagcctcccgagtagctgggattacaggcatgtgctaccacacccagctaatttttgtatttttagtagaggcggggtttcgccttgttggccaggctggtctcgaactcctgaccacaggtgatccgcctgcctcagcctcccaaggtactgagattacaggcatgagccaccacacccggctgcgatttttaagattataatacgttgttattaagtataattgccttattgtacagtaaatctcttgaatttatccctcctgactgaaattttgttcctttgaccaacatctccccaacatcaccccctccagctcctggtaaccaccattctatgctctgcttctgtgagttcagcatttttagattccatatgtaagtgaaatcatacagtatttgtctttttgttcctggcttattttattaccataatgtcctctaggttgataaatgttattacaaatgacaggattttccttcctttcctaaggaaagtatgtcattgtttatatataccacatcttctttattcatttgtccattgatggacaggtaggttgattccatatctcagctactgtgagtaatgctgcaatgagcatggaagtgcagatatttcttccatatactgattttattccgtttggatatacccagtagtacaattgctggttcatatggtagttatatttttaattttctgaggaacttcatactgttttctgtaaatggctgtactaatttttgtttttaccaacagtgtgcaaggtgctcttttctctacatccttgctaacacttaccttttgtcttttcggtaatagccattctaataggtgtgaggtgatatatcattttggttttaatttgcatttctctaatgactagtgatgttgagcattttttcatatacctattggccatttgtatgtcttcttttgagaaatgtcttttcagatcttttgcccaatgtttccaatcaggttatttgctttcttgctattgagttgttttgagttctttatatattttggatattaacctcttagcagatgtatggtttgcaaatatttcctcctattccataagtggtctttttactgtgctggcggtttcctttgctgtacagaatcccactttttctacttaaaatttatcttacgattctaaacctaatatctacatgctcattaaagtggcttgtcacccatatacagctgtgttttattaacattttgacttttttgtcttcttttccttgcgcatagatgattccccctttcttttacaatattattattataaaagcactatgtgaatagattctcactgttaagtgttttaaactgtggtagaatacagaacgcaataggaaagtctctcttcatcatctgcagtgctccctaacacagagattttcttccccagaggtgagcacaatcagcatttggtgagtgctcttccagtcaccatccatttgcagcggtgtgtattatacaatgccttctttcgtcgctttcttataacatggtatgtcttgggaaatctttccatgtcaggacttaaaggtccaatttgttttctttcctttgttattactgttgtcgttgatggttacgtagtattgtattttaggagtatacctaatattttactgcttgcctatggatagacattaagtttttagtttttaactcttacaatgaagcagtcctgtaccagcatgtgtctttgtgcacatgtgcaagtatttctgttgggtaattgcctggaagtggaattgctggctcaaagtgaatcctatttttggttttggtcgatggtgccaaattgtcttcccaaaggaatttaccagtttaaactcataccagtggtgtttaagagtgcttgttttcctaatatttagaaacacttgataatatcattatgttcatttttgtcaatgaatgttttaatttgcattcttctagattgtgtctctgtagatctgaccttgtctactttctgccttttagtaattcctcagcattgctgcttacttgatggtgtcttttaaaattttcttggtgtgaatctgtttatctgtctatagctctctatctgtgtagggtgggatatcttttctgtcacttcagggaactttagacaggaggtagagtaaacttgtgcacttaatctactctcctgataaatttcatcctttctgagctatgactttatagtatttacaattttgtttcttttttctccttaacattataatctttttttgtcttattacatagcaatgtaactggtatatgatattctactctgtgtctgtactgtagttataataatttgtctgttgatgcctattgctaaaattttattttattatttatttattttgagatcgagtctcactctgtcacctaggctggagtgtagtggcacgatcttggctcactgcagccttcgcattccaggttcaagcaattctcctgtctcagcctcctgagtagctaggactacaggtgcccgccaccatgcctggctaatttttgtatttttagtagagacgagtttccctatgttggtcaggctggtctcaaacttctgacttcaggtgatccactcgccttggcctcccaaaatgctgggattacaggtgtgagccaccgtacccggccaaaattttataaataatattgtttccaacactaagcataaaggctctgggctcagatggctttactggtgattctttataattttagtgctctgtcattgtcttttttttttttgaaatggagtttctctctgtctctcaggctggagtgcagtggtgtgatcttggctccctgcaatctctgactcctggattcaagcaattcttctgcctcatcctcccgagtagctgggattataggtgcacactaccacacctagctaatttttgtatttttagtagagggtttcaccatgttgagcaggctggtgtcaaacttctggcctcaactgattggcccgcctcagcttcccaaagtgctgggattataagcatgagccatcgcacctggcctgtgtcattgattcttcaatatggaaatgagtagacagctgcccagctgacctgtgactttaacctaacactgataccatccagtaacagtagcacaaaaagcaagaactttaaatcagtctcaattatgaatatagatcctaaataatctactctcaagtagatgctctcaagtagaatttaccaataaggtcataatggaaatggccaattaagtttactccaagaatggcttaatattaagaaacctattgataacatattaggttgtaaaatgtgaaaaactattatctccatagatgcagaaaatatatttaaccaactatttctaataacactttttgggggaaaaaaaataggatacttcctttacaagttacagagtatctacctcaaaccattagaggcattctcattagaagcaggaacaaaacaagtttgccctctgctacttgatattattttagaagctctagccaatgcagtaaagtttgcagaaacagaaataagaactaaggcttttaggattatttgatattattttagaagctctggtcaatgcagtaaggccaatgcagaaacagaaataagaacaaaggctttgaggattaagtaaggtaacatttcagcttccctcctatggtatttttaagtcagataagacactccaattatagattgttatttttttaattaataagacatctttacaaaggaaaggcaaaatcgtctcttgcatcttaagacacgtctcctggtgcttttttgtccttgatccttgctcgttggctcgtcttgattatctgatctgtgttgaggtctctctcaaaccttcagtcaccagtacaggagtgagaggtcaatacctgtgactggcggagaggtttggttctgtctttgatgacctttcaatgagctgtttttgcaatcctgggagtactagaagaacagactcttaagcgatgacactgttgtcttgaaacttgactctgttcagcaaaccattgcagtgtaccctcagtgctatgcatctctgcagtgtatagctgctgtgtgttatcaggagtcatttggaagtaactggtctggttgaacaccacacagaaatctttactaattagctagctatctctaactttggtttgtgacttcggtctgtgaaatctatgtctctctcttttttttttccctgatagcatgtggagagggccaaatgtgaactgtgttgacagcactggctacacacccctgcaccatgctgctttgaatggccataagtaagtatcaatgtactacattcctgccttcacccttcagaacccaggccttcacgttgccttttcatttcctagaaaagtttgctggctgagcttagtggctcatgcctgtaatcccagcactttgggaggccgaggtgggaggatcacatgaagctgagtttgagagcagcctgggcaacaaagcaagcctccatctccacaaaaaaaaaaaaaaaaaaatttttttaattaatcaggcgtggtagcatgcctgaagtcctagctactcaggaggctaaggcaggaggattgcttaagcccaggagtttgaggctgcagagagctatgattgtgccattgcattccagcctggttgacagagtgaccctatctctaaaaaacaaaaacaaaacaaaggtttgctaagcggtggcactgagaaacagagaaaaacaaacgtaagttcagttcattcagcatttctgtgtctttctttcatgtataatttaaacatccttccccaccctacccaccaaaaaatcttcagccaagagttaagttttaccttttcttctgcttgttctttttccctctggaatgttccagtgctacataatgttctaggtatgatgatcaaatttggggcagccagaacataaaggggctggaatctattaggtaactaactgctcaataaactgaaaatagattaagtggtcatgagaaagctgtcttctgtttcaatagttatttatttactctctcttcttgcctgccattctttcctcataaaattagccctgtacacaagaaccctttttaaggggaaaaaaatacattaaatggcctatgtaattctcctgagtatagagaagttattaggaactgggtgggatttgtgtggaacgttctctggaggaggcatgctttggggagaatttgagagagaaggcataggcttaagtgattgggcactgcctttcaggttgcccagcaaaggggcaggcattgtcggggagcacagtgagtgggtttgccaggatgttgaagaatgtaaaccagagtgtaacagaatagaaggtgttaaaggaaaacaagtactataggcaataagtagcagcagtgtcgtttttttgtttttgtttttgtttttgagatggagtttcattcttgttgcccaggctggagtgcagtggcatgatcttggctcactgcaacctccacctcccgggttcaagcaattctcctgcctcagcctcctgagtagctgggattacaggcgcccgccaccacacccagctaatttttgtatttttagtagagacggggtttcaccatgttggtcagactggtctcaaactcctgacctcaggtgatccacctgcctcagcctcccaaagagctgggattacaggcatgagccactgcgcccggccagcagtgtagtttttatgaggagggattattggaatcattttagattttgctgagcaaggagctccagagccctctaccttagagtattttgtgtcacttgtccgatatttgacccaccctaattgactccaacataccaaaaagaggcagtggttgtttccttcaacattaaacatttctaaaatatactgaatatgatcattaagtcttttctgtagccatcttagatatagctaaaaagaaatctatagagaacactgttcccatatatagtggggtaatctgaattaaagtgaatcttgaacttaaatgactatagtttgttagccaagttcatttccagatgctgttttgatttacagtggggattttctttgacctcacattcatagggataattatatactggtatgtgtttaattagtgctgtcaccaggaaaaaagcaagttcctctttctggggatatcaaatgataacatatgtgtctggcttacttttgcaataactatttatttatttatttatttattttgagagagagtctcgctctgtcacccaggctggagtgcgatggcgtaatctcagctcactacaacctctgcctcctgggttcaagcaattctccctgcttcaccctcccaagtagctggaattataggtgcccaccaccacacccagctaatttttgtatttttagcagagacgggctttcgccatgttggccaggctggtcttgaactcctgacctcaggtgatccacccgcctcagccttccaaagtgctgggattacaggcgtgagccactctgcccagcctgcagtaacttttgttctgcttggcctctctgctttcagctcctacatcactaaatgctctgaataatgtggtgaataataatatttgtcttgtatgattacttttatgtaaattcaacacttgaatgctgtttaaacatgataaacaaggaaacaggtttggacaaagagtccagacattttcaaagtagtagaaaacagacggattaccaagaaagcctaaacagagaggtgatgagtcagcatagcatggctcaaggtggttctgctgcatatcagcagctgtacaagtagctcatggaataaaaggaaaagctggggtggtgagctcaggtagagacacaggagccaaatgagatatctgtgaaagggctttgtgccatataggtgtaaagagctgttagctggaaagacttctgagttctaccaactcatgattgatttttgccttctagggatgtggtcgaggttcttctgaggaacgatgcgctgaccaacgtggctgactcaaaaggctgctaccctctgcatttggcagcctggaaaggagatgcccagatagtgcggttgctcatccatcaagggccttcacacaccagagtcaatgaacaggtcggaaggaagggaggctttccttcctccattcagctatagccagatgtggcaaccccatcaccatcttagccccatagttcaaatctcagagaaccagctcttccttttctttctttttgataatcagttccttagcatggaaccacctcttccataccctaattgtgattcccctcttcccagttctactcttcttagtagatcttatactatgaggatgtattttatatgcatttgactcatgcatatttggaatagtactagaataaaaatgtatacacagtcagcccttcgtttccaggacctccccatagataccaaaatccaaggatgctcaagtcccttatgtaaaacggcaaagtaacattagctgtctctgtctgtgggttccgcatgtgcagacttaactaaccatggatggaaacctgtggatatgaagggccaactgtattcactttatgtgcaaaatttgaaataatgcaaaccctgcaaaattgcatggagtcagtttcaagctagtgagcttaattaactgtgggctgggtgtggtgactcatgcttgcaatcccagcactttggaaggctgaggcaggagaattgcttgaggccaggagtttgagaccagcctgagcaacacagtgaggagccccaaccccccaggccccatctctataaaaaattaaaaaaaaaaaggccggatgtggtggcacacacctgtagtcccagctactcaggaggctgagacgggggatcacttaagcccaggagtttgagggtgcagtgagccatgatcatgccactgcactgcagcctgggtgacagagtgagaccctgtctcaaaagtaaaagtaaattctgtttatgccattgacatggcaatgtaactttcccagtgtttgtcagtactgtgtaaaccatgctcttgttttacatacatcagaacttgcagcagtataagtactcatgctagtgccaaaaaatgaactcacaaatcaggaacatgtgaggggaggtcagaggtgattcagtggaatgaagatcatttccatgatgtcctccgagtaagcatgctttgaaaaagcagagatgattcttagaaaatgaaaaaggcaggatttgagcaaaaataaccgtataatggccatggatttagttactctgagaatatacctgttctttacatttatatctttggaaaaaattgtacttggattatgcaagttttaaacaagcctcttacaaatacaactccctgtcatttgggttggaagttgtgtgcaagtttgagaggagacgggcattccttatatgataagccattctcccctttcctctctctgctctgaactgaagcagatacttttctcagttcctagaaggagggagatattgatgtttctcagtaagcttaggactatttttctaatgactttgccgagaggggattgttaaattacctgtaggattagatcaaagttttccctcaaaaaataggaaattatcctggcaagtccatctgtcaggagactcatgcagctctcagttagctgttaaaagcatgactttgattctgaggggggcagcttcattctgagacatgagaaaattaaaatagtgctcccaaatctcttgatttggagattgtgtgtatatagctgttaatcagccttcctttccccttttgggctgtattttctgggtaggtgagcaacagacatttaaaatcatcagtgaggatgtttgtttataacatttgggaatgaaaagtatctgtttagaattacttctttagaatctaagtgcaattttactccttctagctaaagtggtcatttctcttctctggaggaaatgcataatgaagtttgcttgtaactaatattcttcaatgttggaaagactggtcatccattaaagtccttctcatttaagaaattttcagcaaccatttctaatcctctttgctcacgtttgccttgaaacacagctgcttggatttttgagctacttgagtgtgctagcttaacctgctcacagctgcctcctgcttggagtatcagttgataagtgggaccccagcccagtgctttgagtatctggtaggcaggtggtgggcagaagctgggcaagatgtctgcagtagcttgaagactttaatggatctagctagtggttacaagtactatattgattcattttaaaaccattaatatggttccagtaggatgcttagattaaaggggggtaagagtaaggtgctctggaggttgtctttcttattaacttccctttgaggcatccagagggcagattcaagttgttctagggttgggttccctcagggctgtgtattgctttgatatatttcatccattttgtcatcactttttcttttcctctcctttttgtagaatgctcttgagatcaaagaactcaaaaagtacggcccctttgacccttatatcaatgccaaggtgtgtactttgctgccaggaattctctgcatcatttctccaagctgtacctcctctttggtcctctccgcttctactcttgtccactcagggtcctcctcatcatgctgactgttgtctgcttcagtccatctgcttttggcttgtctgggaatgggaaaatgcagctgcagtgggttttggctttatttttaaaacccatactaatttgggaaatggtgggtggttttttctggaatatttgaaatggcaggaatggggaaatagaaaggaccatattacatgcttaatttacaattttgattcttaaaattttttaaatgtagttaagagatgtcaaattatcttactttttaaataagcatagaaaaaatgattaagttgtacctcctggaattaaaaaatatttttaacctactttctatctgtcttttgaaatggaatctgattttcaggtttcaatagctaatggtggagatgtggaggaaaggacatggttgatccgttttattcctttaaaagctgttgcatgactcttctctcatctcctggagtttgtgcatctctgcctgatgctttaaaaccacgacccaatatctccagccattagcttctctctgcttgatcactcttgacccaggaagcgttctgaaataggaaactatgttgcaggaccaagggagccttagtctccctccctgtgaggctgggacaaagagtagtctgatgggcctggtgatgaacaggccagccctgtctgcccctcagcctttaccacatctgagcagcagagcttgttcattgggtgatggtgttagcctctttccttggtgctctcacccgctggttttggtcaaagattttattcagatgaagtttgctttttggcaacagtctggagtgtgctcaagacactacattatccacattagctaccttttacttgttctgaaaacagctgccttggggaagagaaacataaggtacttctgtatgtttccaaacacaaggcagatatttcatgcttttgagaaatagtgatttagcaaaggaagccccctatgggctggacctaggaaggccctgtgggagattttgttcagctgttgggtcttaatggtagagaagcaatttgaccttaggtagtggagcacatcagctttgttttggcttactctttcttacctccttccccttcccttccccttccccttgccctccccttcccttccccttccccttcacttccccttcccttccccttccccttcccttccccttccccttcccttccccttccccttcccttccccttccccttgccttccccttccccttccccttcccttgtgcttccccttccccttcctcttccctttcccttcccttccccttccccttctcttccccttcccttccccttccattccccttccattccccttcccttccccttccccttccccttcccttccccttccccttcctcttcccttccccttccccttccccttccccttcccttcctcttccccttcccccttccccttcccttccccttccccttcccttccccttccccttctccttcccgttcccgttccccttccccttccccttcgcttccccttcccttccccttccccttcccttccccttccctttcccttccccttcccctttctcttcccttccccttcctcttcccttccccttccatttcccttccccttccatttcccttccccttccccttccattccccttccccttcccttcccctttcctttctttctttcattttaaaaagggtctccctctgttgcccaggctgaaatgcagtgattggcctgctctttaaattctgttttctagtcttcagaataggaagatactcttatcttagtttttttgttttttgttttggaagtagagtgatagagtgaaaaactcataagtcataggctttcatgtcagaccagagtttaagttctggggtgcgacttattagttttgttgacttaagcaagttacttaatttctctgagcctcagtttcctcttctgtaaaatacggcactataatctaccttgctggattgttttggagtttaaataagataatatatataaagtaaaaatatctggtaactagtaatatttgagatactaattttttaaagtgtatgtaatgtatttctgcaaaggcatttttggaatctgtttttgttactagtagatgacgcttaatgaaacattattcagttagtctattcagagttttcttttatggggaggaaacttgaagtgattgttttcccaacagtggttaatttagtgagcttataaagctttgataaagggtaagactttggttcttgaaagtacattttcctatcctttaattttgcacatataaaataaaattagtttaaatgtagtaagaacatacttctttctttggaaataattccctttgcctcttccctgaaaggccaattgatgcaaactacattaagagtaaagctgaggccaggtgctggaattacaggcataatcccagcactttgggaggctgaggctggtggattacctgaggtcagggattcgagaccagcctggccaacatggcaaaaccccatctccactaaaaatacaaaaattagctggatgtggtggcatgtgcctataatcccagctactcgggaggctgaggcaggagaatcgcttgaacccaggaggcagaggttgcagtgagctgagattgtgccactgcactccagcctgggcaacagagtgagactcaaaaaaaaaaaacaacaaaaaaaaggaaagctagccagtgtagtggctcacatttgtaatcccagaatttgggaggctggggctgaagattgcttgagcccaggaatttgggaccagcctgggcaatataatgcgatcccatctctagaaaaaataaaaaattagccaggcatagtggatagtggtacatgcctgtatcccaaattctcaggaggctgaggtgggaggatagtttgagcccaggaggttgaggctgcagtgagcagtgatcactgtcacctgggcaacagagtgagaccctgtctcaaaaaaaaaataataataataatagaaacagagaggtaaagctgtttgggttgtgctgagaatgcaaacccttcttgagctgattcaaatctaacctcctttgaccaggcatggtgactcacacctgtaatcccagcactttgggaggctgaggctggcggattacttgaggtcaggagttcgagaccagcctagccaacatggtgaaaccccgtgactactaaaaatacaaaaattagctaggcgtgctggtgcatgcctgtaatcccaggtactcgggaggctgaggcaggagaatcacttgaacccgagaggcagaagttgcagtgagccaaggttacgccactgcactccaacctggatgacagaggagactccatctcaaaaaaaaaaaaaaagaaaagaaaaactgatctgatccccctaggttttgtcctgattcagtggatttttatagatctggcttatgtctaggaattgttttgttaaagtacttttgagtgctaagttctatcaggcacctgtacaaattaagaagtctcagatggcttattttgggagcagaagtagtttttaggagctttcatgttcttttttgacatttggggcctttttcaacaagtcggtgtaaaccagccaaatgtaaattatccttagctaaggcagaaccatgaaaattgcgcattttccccctcttaacaattcttccttagtctgagtcataaaatgagtaacaatcaaattaatattagggcagatctatttttttggtacatttaaaatgatttcacagtcttagaactgaaagggacttggaattttatctagaccagttgcctccaaatataatcaacctttctggttgcattagtatcacctgcaagcttctaaaaaactttttattaaaaaaaaaaacttgtaacttaaagttttaagaataatgccatgaactatggtacactcttcttgatactacagtgttaacattttgctacctttgctttttctctttctgtgtgtgtgcgtgtgtgtgtgtgtgtgtgtgtatgcaataattgttgtcactgatgaaatatttgatattaagtcatggacattatgaccctttaatcctaaacacttccattttggtattagttagttctttgacctaaatctcctaagaacaaggacattcgcttataaagccacaatacatttattacatttggaaaattcaatattgatacaataccattatctaatatagaatccatgttcaagttttaccagttgtctcaaaaatgccctttagagcaatttttttatgatcgagaatccagtccaggatcatacatattaataatatggaacagttcctcagcctttcttagcctttcatgacatggatggtttttaagagcacagggcagttgttttgtatactgtctttcaatttagctttgtttgatatttccttatgattagattctgggtatacatttttggcaggagcgccatggaagtggtattatgtatgtcctttttagtgctttgcatcaacaaggcacatgacgttggtttgtctcattcttgatgattatgattgattgcttaagttggtgcctacaaatctggggtaaacctactactagcattttagcattttttttttttttttagttcccatgtaattctaaaagctggtttgagaaccaccaatttaggccaaccttccacatagagcaggaatctttctgtcatttgaaaggtgaccctctaccctgtattttaattatttgcttgttttccctaataacaaacagaactcattactacttggcagcctgtttttggattccattgagttttggtttgttgagtttgattggcatctatcttcctaaaccttccatttttttttggatcagagttctgctttccagaacaatacagagtaagtctaactcttcttccacatgatggacttgctttcatgcttctcctgtgtcctttcaatctcagacctagtttttcctttctttccattatggtatgtttttctagggcctgtactttcattgctgcagatagctataggccaggtgtccctaacttcagtatctgccaacaaggggtaagtgtgcagttgggctgtaatctgagcactaggaggtgatagtcctgaaatagttccaagaggagaaaggtcgggaaaaagtttctttcttcctttttttttttgagatggagtctcactctgtcacccaggctggagtgcagtggtgcaatcttggctcactacaacctctgcctcccaggtttaagcgattctcctgcctcagcatcctgagtaggtgggattacaggcaagcaccaccacacccagctaatttttgtatttttggtggagacagggtttcactgtgttgtccagggggtctctatctcctgacctcatgatctgcccacttcggcttcccacactgctggaattacaggcataagccaccgcacccagccagaagtgggtcttaagatgagtaggaatggagaatttgtgcaaaagcattgggggaaatttgggctatttcctctcactccattttctcagtccagattagtagtaataggattttggaaactctggaggtattgtgaacacctgtagtgagatttggaaggtgtgacagggaaacattccagatgatcaggagtctgtgctgctccttagaatcctttcttttcttgtgagtgtattaaccagcacttaataatagtttcctaggcctgcgaggcgcggtagctcacgcctgtaatcccggcactttgggaggccgaggcgggcagatcacctgaggtcgggaattcaagaacagcctgaccaacatagagaaaccccgtctctactaaaaatacaaaattagctaggcgtggtggcacatatctgtaatcccagctactagggaggctgaggcaggagaatcgcttgaacctgggaggcggaggttgcggtgagccgagatcatgccattgcaccccagcctgggcaacaagagcgaaactccgtctcaaaaaaaaaaaaaaaaaaaagagtttcctagaccttaccctctgaggtgctactttggcaagtctgagattggacctcctactagtttttttgtttgtttgtttttttgagatggagtcttgttctgtcgcccaggctggagtgcagtggcgcaatctcggctcactgcaacctccgcctcctgggttcacgccattctcttgcctcagcctcccgagtagctggtactacaggtgcccgccaccacgcccgggtaattttttgtatttttagtggagacggggtttcactgtgttagccaggatggtctcgatctcatgacctcgtgatccgcctgcctcagccttccaaagtgctaggattacaggcatgagccaccgtgcccggcccctactagttatttttaagctcccatgtaattccaaaatgaagccagtttgagaatcactgatagttcttgccctgatagttgtcaggctcaaaaagcctacagtaataagagcttatcgtgatggcttgtgtcagtgatggatgtggtcaccacagatataataaacttgggtattacagttaccagaccatgtctggcatgactgaaacctaagtaagatgctccctatactgtgtctatgagtgtaactttctgcagagatgtggttagaccatttttaacatgaggcaggaaatttgccagtagtgattatgaccttgcctttagcagggcagctttgtgagagctgctttcattctggcgaagaagaaatagagaaaagtttttttgtttttttggtttttttttttctttgctggatggtttagacttttacagttctttagccctaatggcatactttttataaaatcaaggacaatttattctggttgttgggagacaacttggatataaaagagacagtagtatttgcttcagagtaaatagtttttctggattggaattttaataagaataagctgactttcttggctctttctatcacactcatcttgagatgtacaacctggagaatccttttaaacttctttgggttactactctgccccagaattactccacagaaagatcctgtgagtttttgttaatgtaggtgttggttcatcaggagaaagtgataatcaaccagagaaatgttgggttaaaaaagagagaaattgaagggacagctctaagtttgcttaggaaactcatggcatagcttaatagggccttccaaatgggtatcctaaaaggtttgtttggcacagggaggacctcaaagacttgctttctgcccagcatttccccttcctccagactttcaggttacatggaatttgcccctcagggcccagtcatatcataggaggccatggctggcaggccggctgtatcctctggccagcgaaggctgttggcactttcctgacagctgctctccttgagttgtgtttgagctcagtgcagcttcctctgcatcctctgtttatttgtgtgcatttatctttgcatgtgtcctgctactactttttctgtccttatttcatttaaaaatttttctttgccatcgttctcaccttttggggagttgttcccagcagctgtggatctttctggtatacttggtatagttggaaaaaatgatgcagtcaaatgccagatcaaaagcagatggaattgcatatgcatgtttgggtaattcctaatccattacttttagtgttattaatagaattaaagcaattgcagaaacatttaattttgaccttttgaccactgaaaggtgcacaatattgacttaactgacaaaccccctcttaagctttctttcccaaaagtagcagaagcctcctggataaatttaggaatctcaaaatcttgtgggagaattattttcatcagtgcttctcaaaaaggagaggtcatgggacttactttatttctgctctaattagacattgtcagtagtaaaagagcataattggaatgactaacattttgcctctggtggttgataaagcacacaattctcccattttatcccaaattctgtctttagtttgaaacaaaattggcattagaggactgtgggttgtgagcttgaattgatagcaatattacatttgaatattttgcacctctcacacaaaacatgccagcgtttgcctctttcttacataagaaacatcttcccgtgctggctgccattttaatgaagtagatactgcatgcgttgcttggtgcaggctcctggggtaggcacagtgcagtgtcagggtcccttatttctctgtgactgagcccgagtgccccctttacctggaaatggcttttggctgataccttgagcgatttttagtctgctctgttacttttcactgttggctgattgatttgcatgcaagaagctgtgcagatgaaaaacttttattaaaaagcttatgtgtaaggcaatggatggttgacaaatccagaatcagaaccatagggttgaatgcctacaaattgtaaaaccatttgaagtttaaactgaaataatagcagtgatattattggtattcatcttgccagggcttccaccaaatgcctgccacattttcttgttcactctccttacaacctggagacccttccttcatggcacacagggcattgccagtgtttaagagatgacttctcccctctcacagtcactgggggaaggtgtcgctgattagaccagtcaggcttgtttgtgggggagtatgtctggattccgacttttattagcccccaagtgttgctgctatttttctcatttaaacttcagtggttttacgagtggttgtcccagtcaggtgcctgtctgccagtgacctttctgatgtgatctgcttgttaaccctttagaacaatgacaacgagacagccctgcattgtgcagcgcagtatggccacacagaggtggtgaaggtgctcttagaggagctgacggaccccaccatgcgcaacaacaaattcgagacccctttggacctggcagcactgtacgggcgactggaggtggtgaaaatgctccttaatgcacaccccaacctcctgagctgcaacactaagaagcacacccctctgcacttggcagcaaggaatggccacaaagccgtggtccaggtcctcctcgatgctggcatggacagcaactaccaggtagcagggcgggtgggggctcctccaatctcaagagactcagtcattttgcagaaggcacaaggaccatgctgctgggctgtgctctttatttagcacgtttcacatcatgtttcaaatgcttatttgccgactcattctaatgtgacactaagaaacaaatgaactcctcaagcaagtctattatttttttgtttcttttcagggggtaatccgtagtcattaaaccctgaaaagatgtgcttatggactggctctcaaaaccagaaaagtttcattatcttcctatccatgtgttcccactgccaccatttagcgcctccacagtctcatcagcttgacgttgccagcaagaaatgtcacatttcctttctttgttagcctttcccattcagatgaataattccttaggtgttgtgttgaccaaaccacatttgaagtgagggtgtttctgttgtacttttcttcttattactccttccacccaggaaggtggagttctgaggcatttcaccagtagatggctctaagagtaactgttcagttattcacacgtggcctgctggtggcacagaatggccttggtgtatgggccatgatcgtggttttggaatccacacaagaaaagctggaaagataatgacagagggctttgtgtagtttgttttattttgtgtcccttcttgtctgtgtcccctttgtcacgtgaagccgcaccaaactgttctgatgacatcccgctctgcgctctcgtttgctttccagacggagatgggcagtgctttgcatgaggctgctttgtttggcaagaccgatgtggtgcaaatcctgctggctgcaggtgagaggtcggcagcgctcttgtctacacagcgtgccagggttgggattgtttctccctagtcccctagggggatttttgctggctgtgtttgaactcaatgtatgtgtatctccactggttgattacaagtgtgtaaactgttcttgaatagctggattaaatggctctggatgaaaaatgttggccatgctgctgacagccttaaatgtcctaaaatttgacccttttggaggctggcttgaaaatgctcactcccctggtccacctggtgtgcctttctaggaactgacgtcaacataaaagataaccatggactgactgccctagacactgttcgggaactgccttctcaaaagagccagcaaatagcagcattaattgaaggtatcatcctttctccctgtctgggtgaccaggggacacacgaattgaaccaaggcatttgtatttggtgcagcactttttatttttattttttgatctttccatgtagatcacatgactggaaaaagaagtacaaaagaagtagataaaacccccccaccccagccacctctcatctccagtatggactccatatcacagaagtctcagggtaaggtaactctcccctatgagtaaaggggtgctcagcttgaaaagagttgaaaattcgtgggcagaatggaaaaatcttaatttaaataataattttgggggattgtgagtacttagtttatattcagttcattttttgccaactactatgtgaagttttattggacatagtttatgcttttgactgtgggcctctttcctactttattttagcctccacttttccagttggctctgtgagatctattctgagatgtgtagtagagaggatcatctcaagatgaattcaaatctcagtgaaaccttctttttctaacacataatcacaatctagtgccttgtacacagttgacgagtaataaatttttttttttttttttttgagatggagtctcactctgttgcccaggctggagtgcagtggtgtgatctcggctcactgcaacctctgcctcccgggttcaaatgattctcctgcctcagcctcccaagtacgtgggattacaggcacctcccactatgcccagctaatttgtttttgtatttttagtagagacagggtttcaccatgttggccaggctggcctcgaactcctgaccttgagatttgcctgcctcagcttcccaaagttctgggattacaggcgtgagccaccgttcccagccaatatttaatgagtatcatctgattggtaggggggtacatggcaaattttgataatatatcatatgagcaacaaatgtggtctggatgggagcttagggagtctagcctaacagtagtcaggatccaccttttcagatgcatttagcagccttttgggtccttgatatgatgaatacaaagatagaataaagattgacacctttccccaaatatagattacaataaagaaggctagaaaaacagaacaaagctaaaaatgaaaaagggaaagggatttcccagaggagtgcagggagatacgggctgaagggtgcccagctctctgaactgtggagtccttgtcttcctcccacatgcactttttttcttgaccacataatctgctagtaatgggattagtagttcactaacctcttcaaggattttacatttatggttttgattatttacaggtgacccagagttgcctgggctctaatagttggtaactttgcagagtcacacatttggattgcaggtgctccgaggctgatagttatctaacaggccaagctaacagctgcatgggcctccagctcagaaagcctttgccgtcctctattttgcttgagcacatggagactcttattaaagaatgtaaagggtaacttaagtttttcagttacaccttgctatatcttatgggttaagtttatgtcattatggtattgaggtattttgggactttataaaggccttgggaggtatctcttatagatgtcaatggtttttcatattgaattaaagaaaaatctgtttagatctcagggtataaagaacagctgaaactatacgtattcttgtccatggaacaaagtaatcattttcttgctctgggttagtgtttgtgagcgcgggtgactaaagaggctttgggttgctgcagtggttggaacctgagattctgctccccttcagtgactctcttgccctccatcctcctctcaggtgacgtggagaaagcagtgactgaactgattatagattttgatgcaaatgctgaagaagagggtccctacgaagctctgtataatgccatctcctgccattcgttggacagcatggccagcgggcgatcatctgaccaagactccacgaacaaggaggctgaggcagcaggagtgaaacctgctggagtgaggcctgtatgtgacccggggcttacacctcctgggggctgtgttggctggctggcccctgaggtgatggggcacggggaagggaagtgtgatccctggtgccagctcatgtttccggggcctggagcccacttattctcttcttcatggggctctgctgggtctctcttgctgagtgtactgaaactctacagatcacactgaggttagagtttcattttttctagtttcagtataagcagcttgcatctttacgtgacttcattggccttagagcaaattaaacatcttatttctatttagccttagtgttgcttctgtctttggaatttttgctgtatattgtctgttttctctctgaaaagcagaagcatacagtgaaagctcactgaaatgagttcctatctgtcctgagtgtatgcttactatccacttgccctgaaaggattctccatttggatttgggcaggttctggattcaacagggttgtagcagggcttaacattgtatttattagtatgtggcattcctattttatctaattataatgcctccagccattgagataagaggatgagaacaactctgaatttttccttctcaaggtccattttctcatctttctgtttctttctctagtacagatgctccttgacttacagtgggattatatcccgataaagccattgtaagttgaaaatctcataagtcaaaaatgcaggcaatacacctaacctaccaaacaccatagcttagcctagcctaggttaaatgtgctcagaatattgcatgagcctacaattgggcaaaatcatctaacataaaggctgttttataataaagtgttgaatagcttatgtaatttattgaatactgcactgaaagtgaaaaacagaatggttttgtgagtactggaaggacagtttctactgaatgcttattgctttcccacgatgataaggttgaaacattgtaccatcgcaggtcagacagtctgtacctgcttttacttctagccttgtacattgttctcaagataacttacccctggcttctcccctagggttatgttgggagtgtaggcccgaatcactggtcccactgaccctccttcctccactgccacgcacaacaatttgaggttttgagcagtgcccattagctaaactgaccattgctctaatgagatcctagtgctaaccccatctggagacaaattttcaggcctgtgttatttcttcctgttggaggggctggcctttcccttttggtctgaatctggcttgtgaccattttgatgatcctttggctgcagataactcttgtttcttgcaggtgtgccctgggaatgaccttatgattcttagagtgttctttttcattaggctctttgctgtgccctgctatgccctgaaacaccattttagtatggatcttggaaaggcccgcagtctagtggtagtccaccaaagtgggtgttatcaaggactgtgacaaaactccttgtgagcggtgaaagcaagtgcatgtgctgagcaccaccagtatagcacttctatagacagctagttatttcacttattttgcttttaggcacaacggaattaagcaaatccaggtttggaggaaggtggtgttttaattggtacttataggtgatgcccattagggggcgctgcagtctttgcaagaagctgctcagggttactgaagaaagctgagaatgatttcctgtgattgatttacacaggtctctttgttccctcctgctctcctttttgcctccttctctccctcctgtggtcctaagcagaaacgggtggatgctttgccatttttacttgtgtatgttgtggctgtgctgtcttcctggcccttggtaattaactatggcaaagggcctgtttacctcttggtaaacacaatggatggtatgtgtaaatcactgtggtacttctaagccctgctccaaagttttcaccttagagaaaaagacacaggtatttctctttccttccagtgtccctggtgattgtttcttacacaaaaagcttccatattgttctttctaggcttttttggccttaggaaggcttctacgatgagttctttttgttgttgtgtttcctttttgtttttttttccctcagttacttgatgtcccaaggttggttaactggtgatggatacaggcctgctccttttgctgttcccttccttacaaggtggcactggaaccaggttcctgcacttctggagcaaagaagggtggggaaagtgggacttagtgggacatctgatataaatagctttgtttggcttgaacatacaggcttgttttgaagttgttgccattgggcatccatctggttccagggtctatgggaatgaccgacttatcaagatagaatactgagcagtgaagcctgttttaagagagagattatggatgccaaaatgctaatgcgagtagctcctaaaacatgagaaacatctttccatgcagattttgcttgagctctcgcgtaactcagcgttctgttctttgactttctgaaatactcctgttttaacaacacagtgaacaaacctgcaagccagggaatgaacctgcaggacagctcttgttttgggtcccccactgcctttagtcggaacactgattctcaagcatgaccagggctttggaatataaacagtgctaaaggccctgcaggtacaatggcaaatatctcttcagctttcagttttccttcatcaggatcatcctgtgtcttcctgaaattgtttacccatgatctaacttatcctgtgtcaccttttcagtgactttcttattctagagcaggggttggcaaacgacagtccacaagcgtctgtttttgtaaataaagttttattggagcatagccacactcatttatttacatatcatctgtggctacttttgcattataatggcagaattgactgcaaagcctaaaatattcactatatggcccttaaaaagcttcttttccttttaaaaatgggtttagatgggctgggcacggtggcttacgcctgtaatcccagcactttgggaggccaaggcgggtggatcacaaggtcaggagatccagaccatcctgggtaacatggtgaaaccctgtctctactaaaaatacaaaaaattagccaggcgtggtggcgggcacctgtagtcccagctactcgggaggctgaggcaggagaatggcatgaacctgggaggcggagcttgcagtgagccgagatcgcgccactgcacttcagcctgggcgacagagtgagactctgcctcaaaaaaatttttttttcaaatgggtttagatgaaatagagtttcatataatacttattattgaaggaggcaaccaaggataagagaacaggttgagctttttgctaataaatgggagtagaccagtatcagagcgttaacatttcaacaggaattaacatttttgtccttgattactttcctcattacttcctcagtaactttgatttgttagaacaaatttcacaggttgatttcttttgatccagtgtttcttctttctagagtagactgaaaagtgaaccactgattttcctaaggtaaagttttatgtatcagtattatgaaggaaattttctaacaaggcagttatgtgttctcagtactggcatttctcactgtggtctaggatatgaaagaggtgtttatgatctctgctacagacatcaaaaaccatagagcatgctaattgaattgtgtatgtatgcacagagttctccatctgttcagagacgaaaccttgactttagtctctcaggggagttccatacattatttttttcatttctaagggctaagatgagggcaaaccaaaaaattagatacttaaaaaagagatcgcaaaatatttatttttttctcttctgcagagggaacgtccaccacctccagcaaagccaccgcccgatgaagaggaagaagaccacatagataagaagtattttcccttgacagcttctgaggtagagggttgtgggtttattccccattgctgaaatttgagtttgttgaaaagtgcatcgatgtgtgctttaaaagactttgctttctcatcttctcatcagctctttggattataaatttgtattatgtgtactagtaatctggaataagaccttccaaactcacaaagaattttaatatagctctcgcagacaggcccagtattgatctgccataccacacggaaagtaaaatgtacattttttcctggctccaataagctgaacagtctcactttttgcttttaagcctcttgtcttttgatacaagatgtagagcttccctttaatcactgttccctagactgtgcctcattagcaagctttagtgcttctgccccaaacatcttattcctgtttttgtattttttcctgttcgtttcacatgaagactctacaccaggacaaacatgaattgagccatgaagactcaattagaaaagacataggagttatgtgggatggccagggctggaagatcaaagaagtttatttgaaaagaatagtctacccttttgaaaaggaaatgtcatcatgaggcaaataactcaatcacttagaagtgtgaaaaaattgtgttttccttaatctttcatcttcaaaatgctctgctaacacttcctgccattagaatatatctatggaatatttattgaaaatattacataattttattagtcattttgtagctcattcaatgccctattctctaatttaaaaatcagctaatataaaacagttaattactctcatcactttgtccctagaagttcgagttattgattttttacagtattgccacggaccatggcaggttcttttattcagtataaacacatggaaccagaaggatggctttagtttaacaaaatgtataaatacaaggaagcccttttaaaaacgtaaaagtcagtgttggagataggggaagatttctatgctaggtacaaattctgtccttaattctttcctttagttacaaaatgcttattataatgtctcatctaagggtttctagatttgcagcctgttattaccacctctggataataacacatttctagtagatccaagtgtacgcagtaaatccttccatatttttatataaatagaagtttgtctcattacccccctccttttttttttttttttttaacaaggagaagcctaataataagaatattcagttggggctggttctctgtaaatgccttctgcccctctttaacaagcacttgagttaaaattcataatgcttgggcaaggctcttaaagaaacactggattatacccagaactttctattctcccaaggttttctaaagcattcaatgtggcaataacacagtgtcaagaagtggtggctgggagagagaagggggaaatcttcatattactctcctagatgggagagtttgagatacattttctaaaacttgcttctgaatagcctggaattctggatcagttggaacagcatagtcagtatttggaagatggtgaaacactgaatttgctaatttactggtgattataggtacctgaatacagaggtgatacggcctgcatatgatccaggcagattttattcatatgctgtagtttgtagtctgaatggtcttcttcaaagtgtactattatgtatattttttggactttgttgtctttccctgtctttccttatactgttaaagctttaataccctagactctatcatatctcaggagacactgacttcatcaaacttaggtttttgtctttggcaagctatctgccccaatatttgtattcctattcctaagcctggtcattgtcagatgactcatagaagcctttaggagaagccagagtatacctagctctaggagtgcttatcagattaatgacctgatcatgaaactggcttaaaaacattagacacatatactcacacacatacacatgctgtgtagatgtttttgcccacagaaggggctgccagctgcatcaggactggccgtagtcttctctgtgctcagatatgctaaatattcatggaagttgcagctgctggagtatctcttcccagaaagctcccacaccccaactggacattccattggtcactgttaggtggtgactgctcatagcttttctctgcagcagaaatgttgctttccacatagccgggaaaaaaaaaatatatacacacacacacacacacacacacacacacacacacacatatacacatatatatatacacacatatatatacgtatatacacacacatatatacatatatacacacacatatatatacacatatatatacacatatatatacatatatacacatatatatacatatatacacatatatatacatatatacacatatatatacatatatacacacatatatatatacacatatatatacacacatatatatatacatatatatacacacacatatatatatggctttgatttattgccagccctggaggaaaggaaaaaaaaaaaagattaaggagtaatttagtaaagagcagaatcctttctgttgaaaatcagttattgccgtattgactatgacatagggcttctggagtgggagctaggaaggctcaaagaaaagcagtttattgctttattgtgaggatttttaatcccatagctggtaggagccagcaccaagaagaaatgatcactctacttgtcgtctgggtatgagcaattggatgaagaaaaaaatgaaagccagaagaaaatgaggccatactggtccaggatcaagggaattgacttttatgcccatggctctgttgtgagctttctgtataaccttggacaagtccccagacctctctgggaaccaggtttgtcatctacgaatgaaagagcagaaccgggtgctctctggctgttactgtgatggttaggatcccttccagctctggcatttgatggttctctgcctctatttgtcctgcacaagaactaggcacagagtgaaagcaggtccagtgggcctgattttccacatggaagtcatcagccctctgctgcatgagaagaaaggatattataggctgggcatccaggctgtcaattacctacctctgaaggaagcatgccggaggctatatgagagttcttcctgtgtgcggaacactcactgaatcagatttctagggctctgtgtaagtgatagctgtaggtgcgtaaacctgcagaacacaaattcctgcctgtgatgcctgtggtattaagttgacacagtgtgaactgcttaatggtccctctttgttcccttaattgtgttcctatcaagaggcaaggaataagtaatatgagtaaatggctcattgtaatgaaatagcttttagcttccaggtagcttgctgtaagtggaggttcctgctgtgcttagcagaattttggaaggaaactgtccttttgcctttagagtggcagccttgttaacaaacaggagctgcagtttcttgtttagtctgacgctactagagtccttgttgtctcattaggcacataacacagtgagctatgccttgagaagcaaaaacccgatgaaccacaaacctgatgcatttccagtgggctaagggacatgtcagtatggaaggaaatctctgtgtttgccaaggaatcacatttttagggtagcattatttgttagatggaattgggaattccccctactcccacccccttgtttgtaatacgttacttgtcctagccaaactgatcaagaagagatcttgagccttggtttgctgttctaataagtaggatttgtcttaatactagcttattcttatttttcttcttattttgcctgtgaaacagtttggattcttaggacaactgggccagaattatcctctaaagcaaggacatccattgtctctcacaaagtggctgtagcactaattgtggtatctacagcttgattcaagggaaagcgtggctactctggtaccaagacaagccgtggccatcaggccctcagctggtcaaagccttacagttgccaggtgtaggagccagctctggttccgttatttcatcagagacacttgactgcctggattaggaatttctcagtagacagctgcttttccccctccacactgaaattcaaactttctagccacttgactcttcagagcagagattggtggaagtaatttaaaattgtattaacataaaggttgtaggaatccagttttggggatatccttcccaataaccctcaggacctctgaagaaaagctcacaaaaatagagatggacttacagacaagtttgtttctagtaaacgtcaaatgttgagggtcagttggaagtcattttggtttcctcttgaggaggtgggaaggattccagtctttggatagtatatgtgcatattagaaaagaaacgtggagaaagaggtctgccttcacgatggagcatggctaagagctgcttggcaagtattagcctcagaaaagagattatgcagaacactgtaggcatgggagacgcaagaaaggaaggatcctggattttatttagcattttttgaagactaaaatcaaagaaaagggagttttttgtttttttgtttttgtttttccttagagacaggatcttgttctgtcacccaggctggagttctgtggcacaatcctggttcactgcagcctcaaacttctgggctcaagtgatcctcagaaaggggtgtattctaatcaaaggcctttcagattggaggtatggatatatatccagaaatgcagttgtgattctatgtgacacttgaattattcaccttctcttttccacctttcttctttgatgaaaaaagagccaataatctcgaatttgttccagactgcctgtcttggtattagccacatgcacaagatacactggatgtttctctcccttaggttctgtccatgagacctaggattcatgggagtgcagcccgggaagaagacgaacacccttatgaactgttgttaacagcagagacaaagaaagtggtgttggtggatggaaaaacaaaaggtacgttccccacaactcctggcagaaccaactccaaagggatttttaaagtttgtgatcctgagtggaaggggaagatgtcgtaactatgatattccttgggttgtggtggttgggtttcacgatgatctgggatggtgggtccattatggcttttcatttccaatacctgacctatatgctctaggttggagttggctgccaccttcagtatgcgaagcaaggaaaaggttaggtcagactaggtgctaactgtgggaggagagaccaccagccccacggcagagattgatttggggtctcaaatcataaaccctcaagttaatgctgtggaaaaacaagctcaacaagtcagtccctttgggttcaggctgacggcacagactctgcttttgagtcctgacctcagagtgagacactcctggggaggggcccgtgattggctgccaccctgtaactagagtgctctgtcgccttggcctactttcattgcctctgcaaaattcagtttcctctgtaagggagtgagtgctgcagtactgagatccagcccgtcgatataagtgcagtcacgacagaggtgagtgtgcactgctggagaatttgtgtcaacccctgttctaaggaagaatgataagggacaatgcagttcccactgcagtttgaaggaactcttgtgacctttcccagctctctacagcttgcaggtattagggccttcatggggtatgcgtaccttctttcaaccctaagacattccatggttcaggtaagaacagaggatgagatggtttcctttgaaatgccctttgctgagatctgtcagtgggtagagggcggcaaagagaatgtgtgcatatgcgtatgacattgtagactttatttttaatggtcctgtttaaaaggttttctcttgcatgcagacattgtggtcattttcatagtgtttttttttgttttgttttgtattttatggtttccattcggagctttttaaaaaagttataatttagatacagtaaaatttatcctttttggtgtgtagttctgtgaattttgacagatggagttgtataactgccatcacaataaaaatatagaacagtttcatccccaaaatttttccatgttcttttgtagtcaacccctctaccttcccttatttctcacaaccactgctctgatgtctgtcccaatagttttgccttttccagaatgtcatataaatggaatcatacaatctgtagccttttgagcctggcccctttcacttcgctaatacatttgaaattcatccatgtcattgcatatatcaataattcgttccttttcattgctactatcccattgtgtggatataccccagtttatcccttctctagctgagggatatttgggtcatttacagtttttggcaattacaaataaatcactaaaaacattcacttacagatttttgtgtgaacagaagttttcatatcacttagatatgtacctatgaatgggattgctgggtatcccagcaatagatgtttaactttatatgaaatatataatatgtttaactttataggaaactgccaaactattttccagagtgattataccattttgcgtttccatcagaagtgtatgagagtgatatacatctacttgctatatatatcatccctagcacttaatattgtcaggttttaaaaattttagccattctagtagatacgtggtgttagttcattatggatttaattttcattttcctaatatctaatgatgttgagcattgattaatgtgattagttaccatccttaatatctaattaaatgtctattcaaatttttgctcattgaaaaaaattagattgttttcttattattgagttgtgaattctttatatattttacatacaaattcttcattagatatgtgattttctcccaatctgtgacttgtctttttgttgccttaacagtgtcttttgaagagaagtgattcttaatttcaataaagttcagtttatcctgtttttaaaaaatggataaggtcaccaatctttttttttttttttaagacggagtcttgctctgtcaccaggctggagtgcagtggcccaatctcagctcactgcaacctccacttcctgggttcaagcaattctcctgcctcagcctcccgagtagctgagtccacaggcgcgtgctaccacgcccagctaatttttgtatttttagtagagctagggtttcaccatgttggccaggatggtctcgatctcttgacctcgtgatccacctgccttggcctcccaaagtgctgggataacaggcgtgagccaccatgcctggccaccaatcttttctattttttttgctaaaaattttatatctttaggtcttacatttaaatctatgatcaattgtgagttaatttttatatatggtgtgaggtatggatcaagtttcattgttttacaaatggctatccaattgtttctgcacaatttgttgaaaaagaccttcctttcgctattgaattgtctttgcaactttgttacttttttcagaattgttttagatattctagttccattgtctttcccatttagaatcagcttattgatttcttctccatccccacacccggttcttagtgtgcacagcttgttgatttctacaaaaagtcctgttgggattttgtttgggattatattgaatctatattgattgtgaagaattgataactatattgagtcttccaatcatattggtagaatttttttttttttttttttgagacagagtcttgctctgttgcccaggctggagtgcagtggcatgacctcagctcactgcaaccaccacctcccaggttcaagtgattctcctgcctcagcctctcatgtagctgggattacaggcatccaccaccatgcctggctaattattgatttttagtagagatggggttttgccgtgttggccaggctgatctcgaactcctgaactcaggtgatccacccgcctcagcctcccaaactgctgggattacaggtgtgaggcaccaagcctggccatattggtagatttttaattaaaacatttagaaaaggtgaagtagaacactaatgccctctctagtcattcgataataaattatgcttaaaaaactaacccttaaaaaacaagcaattaatgaatgctgtgtttgaaaatggttcatagtgaaggaataatttttagcatcatggaggagggagattccagttctttctttctttcattcaaaggtttcatctggaaccactacaagataattgactcaacctttggaagaaagaaaagtggaaagttagactaacttcataagtggggctggtgtccttagctaccaagtgtgcctgaaagggattttgtatccccatatcaagagatcgtcaggttaaggaaggaactgccaaggaggacttttggctacacatctggtcctcctatgctttggtttcttccaattctgcaatattgggctaagtgttgagagtgggtggtatagaagcagatttaattgaaccacaggctgtgggatgcgcctgcctcaaggcttgctgtttagatcactcaaagagctttcagacaaaatacctgagacactgaatatgaaaatgggctctgctagtttcttagaagccttgcctatcctggcagcctggcaggaaaagctagcctagaaggagtgcctgctaaggttagtataagtgaggtacatcagcagaccatgtggtaggtattactgaatcttttctgtatttcctttaatgtcattgtcttatgcagcttttatgaattaattaatcagttttcaaaaggccatgttagtgagactgtcagagcttttaacccctccttagtataattaaaaaaactacaatgtgtgagggtggtgagggaagagagagaccctctcatattgttttatactcagaaaagaaaagagaagcaaaactaaaggcaggtagcctggcacctaggaacagacccaaaaccaaggaaccagacccgaaaccaggcctgggcctgcctgacctaagcctggtagttaaaattctacccctgacctagcaactgatgttatctctagattatagaaagacattgtaaaacttcccggtctgttctatttcactctgaccaccgttgcatgcagcccctgtcacgtaccccctgcttgctcaatcgatcatgaccctctcacacggaccccccttagagttgtgagcccttaaaagggacaggaattgctcactcggggagctcggattttaagacactagcctgctgatgctcccagctgattaaagccactcccttcactatcttggtgtctgaggggttttgtctgcggcttgtcctgctacatttcttggttccctgaccaggaagcgaggtgattaacggatggttgaggcagctccttaggcgactttagcctgccctgtggaacatccctgcgggggactccaaccagccaaagcaacgcggatcctgagagtgctcctgggtaggcacttgccctgatgggacgccttgccagagcagtgtgtggcaggcccccgtggaggatcagcacagtggctgaacaccaggaaggaactggcatttggagtctggacatctaaaacttggtaagacttgtctttggaacttgcccactccatctgagtggaagcatggcctgatcatccacggtgtgcctttatcggcactttggttttggttttgacatggtttgaattccttgacagggttggtcttgggaatttgcctctaccatttgagcggaagcatggcctgatcacccatggcgtgcctgtaccggcactttggtttttgtttttgacttgacttgggttgcttgatactttggttttggttttgacctggcttggatttctggatactctgattttggttttgattttggtttggtgtaaactgcaaaagtgtgtgtgtgccctttttacctgttctttgttttgtgcgtgtggtgtgagcgtggtgttttgtctcaaagaagcatgggtcaggaacaaataagcccaccctactaggaactatgttgaaaaatttcaagaaaggatttaagggagattacggtgttactatgacaccaggaaaacttagaactttgtgtgaaatagactggccagcattagaggtgggttggccatcagaaggaagcctagacaggtcccttgtttcaaaggtatggcacaaggtaacctgtaagccaaggcacccagaccagtttccctacatagacagttacagctggttttagacccccttccccgccacagtagttaagagaacagcagcataagcggctggcagaggcaaggaaagaccagcagagagaaagagaggaaaagacaggaagagacagagagacaaagaaggagtcaagaaaagagaaagagagacagagaaagagagaggcagaaagaggaagagacagaggcaaaaggaaagtcagagagagagagacagaaagtcaaagagagaaaaagagaaagaaatatacaagtacttaagaaaaaaacagtataccctattcctttaaaagccaaggtaaatttgaaacctataattgataattaaaggtattcttcgtaaccctgtaacactctaataccactttgttgtcagtgtagtcagtgtaaacaagggcgtatcccgaaagcactgaggccttcctatcaaaaatccttaacccagtaacccgcagatggcccagatgcattcaatctgtagtggcagctgctttgctaatgaaaaaaaaaaaaaagccatctataccaattctaagttaatttagactaaacaaggtcttattaatagcaaaggataattgaaatcccaaactaacaaggttttcaacaaaagtaaagtttgctaaaagttaacagtgtaacatgtattatagtaacttctaatcttgtggccttagacagtctagtccacagacgtaaagaaagttcacttaaaaaaaaaaaaagaatggttatcttcaaagaaaaaaaagtggagggaggcaaaatttatgtaaaaagagtgttatatagtaaattcttgtcctgaaataaattaaccggttgtttaaagaaaaaaatgtttgtaataagtcagaaagttgagacatgttgaagaattatctgtgaaagtcatgaaagaaaaaatgttataaaaaaatttatgcaaaaaatgttgtataatttaaaagtaataaagcctcctgagtactattaaagaaacagtttatgtgcaaggtgtataaggaaagtaaactatacctttggtaaaaggattataaggaggcataagaatgtggatttttacctacattaaaaggttaaaaaaaattattgctttgaaagtttaagcaagttttaaaatgttaattgtaaaaaaaaaaattctgtgtgtaaacatgttagctaaagttaaaaaggtatcattcagtttttctgtgaactggacattaaagtaaaaatgcaacaggtttttcttaaagcaccaacctgctctttaacaaaaattatgaaaggttaaaaagagtctataaaaacttaccttatggtcaaacatgaaaaattggataaatatgtctacaaggttttattaaaattaagtttaacgttaataacacactaatataaaggtaaaatttagcttatctggtataaaaatcatataagaagcattattaaatataaaatggtgtttagctttctttggtctaaaaactaataaaaattggtgctgaaggaaacattcattttactagaggatgatagaagttaaagacttaaaacaaactttggcaattaagacagcataccaagatgcaaatgcctggttggaatggatcaaatattccatctgcacattaaacaaaagcaattgttatgcttgtgcacatggcaggccagaggccctgattgtccctcttccactaaggtggtcctccagtcagctccatggtagctcttttccgggattctacagcctggagtaataagtcatgccaagctctctctgctatatctcaaagtccagcaccctgcggggcagcccctgagggccatccagcttccatctcccaacactaggttcacttcgtgtctctcacgacagggaagaaatttagcattccttggagacctgaaaggatgcagtgagcttaagaattttcaagagcttatcaatcagtcagcccttgttcatccccgagcggatgtgtggtggtattgtggtggacctttactgggcactctgctgaataactagagtggcacttgtgctttagtccatttggctatccctttcacgctggcatttcatcaaccagaggaaaaaaaaaatggcagttggagttttaacccagactgtaaggccctggccaaggccagtggcctatctctcaaaagaattagacagggtttacaaagtctggcccccatgtctaagggccctggcagcaacagccctgttagcacaagaagcagataagctaactcttaggcaaaacctaaacataaagtccccctgtgctgtggtgactttaataaatagcaaaggacactattagctaatgaatgctagactaactagataccaaagcttgctctgtgaaaatccccgcataaccattgaagtttgcaacaccctaaacgccaccacctcactcttggtatcagagagcccggttaaacataactgtgtagaggcattagactcagtttattctagtgcgcccaacctccgagaccatccttaaacatcagtagactgggagctgtacgtggatgggagcagcttcaccaacccctgcaaagtgactctgaagaagacgacaagccctgcttcagttacacccggaagctgactggtccacgcatggccgaagcatgaggaaactcatcgcgggactcattttccttaaaatttggacttatacagtaaggacttcaactgaccttcctcagacgaaggactgttcccagtatatacatcaagtcactgaggtaggacaaaagatagctacagtcctattattttatagttattataagtgtactggtactctaaaagaaacttgtttgtataatcctattatatccaaggtatgtagcccagtctctaaatgttatgtttgtggagaaactgtaatagaagatcaatggccataagaagcctgagaattagtgcctacagacccagttcctgatgaattcccggccctaaagaatcaccctgatcatttctaggttctaaaagtctcaattattagacaatattgcatagctagaaaaaagaaagaattcactcattctgtaggatgacttagttgcctaggacaaaaactgtataataataccacaaaaacagttacgtggtggagttcaaaccgcacagataaaaatccattcagtaaatctccaaagttgcagaccgtttaagcccacccagaatcccaccaggactagacggctcccactaggctatactagatatgtggacatagaacctacgctaagctgcctgaccagtggacaggtagttgtgttattggcactattaaaaccatctttcttcctactgcccataaaaacaggcgaactcctaggcttccctgtctatgcttcccgcaaaaagaaaagcatagctattaaaaaattgaaaaataatgaatcgccccctaagcgaatcatacaatattataggcctgctacttaggcactagacagctcatggggataccagacccccatttacatgctcaaccgaatcatacggttgcaagctgttttagaaatcatcactgataaaaccggtcaagccttgactattctggcccggcaagaaactcagatgagaaatgctgtctatcaaaatagattggctctcgactacttgctagcagctgaaagagaggtctataaaaaatttaaccttactaattactgtctacacatagataatcaaaggcaagtagttaaagacatagttaaaaatatgacagaactggcacatgtgcccgtacaagtgtagcatggattcgaccctgaggccatgtttagaaattggttcccagcactagaaagatttaaaactcttataataagagttataatagtaataggaacctgcttactgctcccttgtttgctacctgtacttcttcaagtgataaaaagcctcatcgctaccttagttcaccaaaatgcttcagcacaagtgtactatatgaatcactatcaatctattgcacaagaagacagaagtggcgaaaataagagtgagaactcccactaataaaaagtgagagtctcaaagaggggaaatgagggaagagagaccctctcatattgttttatattgttttatactcagaaaaggaaagagaagcaaaactaaaggcaggtagcctggcgcctaggaaccagacccgaaaccaaggaaccagacctgaaaccaggcctgggcctgcctgacctaagcctggtagttaaaattccacccttgacctagcaactgatgttatctatagattatagaaagacattgtaaaacttcccggtctgttctgtttcactctaaccaccggtgcatgcagcccctgtcacgtacccctgtttgctcagtcgatcacgaccctctcacacggacccccccttagagttgtgagcccttaaaagggacaggaattgctcactcagggagctcggattttaagacactagcctgctgatgctcccagctgattaaagccactcccttcactatcttggtgtctgaggggttttgtccgcagctggtcccgctacagtgagatgggaaattttttaaattacatttttaggctgggtgcagtggcttactcctgtaatcccagcactttgggaggccaaggcgggtgaatcacttgagcccaggagctggagaccagccagaacaacatagcaagacccccatctctaaaataaaatttttttaatttttaaaaattacatttttatattatcttattagtatatgctcactgaggaagaaaacatttcaagcaatacagaaatgaatataaataaaatgttaaggttcttctcacctccctgttactcatagttgctagaggtgatcatttgaaaacgtggtaggctgggcgtggtggctcacacctgtaatcccagtactttgggaggccaaggaaggcttacttgaagccaggggttcaagaccaacctggcaacatagtgagaccccatctctgcaaaaaaaaattttttttaagtaactgccttttaatagcaaaataataccatcctaatctaaccacagagttaaaaaagaaagaaagtgtggtgtatatgattcagaccatttgttatctttatacaaaagtgactatgtgaaattctttgtttgtatttaagctaacgtgggattatattttacaaagtttttgtgaacttgcattttgtatttgccttgtctatagagcacagatacaattttatcttggtccttaaaatctagctaaatatcccataactcattttttccttctccaggatttctgttataaattatgcttctgtggacattctgtacatgtgttcttaaatacttataaaagtatgtctgtaaaaaagattgatagaaagtagaattagcgggtcagagtgtatgtgcatgtctagatctaatgggtggagctaaattgccctcccttaatggtgaagagaagtatgctcttctccataccttcccaacatggtgtattatcagtctttaatgttttccaccatgttaagcaaaaaacgtgctatttgtcattgaaactgagcaacttaccttattgattagtgttatatgtttagtctatgagttgcctgtttttttctatttttctacatagaaattagtggtagtggaaacactttgtgtaaatacctataatacttggccaaagtagtactcagaggaaagtttatattcttaaattcatttgttaaacaacaagaaagattaaaatttaaccaaaagacagtagcagagagtaactaatagattgttagggaattattgagataaaagcagatagtatattgctgatattttatgttatgtgtgctacaccttagtgaaagaaagaaaagtaaaagtaaagaaaccaaaaggagagacttgatcattaaaatgaatttgtatttttttaaagatttctgacaattttgatcaagaaagaggaaaaaaccgctacatatgaagatgctataaagaatattgttggccgggcatggtggctcatgcctgtaatcccagcactttgggaccccaaggtgggtggatcacttgaggtcaggagtttgagaccagcctggccaacatggcgaaaccccacctctactaaatatacaagaattaggccgggcgcggtggctcatgcctgtaatcccagcactttgggaggccgaggcaggcagatcacaaggacaagagatcgagaccatcctggctaacatggtgaaaccctgtctctactaaaaatacaaaaaattagctgggtgtggtggcacgcgcctgtagtcccagctactcaggaggctgaggcaggagaatcgcttgaacccgggaggcagaggttgcagtgagccaagatcactccactgcactccagcctgggtgacagagcaagactctgtcttaaaaaaaaaaaaaaaaaaaatcaagaattaggcgtgatatcacacacctgtaatcccagctactcaggaggctgaggctgagaatcgcttgaacccaggaggcgcctcttttttgaggctctgtctcaaaaaaaaaaaaagaatattcttaattgtacattttaaaataactaaaagagtgtaattggattgtttgtaacataaaggataaatgcttgagagtatggatgccccactctccgtgatgtaattattcctcattgtatgcttgtatcaaaacatctcggccaggcgtggtggctcacgcctgtaatcccagcactttgggaggccgaggcgggtggatcaggagatcaggagatggagaccatcctggctaacaaagtgaaaccctgtctctactaaaaatacaaaaaatttagctgggcatggtaatgggcacctgtagtcccagctactcgggaagctgaggcaggagaatggcatgaacccgggaggcagagcttgcagtgagccaagatcgcaccactgcactccagcctgggtgacagagcgagactccgtctcaaaaaacaaaacaaaaaacaaaaacaaaaatctcatgtaccctactatgtacccacaaaaatttaaattaaaaaaaatttttaaaattaaaacttcaaaaaagaatatagccaggcacagtggctcacacctgtaatcccagctcttagggatgcagagacgggaggatagcttgagcctaggaatttgagacctgcctgggcaatatagtgagaccctgttctccacaaaaaagaatagaaaaaagacaaaaaagaatatataacctcaaattaagagattttaaaaattaataataagatgatttataggaataagttttatgtggttaatcagagttgctgccatcccctgggagcatttagaattgttttgggggcgttttggtccatcacagtgactggttaaggtggggttgctactggcattttgcgcctggggaccaggaatgctaagcatcctgtactatgcaggacagtccttcacagtgagtaattttcctacccagaaatgccatttgtgcctatagaagaaacaaaagctggcagaagtggaaagccttaatagatctatgaagtagaaagcccatcctccaaaaagacacaaggcccatgtgattttatggtagttttatttaactgggtattcctgttgaattatttcaaaagtagaaaaagtcttctgaaatcatcatacagggcaagcataaccaagagcagtgattcctgttttgtatagcgtagtcatttatttctctttcatgtttaactctttgctcgctggatgttctggacatattaccacttggagaaatagtggacaactttccatgtttgatagtaaatgggaatgtagccaagagctctaaaagccatcttgttctttgtggtgcttttttgtagcatccactaatagtgcttgggtccaggtgaagtggtacttaacagaggacaatcatgaatgattatctgaagacagtgatacatgtggactttctggcgtgcagttacacttcagaggtttttgagattaagtcagtatttctgagagctacgcatttgagtctgtgcacagtttgtgcatgagtatgaagaccttaatccttccaaaggggaggaaacggtttttagcttctacctctactcctacatcagagtaccaattccttagcctttggggaattctggagtgtaaatcttggcttttccctttgccagttttggattgttttctcaggtgtgcttccgtctgtagtcccacttttactgttggtttaatgagatttcaggaagaagagaaaataggtacctgtgttcgatctatcatctttaccaagaagtccaggctagattttcaaaataaatacccaggagtatgtttggatgctttttccaaagggaaaacatatcaatgagacagtttgacaattaagccttaacttcagcagcttcctcttctctcgccatcttttttttaaatagacggggtctcgctccattgctaggttggggcacagtggcacagtcatagctccctgcagcctcaagctcctgggctcaagcaatcctccctcctgccttagccccctgaatagctagactaaaggcatgtgccaccatgcccagctaaaagtgttttttagagatgggttctcactgtattgtccaggctagtctcaagctcctggcctcaagcaatcccacctcaacctcccatgtagctggggtcacaggcacaagccactgcactggacttttctcaccttcttgcattagaggagctcctgcacaaagtcctgctgaataactgtcttcttattattaatttaggtttctgagttggaatagttcaattttctttccattgtggaacaagtccaagccttatgaactgtgcttctaagttttcctccaccatatgtattgacagccatttatatacatgtatattatgcatttatatatatgagacatatgtaaagtaactgaaagatgacagaatatgttaaattcatataaaagtgattttggtgtccaaaagagggataaattatgtcagtgtaagagatcatggatggctttattaacgaaatcacacttgagctgaacccctagatagagttatacctgataggcagaagtaaggaaggagagagcattccaggcaggaggagtggcatagacaacagtgagatgatgggaggagatagagagaacatgtctggagaatggtaagagtaatccggtttggctggaacaaagggaacttgtcatagagcattggatctccaccgtcagtgtttattcccgagacaatgcagtgttgttgaggctttttgaatccggcgacaggacaggagccacgcttcacaaatatacaattgtggactcttagattggttagactgggagagactggaggcgggaatgccctaaagtcaagagacttcacagagtctctccaaggtaattggagcccagactagagggggagtaggaagttataggaagggaggtatgaatgggagaagtatagaagaagcagaattaacaggaccatggaacaaaatgtataggaatgaggagaggaatttgaggatgattctgaggtttgagcttggttaattgagaaaataatgtacaactaacagaaatagagaattgagggagggggcatgtttgagggatgatattaaatccggtttcaaatgtgttaagtttgaggtgttttaggtaccagagaacatccaagtgaagatacttcataaacacttggaaatatgagtctgatgagagatgtgaaggttagaaatacagatttaggagtcatccaagttgaggtgattcttaacgttaaagagaacccaggctgggcgcggtggatcttgcctgtaatcccagcactttgggaggttgaggtgggtggatcacttgaggccaagagttcaagaccagtctggtcaacatggtgaaaccccatctcttctaaaaatatgaaaatttactgggtgtggtggtgcaagcctataatcccagttacttgggaggctgagtcatgagaatcatttgaacctgggaagcagaggttgcagtgaaccaagatcacaccactgcactccagcctgggtgacacgagcaagactctgtctaaaaaaaaaaaaaaaaaaaaaaaaaaaaaaaagtccattgctgagagacgagagagattgaagaggtccaaaacagaacttagcctgggcaacatagtgagatcttgtctctacgaaaataaaaaatttttaaaaattagctgggtgtggtggtgtgcacccgtagtcctagctacttggaggctgaggtggaagaactgcttgagcccaggaggtcaagcctgctgaactccagcctgggcgacagagtgagaccctatctccaaaataataataataattttttttttaaagagtagagcttatgtttagaggcacaaggggaaagaaacataggaagataactgggataatgcaatatcttaggagctaaggctgaatgtgacagaaaaccctcaataactctggttgaacaagatagaagtaaagagtgctgggctcaacaacagttcatgaccattaaggacccagtccctttctgccatctcatggttcaagatggctatccaagttcaaggcatcagcatgggaaggaagaaaggggagaatggcactttaaagatagttcccaaaagttacacatgccactttcacttataacccactggccagaacttggtcatgtgtttacaccttgctacaaaggaggtgggaaataattgtctttattctaggtggctgtgaacctgtctaaaagtcccataaccaaggaaggaaggggagagtgagtactgggggcaatggacaaacagtatccattgatctagaaagagctagaaggatgaaaactagaaaaagggttaggcagttagaaggccattggtaaagcctaaatggggtctaatttctaaggtaggagagaagtgatgaaattaccccccaatttttacatggtgttgagagtagtcattaaaaaagtttgatctgtcttctcgggaaattggtgtgattgtcctccaaaaagtgcaggtgctgtgggtaaagatgatggcttaaagagagcagaagagatgaggaaatcgatcttacatagttttcaagagatgaatgaaaagctcactgagcctggtaatcaagctggcatttgaattattgctctagcacttactggatggtgactattatttagggaatcatttaacttctttaagcctcagtttctacatgtagaagggatactaattcttacctcatggttgttgtgaatattaaaaagaaaatgcttggcatagtgtctggcacagaaggagtagtactcaataagtagtagctgttggaagccagctgagttaggtgaattggtagaggactcaagtcagttgtttcttgagtatttaaaagggctcaacattccagcaactggagaagagaaagcaaatggctatgaatacccactacaagaactggcagaagatcaaggggagcaaagacagcaaatatgctattaaattaggcatggttagaaatcgtggctggttggaagctgatccaggcaaagctggtatattgaaaactagggaagtttgggggccagaggtcagaggtccaatgacaggtagagaacagacgctttaggagttcaagaagaagggggagatgtaatgaggtaatcaagaccaagtcaatgtgaaacagtccgaagtcccaaagctgggctatacctatgggccccaaggtgagtacagatggctcctaatctgaagattctccactgtgctattacatgtaatcccaaaccaaacttataagaatactggccttccctggcatttgagttttattctgcctctttaaaagggctactcagaataaatcagtctcctttgcagagtcaggagaagggaaaccagcctctctgtgcagtgttagcatgatgagctaagagttcagaaatgactgtaaatgaaaaatggtgataatgatagcagctatcatttactgaatgcttcccacgggccagctgccatgctgatttcctttatgttgattatgtcattgtatatcttgtgacagatcttcagggtaggggctatttttgtccctgtttcagagctgaggaagaaaaggttaggtattggagctgagacttaaaccctagtgtgactgaatccaaagcctgtacttttaaccatgaggctaaaaccatttcatcaaaagcctttctgctattcatgttcttaacatcatagaactggtagggactatagagaggtcctttaatcacagattcaaactagcctaaatcccaaagccctggagaatgcatcccaggcattcattttttgaaagagacctagagaggaaaagtcacggggctggaactaaaacatgggcttcttgaatccctgtctagctcttattctatttctcaggttgccgtggaccaaaatgaactctcagtctatttgtcttatcaaattgcagtcttcagcaagtgtctgaataacttggtcaggaccttccttccaggaagagcctggtgaccctctgaaagcagccatgtacttgggagttctcctgcacacccatggtttttgatgctcactatagtgactaggcagctggaggattccaatcctaatgatacggagaacacaaaacaatatgagacactgggtcccccagccttcttctctgggcctgaggggagatttgaattagcaactcctcacatgagctgcattctttagccttaatttaagtgggcagaggtgaatgaaaatgtgtaaatgttgaagtgttattattcaaaagcccttgagatcccatagctcatcgtagtaattaaaatgcagcacagaagaccccttgcttcagtagctcacagggtataaggaaaatgaatgaggatcacaagttgatgggattgggaattagcatgctggtgtgccatattgagtagaacagctggcctcgatgtatgggtagcataagaaacaggcctccctccctgtgtgccactatctccttgtttctctcctagaagggcagactgtggggagggcagagctcggggaacatgggaagtagtgtaggagaaaggcctaagggtctcttctgcaacttcactagtccctgggcgtgaggtttgttgcccagggtggtctctaactcctgagctcaagtgatcctcctctctcagcctcccaaagtgctgggattacaggcatgtactgccacacctggcccttctctgccttttctaatgtatttttacttctctgtaagcctgacaaggtcttatttctccttcagtgctcagctcgaaagctacctcttctgagaagccttctggttcgaagtaatcaggctttcctttttgtctgccaagcatatgatttatgcctgtcttaaagcatctattgaggcagacttggtgtctttattttttttattttttattttttggtgagacaaggtctcgctgtgtctcccaggctggagtgcagtggcatgatcacagctcactgcagccttgaattcctggactcaaattatcctcccatctcaacctcccaagtagctgggacagcaggtgtgcaccaccacacccagctaatttttaaattgtttatagagatgaggtctcgccatgttgcccaagctgatcttgaactcctgagctcaagcaatcctcccaccacaggctcccaaagcgttgggattacaggcgtgagccaccacacccggcctctttatcctcatatccacctgggtgcctcctgaggacagacacttcatacatttgtccatgggatgagtggttacagtgacagttctggggcctgtctcagagtttctcacttcagccctctcaccatattaccttctgtcccttccttctgctgttcagagttataaggatggtgaaggtaatgaatgcttgtgaagtgctttatatcttacagagtactttcatgtaccttatctttgatgatccttgtgacagacctgtgaggaacggagaagtagttggtctcatctgtgagcaaagtgtgttgtaacggaccctgtgtggaggataataacaatttcaacatctattgagagcgtggcatgtgctagacacggttcttaatgcattacacgtataatttaattaccgcaacaatcccccaattaagatcccagaattgcacaaagaagtgatttgcttaaaaactgcttcttgatcagtatattctattgttagcaccttgtccctaagagaccttatattatccttactttgcagaaggaagaaaccattgagtaattcttttcccacccattgatctgccaaaaaaaactcatcttggccttggatgtagtttttaatgggaacaagaacaccagccttagggtcttggatctcggcaagcttttcagataccaaagtgtctttcttaggaattgcctggctaagtcatatgattataagaatttctttccatcatttcttatattccacaaaatattggtggattgtggtttctctaataggattatgaccctcagagattcttcctccacatatttccttcctccgtaagtttccattctttccttctacccacttccttccccttggcatgtgtctggtattgagcccttggcatctgtctctctttcatcattgatagctagcatgaatgggtggctgtttcacagggcctgcattgttggctcccacagcagcagttagaacattctctgtggcctgggttctgaggtccacccaggcagtgtgagccaggctggcccccagttctgagctgtggtgtttcctttcattgttggtgccttagctcccagttgttaaatatgaagctggaagttgatacaaagcagtagaagcctgtgctccttttaccaaagtcatcttgcattcaaatatagtcagagggacattgtaccttgggccaggatctgtaggaagtcggctattagaatgtggtcccagagatggcaaattttacagcctgattaactctccccatcagcttctcctaggaagtactattgacctgaaccacattaaatggtcatgtgtcatcctcactgtagccccaccatgcaacatcactgggtagctttgttctggctgccagttgttatatgtaatattcgtagccatgagtcgtggcttcctggggccttggttaagctatatgaaactcttatgtaatcagcattccttcttccctagagaaaggattcaagtttttcagggtttgttcattgctcaggacctgacctttaagttgagttgaggtgtgaaagtcccaaagtggtcaagtttgaaagtcccaaagtggtcaagtgtagaggaggggcccaacacagtggctcacgcctataatccagcactttgggaggccaaggcaggcagatcacttgaggcgaggagtttgagaccagcctggccaacatggcaaaaccccgtctctactaaaaatacaataaaattagctgggcgtggtggcacacacctgtactcccagccactcaggaggctgagatgggagaatcgcttgaacccaggaggcagaggttgcagtgagccaagagtgtgcaactgcattccagcctgggcaacagagcaagacttggtctcaaaaaaaaaataaagaagtgtagaggagagagatgccaaagttggtgcttctgtgctcctgtggataagtaatcagagccataaagtggagctaattggctgcccctggccacttctctagactcgtgaaaagctgaacagactgtggagactgaactgctcttctggagctgggaggggagagggggcgatgggagaactgtatccctgctcagacctcagcgagttgggctcactgtgagagctggttgttgagacatttcttaaaggctgttttgaaaaaaccactgttgcaggagagtagcgtcatgcttgggcattggagactgtgttttagtacattgtgtttataaagcactgctcattttgcacccctcctcacctggctaccctctccagttgcagaactgaacctcaagaaggggctttgggccttcaggcatgctgatgagggagagtgggtgctgtgtagacagcaacaggagaggtacccaggcaggcatctcacatccctaagggggagaagtgtgccatcatgacatggtggagacctggattctcatcactatcatgacattaaagggatttttaagtatcatgcagcccagcccagtcactttagacgctgaggcccaataagatgaaatcactgccaaggccacacagctagagaacagctcagccaggaccagagccagatcttcaggcttctaggttgaagtcttctcctgcaccacctggggtaaccactaagactcctcatctgtaaacatagttgacccttttggttctaagattctctgagctcatgaatagttcttgagagttttgagcaaactagggaattgtttggtataggtgcaatagatcccacttatagagaaggttaagttgaatattatggaatgtgagctagtgctggacatagtgttatttactctgatgatgtgggttaaaatctttaatggggctgagttcatgcaaggaaagcccctgggtgtgccagtgtagtgctgatgttagattctgatttggccaattatttatgctacttcagggcgaggtatttgagtgtacagtagtagctggcctcatgagctagtagtgtcagatttctaggatgttagggaagtctcgagagaactgcaaatgtctcctggcattgacaaattagaccattttgttttcagtggatcaactaaggttaaacttaaacaaatatgagcagctgggagattttggaagaagcaagatgtgcacattctcaaaaaaaaaaaaaaaaaagagagagagaaagaaaagtctgtgctccctgaggaaggaaggatgaggcgtggaactcggaatggccccctccgaggaaggaagcagttatttctctgccgttttgtttctgttaaggaattccagaagttgcaggttgtggatcatgacctcttttttttttttttttttttttctgttgctgcttgccagaggaagggagggcgggtggcctttaaataacactttggcctttatggaaatgtatcagatgttccaggagtgggtctccctgctcgcgcttgctcactggtgctcttacttttgcttcatgttcactcactctgtcctgacttgtgtcctttctctaggttatacttaacactcttctcgccttatatagcaaggtctggtcgttaatgttaacagaaatctaacaacagggaaggctgccagatagcattaatcaggccagtgtttggaatttcataaatgctctgactttgggtacaaattgaacattaagaacaatatgaaaactgtcttccttcctctctcttcttctctcctctccccctccccagcctatccagtttctctctctgtttctctgtgaattcctctgctttgccatatgcttgctgcattggaactttgttgatttttgccacgtttaattttttatttctctgtctctccgtccactccaagaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacctcacaggcctgcccaccaccaacagccgctcgcaccctgaaactttgactcacacagcatctccgcaccctggtggtgctgaggaaggagaccggagtggggccaggagccgagcgcctcccactagcaaacccaaagctgaactcaaactcagccgcagcttgtccaagtctgactctgatctcctgacctgctcacccacagaggacgctaccatggggagtcggagtgagtccttatccaactgcagcattgggaagaaaaggctagagaagtcaccctccttcgcctcggagtgggatgaggtaaggccgacatgacgtcacagggagctgggctggccaggctggccgcagcccaccacagctcccgtgagtgccaactctcaggcccaggatctgggcaaggttgctctggttccttcactccgtaactaatgtatttctgacaatcgtaagaagaggcgagcctcaggtagtctggatcacagaggacaggtccttaatggttaaattagagggtggaggccccagcagagcagggctgagggaggggcactttctagaaatgacatgctgtttggaaatatttggatcccatcagccccattgagagaatcatgctcaccctggagatgcttaagagctggagtacttcctatgagtccttcaggagaaaaagagaagatccagggttagttgagaggtgtgaggggtgtttaggggaggacagggtaagtctggggggaaagctgctgaaagggggcttttcttttttatatatataatttcaacttttatggtagattcagggggtacatgtgcaggtttgttacatgggtatattgcatgatgctgaggtttggggtacgattgatctcatcacccaggtagtagacatagtacccaatagttagtttttcagcccttgcccccactccctcccctctccagtagtccccagtgtctattgttgtatctttatgtccatgagtacccaatgtttaagggagaacatgctgcactgtttggttttctgttcctgtgttaattcactcaggataatggcctccagctgcatccatgttgcctgaaaaggacacgagctcattcttttttatagctgcaagaggaaggcttttctattccctgcttctccatggttattcttactgtgctgtcctggaaggccaaatacttcttccagcagaagggtcctgcccatcccacattcccagattggtcaggcagaagagggataagtggttcaggaaatgaagattggggagtagaaaacattgggagtcagaggcccagttttctttcatagccattattagttggaaatatgtaccaatttctctgtgacctatggcatgtctcgctgagcagaagaatgtgtttctcaaagataggtaaacaccatgggaatgttaaagtaccacccttgcaagcttcttactgagtggaagctgcctttgaagtggactgggtctgtctctgaggaataatttcaagaactccatttagctctccaagaggaggggaacactacagctgacatgtccatttgaacaatctgtacacttaatgccctacccaactctatttgggtaggtgctggaaagttatgtaaaccaaagccaatccatttccagtgaaggaactgggttgggggtgggggctgtgcttccagcgctacctccagataaggtataagatgaagcttaagattctgattaggcagagacagaggaatcctgtgcaaaagattttcattgcttagtaaacaaagatttggtgagcctgtgctagatgcctggccacttgtggaaagtcactatgagtgagatagctctgggggaggggggtgccaggagattacacactggagtgtgtatatttgtaggaatgtatgctctacctttgttttttaaaacagagttttactaatttacagtcagctataggaaaacttcaagataaatttaagaggaaggtgaagataagtgcagtgtgctctgaaatggccatagaggtcaagagagaaaaacatcagtgactcttacccaggtctgagatttttaaaaaatcagtgggtgggggagtggagacaggaggtgtgagagggtgggaagagattcaggaaagaccactagagcaatgggatttgacatggaattaaaagactgagtcttatggttaaaaccagattgaagctggtgggacgaggagaggtgggtggagagagcggcatgagcagaggcatggagccagaaaagttcaggtcatttggtttttctagggtgctgactgtgtgtaagggcagaatgagaaataagagtagaaagcgagatttgcaccaggtagtgagagggcctcgagcatcaggccaagagatgagtacagccagccctccatatccatggttttctgcatctgtggatttagccaactgtggatagaaatatttgggggaaaaaataacaaaacaacaataaaaaataatgtaaataaaaatacagtgtaacaattacttacatatagcatttacattgtatcaggtattataagtaaactagagatgatttagaatatacaagatgtgtgtaggttatatgcaatgttatttcatgtcagggacttgaacatccacaggttttgatatccaaatggtgttctggaaccaatccctagtggatactgagggatgactcctggatatgctatcaaggcagtatctcagaatcctttaaacgggctggaagacagctttaccagtctaatgaatcacctcttctttatggctccttctgagcgtatcccaaaccagagaggtcagcagtgctgggcgattcttcacaggatatttatgtcctgttaacatgcagcatttctgggcagccttatgggctccactgtttcctcctggccaagaaatacaaaatcacctgggcaaagctgggcttaattgaggttggctgtgtgggctcgtaagccagtgtctctttgcatcgagaggagtttcatttgctgatatcacctgtgcagataaaggttgcaggtgcttacaatggcccagggatctacatctatccaagatctaggtgctgtgggccagttctctagtgtgactgaaatgcaaaagccctgctacattttaaatttgaaaaaacttaaaggcaattgaggtcttattggaaagaattcagaagatcaaggtttgcttacgtcctaaacattaacagggccctttatgtgtaacccttcaatgttgtttcttagtgatactgtacttggtttctgtggatatcactctgtaaagagaaactccaaaagtgtttcccccagtgattggccctaaacccagggccttggcaggctttcctggaatagggcattagttaatggctgctccccaccctatccctgaccagtgcctgtagccggctttgccatatcctgttcttgctgatttttttctttgttgtccttggacccccgggaggtggggaactctgctctgaaggctctgaaggtgcttgggcctagctcacctcttcactgtgagacctggggagggagaaggaaggctgtcgggtgggagcccctcaggctgctcctggaaagaagtgcaggaccacagatgggctcaggttcaggagtcagcagatccagcttcaagccccagctcctccatctccacctcggtgcatggactacctcagtaagctcactgttattattcttatttgtgaaactgaggcagttagatctgtgtttcagagtgttttaccaattagagatgtgtttaactgcctagcacagttcctagcatgcataaagtgttgactaaatggtagatattaatgttactatcttgcttggagctgcagagaatgggaactgaggactggagtgtgttcagaccttatgaaatgcagagctcaggccgggtgcggtggctcacacctgtaatcccagcactttgggaggccaaggcaggtggattacctgaggtcaggagttcgagaccagcctggccaacatggtgaaaccccctctctactaaaaatacaaaaactagccgggtatggtagaatgtgtcagtagtcccacccactcagcaggctgaggcaagagaattgcttgaacccaggaggcggaggttgcagtgagcggagatcacaccactgcacctcagcctgagcgacacagtgagactctgtctaaaaaaaaaaaaaaacaaaacagagctctttgcaggaggttctttgttgtttggtggtagcagagtcacggggaacccctggagttcaaacccttcaactggtgatcctcctgcacagctctgcctcactgcagggatgggagagcccacccagcctgagaaagtcaggcaggcaccttccccactgttctcatttgagaaattaatgagctttctgttgaactccctgagaggagaagagaggttggagagaaatctacagccttctctacaatttgtttttcaaatatattcttccacataatggccagcaaatggctggttggttgagatgatgttctccagttggggaacatgtatggctaatagatttgggagtcattttctccaaatacagactgctccttattgtgggttaatgcagccctgttgaactaccctgagcaacatgacttctgaaagatggcctggttaaggtaaacctctgtgatcatatctgttaatgacactagcattctccctattttctattgtatttttggtgacaaagaagtcatagagtttgcctttaaaagagctcagcctaagaggagatctgaatccaaacttcagtagttattttctgtgttctccagtcaagtcaaagcactctttgttgtcttaatgatgcttgggacataatagagggcaaactgagaaggtgtacgtaaataaaattttaaaaatatacagataaggagtgggaaattcacccacatccctccatgcatacttaacctctgttaacattcaatacatatccaaattcggagtcttagtgtatttactgattataatttgcttttcttacctaataactgcacgttgtggatatcttaccatggcagcatcaataagacctggattcagatcgtcattctaaaaaggctgagtattctcttgtatggctatatcataaggttggttagtttgttgttgttgaaacttctccaaccattagatactgcacagggcattttccacctgcccttcaggtccagttcctacccttttctatctgcttatgtgtcgtgcattaataggccaaggggttgttggattggttttgtccctctactgaaagccaccactcctgggagggaccttctcccaatagctgttctctctgggttctagtaaacagtccttccctttgacccttctgacctaaggctcctcactgtgactagctcccctccctgcaccttacccaaacctgtgtaaataatcccattactaagttccttcaggtgcacaatttgtgccgtcttttcctgcagggaccctgagtgatacagcagtttttggcactgtttctatcaactctgagcaagcatagatggctgtatgctggagcagtaaacatgactctagcatgtaaattgtaaattaatcttcatttgcaaatgaactgaaaggcttagatattcagggtgctgggaagcaggagaaattcatcatttaactggaagcaccagagctgtggcagtagagtcatggcgggaccagcatttagaaagtttctttcactctttgactgaatattggttgaaaggagtgcagctgaaactgtaaccaaaggaggcattatgcctccaggaaaatctcagggagaagtatcacaagcagcagtggtagctgttggatcaggctctaaaggaaagggtagagagattcgaccaattagcgtggaagttggagacaaatttcttctcccagaatatagaggcaccaaagtagttctaggtgacaggattatttcttatttagagatggtgacattcttggaaagaatgcagacagaaataaatcactattgaaatggcatcacgtgaagctgctccttccactgaagtcctaaaatatttcataatataatttccatgtctttctttataataaactaaatttctaaattttattttaaactttctttataataaactaatgatatataaagtaatggcatccagtgtctctaaaactttgtttttctgcactgatatagacatctccaaataaaaatatgtaaatttaacaaaattaaaaatccaaaactttaagcctttcccacttcctactataagaaagaaacctgttctcccttcatcaagctggcagtgtcctcagcatctcagctgtgtgttcctgcggcagagtctccttttggtatgtctttatcctctgtctcttgcacagtgtgatgtacccacagcacacacacacagcaccaattaacatctgagataaataccttgtaggaataacaaaaatggctttctggtcatattgtggtttgaatggataaaaagtttgtgatgaccagattagcctctcacctgcctttgaatgggattaaagtttatgaaagagaaaaccacagaaggctgtttgtctacttagcataaacattggagtcatttaaaacttggctaaaggcttaaatgataaatttgtgttttgtaatcagctttcataaatattaaataagtgggagatgggtgaagagcagggacatgctttgtatgcattttgtataagatgagaataatttctggcacaggattttgggaatgtcctggctttgtctgaaatggtagctgaggaaacccttggctcttgaatccttttcctgagaagtgaagtggcagcaactgggagggcaccctttcaggccaagtccagaagtggcctcgccacctcgccctttccagctctttctcattagaggcatgatgtcatcaagagacaagctgattggttcaactccatagaggctttggctgcttttaacccttgggggttaggtgtgcaaaaagaagaatgtaaaataaggagatttgcatttccactgatgatgactaaatttcccacgccatattctgcaatgtgcattgttcctctttatgtaaacaagcatgctgtgtagtcttttgtgctgagcaaagccctcccgccctgaacaagaatgtgacactcctacctctggggaaagattaggacctggagtgtctatttaagttgtttccaagtatacagagtagtcacaactgttatcctagatgaaacaccctttatatttccattggctttaggtggtctggtaatattgaggtaatttgttcatatttttaaaataatctcatttattttataggcagccctaaataaacagttttggcctttctatcaaagtgatttttgttagcctagattatatatgtgtatacacacacacacacacacacgcatatatgtatgcgatgtgtgtgtgtgtgtgtatttatgtatgtttatatgcatttccatggccttgatgctaacaggagaaactccacggtgttgtgaatgagcgggagttagtcctggctctgcaattgactggtgatgagaaaactggtgtgttcagcacctctctctcccgcttgctggtcccttgctgccatcacgtctctaactggacaggtgctggaaagcggggttgggggagtgggggaatgcaccctccctgctgctgccacttcacttcccaccgatgcatttccccattgctgctgtccctatctgttactcatctgtttccctctttctttttgcctttgctctttctccccttttcttctatgcttttttgtctttttttcttcctccctacttttctcattcatttttccttttcattcttatttttacaggtggagttaaggataggcttctcttctagcctctcagccctctgtaccagagggattttgcttttattttttctttttaacattttttccagggttgacccacatttctattctgcaccagcatttctgccactcgtggtatccgcaggccaccacacccaccgccagccccagtcccccactaaacagcctggttccctttagctgcagcaagagggcaccatcaagcaccagggagggagctggggtatttgcaaaatcaccagcaaaaggagaattttccttttctcccttttttgttatgttacaaactgaaagcttgggtgacaatgaatgtaggtgactatagatgagaggaatttgacctttattccagtccatacaaatgctgagaatcagagaaggaaacattttctgggatattctttttatactttggttctggttttgtatcttgtttttctagtaaagtatcagtaggatacagagtgcgtgattttgtatgactttgggaataatagttcattttatattattctaagcaattgtgtctaagaacaagtagaggtattttacataatcagtaatagtataaaattgaagtatatttgtattacagttacacgttcagctaatttgttgagcacctgctctgttccaggtaggctgtaagtgctggggatacagcaatgaacaaaacagacaaatcctcttgccctcatggagctggctttctagaaagctagaggggaatgagaatttaaaaagaatgaataggtaaaaatcgtagtatgtagttgatgatgggagtggttatgagaacaatacagccaagaacaggattagagggtgcggtgggaggattgctgccgttaggtgagtcagccaaggaaggcccctttgaggaggacgtgaaggagcaagctgtgcatgcttggggtggggagggagaagcatgagtggttattgggctactttctcttaattaatttctcctgtaagagaaatttaaaatcctaccctacacttaatattgtcttacaaatataccttataacttgacttttacttttaacttcctttttctttagtcatgattgctacctgttgcctttctcatcttggtttttttccttgatttctttattttaagctgttgggtgcatgcttttaaacatgcacatacccacatttttaaaaagctattgaactagaatgaaatcataatttctcaaacttgatcattgttcttgttgtcatcctaggcaaggatgttgggtgagttctggcagaggggctgggttataggtcattgtcttaggaaatgcctttccataagctcattgcatactcaaggcagaaataaaatctgaaaaccaggatcacgaagcaaagggaagagaattcaaaattactaagaccagaagatggccagaaatctcagaaatgggagatccagtgagggaggccaactgattgggtgttcatggaggcagggaaggtgagttgagggtatgccaccaccacttggaacacagaaatggtgctgatgtcctaaaagagcactcaccacaaataatttgccctgatgaatcttaaatacatcctctcaggagccaggcccataggtaattacaaccagtaagagagggagatgctggtggcctcagacattctctgatcctgggtggacttaggggacatcagggtagagggagcttcttagagaccagatatgaaggtggtctgtgtgtatgcatgcacgcatgtgtgtgtatatatcccagagaagtttaatttgtttagagatatgctgtgtggtcagagtggcagccagatggtgggggataggctttttattatgtaagactctgagaaaacaattaatctggacctcatttgcacttcctttgaaatgtgtgaccctcagaaacaacacagggtcttttcctgaccccagtgttatgccagcatcctcaaagatgtgctctctgatctcagctctgtgagatgagatcagatcatggacgactaccctccctgcctagggctcctttatcctgctttcttctccatagatgttcccttttgatgctaccaggtgagtagccagtgggtaagaagaatgtctgtggcctgtagctgctgggcagggccaagatgctgagcgaatctttcccaggtatcctactcttgctcacaagctctaatgacccagtctctggcgccacagggcccacctgtccataactcaaggcagcctgttttatttgcctggacaggtggaaaactgcctaagctcactaggtgcctacaaatgacaatttatctggcagtctgttcttggctgtcctgatttaaacaggcaagaagccattgtaaactcagctgaaatgttgtggtttgtgtaaatgttctggttcctttcctttccactttggatctagttattttcaacagaacttcccccaaaagcatggaagagccttatatccattatgcagtgggcatacagtcctggttttgcagcttgggccctctgtactgggccaaaggacagtgaagagtgccgtggaacttgggtgcagtggcagaggactggcatcccatcttcacactgtacttcaagggtggagatctcccagcctcaaggtcataggctgtttctgtgtccttggagggaatatatagcttaacctccatatctaactgtatgtagaaatctaggcaaagctaaccctagaaatggaatgtttataccttagggattttgtatttttaaaattataatacctgaatctaggtgaaattttaaaggtaccaaagactatatagtgaaaaataagtcttccagattttcagttcttctccctggtgttttgaatatccttccagaaatattctctgcatgtagaagcatttctgacatgttaagcatttttctttttaaaagacaaaatggtgctgtctcatgtgtactgctctgaaccttgcttttttcatgtaatagtaattttttgaaaatcattctaattgagtacatgaagttttcttttttattgttcataatattccatggtgtgcatatactatcatttatttttgtttcttgtaggtggacattctacatgttaccaagcttttactgattaaagcattgctgcaatgcaaatccttgtacagagtcattgtaagatgtttctagaaactgaacagctgtgtgaaagagtttgtgcgtgttaaatttactttcctacccacaacatgtaaacaccttatcaacatgagggtggtcagccttttagtctctttttggttaacagattggtaatgttatcttatcttgggttagttttaaagtgtgtttcttattatgagtgacattggcatctctttatatgtttacaaaacactactttctatattccttttctcttttttttttaaacgttgttattgaattgatctctttgttactaatttgtagaagctctttgtatttgagaaaaattagccctttatctatgatatgatttgtcttttggccttgtggtatttttatgttttttttaacatgtggaaatttagaatttttatgtagttgaatctatcaatcttgaatgacttctgctttttttttttttttttttgagacagtcttgctctgtcaccccggctggagtgcagtggcacaaacttggttcactgcaacctccatctcctgggttcaagctgttctcctgcctcagcctcctgagtagctgggattacaggcacctgccaccacgcccagctaatctttgtatttttagtagagacgaggtttcaccatattaggccaggctggtctggaactcctgacctcaggtgatccacccacctgggcctcccaaattgctgggattacaggcgtgagccacggcgcccagtcgacttctgcattttgtatcccagttaagaagactttccttactctaagattacaaatatatgtatattatttgtatatatacattatatatattattacatatacatatataattacatatataatatatacttatatgtaatatacaaatatatattatttgattacaaatctattttttatatatatatagttacatattctatatatatacacacacacaaacacataatttcctcctgatattttatggtttcatttttcaggtataaatctttgtttcttcggaattcattttgctatgaggagtgctagacatcctgttgatttttagcaacaatttgatctagcccactatttgattcacttttcctggtgatgaaactaaagctttgagagctgaaatgacttgcctacggtcttagggttgataaatgtgggaaaccagttggaactacatcttctaaggattgtatttagaatataggtgagctaaacctttatttcagcattaattagcagttacttttcatttcctcttgtttcaacccaaattattgcagctttatcttactttttccctctaactgcagacaaaaatattggtctttgtgtatgaaggaaagcaacttacgaaaggagtctcctgggagaagcatgtgtttccttttttaccgtaatattaagactcaaagcatttcttccctttactgctctctaagatggggggctgttaggtttttcttttgtgacttgaaaagtgaggtgatgatttctggcaaattctaaaatttggaatttggaaggaatcctagttaccatgtagtccagctcccttatgaacaaagtcacttctgtgttgtctaaaagtgaccttctttactaccgtacttgactggtttaaaaataataatagtaactaactaaataaataaaaatgatcttccaacttttgcttgtaaaccacaagtaaccccctctaccatccaccgttacgtctatgaaataatgaaaaatcctttctcatatccagctaaaatctgtgacttccaccccatcaattctggttttaccttcttggtaggtcatgcatgcagtcctccataatagttgttcagatatttgaagctgcaattatgtcctcccaccctcaaaccttctcgtttccttgccaggcaggcacgccagtttcttctctctcacctcagatggcttattttcaaactgcttttgtcccggcccttcggtgaacatcctcttgaaatcgtatgacattgttacagatgcttgtacataatgtacattgcatggtacactatgatgagatttacatgttgcaggccacctgataatgcttcatcaaggggtttgatgcgcatcttagtctcctgaaaacttaagggttcaatctgtccgtgagcccaagtcaaagacagtgtgcacaatgcttccagaggtaccacacctccatcaggaggccatacagaaagcggttctgtggagtggaggtgtttgttgccttttaaagctttatcctgtgatttctgccctggagatacagctcagcctcttccctgttgtgctcttttggcaaaatcaatgtagcttttccccatgtcccatcacataacagtgactctacctactctccacctaacagcgtaatcgcctgctctgggcccatgagacttgctcaagcattttttagcagctacatgactcactatgaccttaatttgcaggtaaagatgcttttgtaccaatttttcatttgaaatcaataggacagataaggcctgagaaagcctatgttgtctaaatgaccctgagccaggccttgtaaagggtcactcaagtccccttgtgctcttgaccagaacccttcctcctcctccccattttgtgccagtcgccagggtttccttccaaaatctctctcctccattcagactcacgtatctgggatcctcagcggccaccacctcagtatctccctgcttgcctttgggcttctctagctcatcttacttgtggctgccttaccatgttcctcaaatattttgtgttatcctcccttgactaaaaacatccttgcttccctattgctatggttcagagtccagactccttagcctggagtgcatgattcaccagagaatgagcccatggcccagcctctataactggccttctctttcatctcataccctatttttccagctcagttaattcctatactcactgttttcccctacacgttggtttatactattctccctacttgggtggctttctccatttctttttgttgaaattccactgttcattagaggcttagtcactcattcaccacactgatggagagcctactgtgtgcttaggctgggcatacagaaatgaaattgtaaacaaacatgcagcttttgagggacttagaccctaaagggagagatagatattaagcaagtacaaataaaaatattaccacaaatgaaaataagtgctcttgaagaaaaggagcagagtgctgggcaaggtgtgggaggtgaggtgaggccccattagatggactggccatgaggcctctctgcagtcaggcttagggaggctgaaggagctcagtagcccagtaaacagtgttggggctcaggagaggatgaggtcaagtctctgtctgccataaaacctgcccccttgcactttgagcttgacaggtctttccatcagcagctctttccgcaggcactacatgctttgctgctcttgtttgtgtgtgtggcccttctccccagtcagatgagagacctttccagagtagtaatcacagttcatttttacaagccctgcggctccccagccccaaacgggtgcatagaaaaaatgcaagtccttgattaagggcctcagaaagatgtgggatgtcctgagtccttaaaatgtcatgttttcccccaaagaactcaaggtgtggattgctaaagacttgctgcgcttgggcatagataggtatctgtttttcttcttcttgagggagatataataattaagcccttctccttcacctcacccttaaatttggaattttcttttctttttctttctctaataataaggtagagcccttttttatgccacaactgagagattctaaagcatattcagaataatttgcttcatagatgtgagcacagaaatttacagattttgggagatgtatactgaatgtcttatgactttctcacttaataaattaatcctccctcacccattttttaaaggtaaaaatatttcactaaaacaagctggttcggaaagggggagatgaatttggcatttaaatgtcaaatatgttttaagctaacttcattcactgcccgttcctgcctccatatatagttaacatttataaagaatgcaaatagaatcccccttgataatgtcacattggtgttaacagtctttctgcttctaagtatcatatacgtaagtcaagaacagaaatagtttggacagttcttggcccctattattccaaattagattgaaagaagaaaagaaccaaaccagatatggtatatttctgttaaaatatcagctcctgctcaggtagctccatatgttcccacaggtctccagaaggacttgctgcagcagagcaaagcagaactaagcaaatcctcagctgggttcatgtgcttacagccattacgggctttacaggcacttaatagagcagagagttcacatctcagacatgtatgatgctggtggaattcatttggttaaagaaaaatttttccaaggcccattttttaagaatcaaaaatattactgctgatccccaaataaggtctttgatgagtctctcctgttggggtattaacctaggggtctggccatgctccagttcagataacgctgtttctctgtactaaattcttcctgaaggttcaattagattttggccttctttcatcttgggcaacaactcaagaactgcccatttctaaggcaggagcttagtgatggatgcatttgtttcaccgctgacaaagattccaatgtaaaatctgccaggcccttgaggatggaaacagagattgatctcaatgaagaacgagtctattggtcctcatgcagagatgcattaacgtctctctgtgctctggaaggggttcacttccccaggtggacctgagcaggctggatgttgcagcctgttcagcggcaggatcgggccctgttcctggaagagagctccactaaggtacttgttagaagtcatcagtggtgttaacactcaggttcctttggtcggtggttccacaaagcaacatttactcagcacctactattgccaggctttcaactgctctatgtggcattatgagaacataatgttgcaggtttaggtttgctgtgccctttttaccaggggtgtgtctgtgtgtctgctgatgaatttcttagaggtatattagtttgctaccttggtaccttttgccacttagttttgctttctccttttcaaggaacagcatatgtgtgtttgtttcattgtagtgatccactgcaaattgtgtataagcttttgtgggtggttttctattttgacatcaccgtaagtgttttggttctttttcttgaatgtttgttctctgtctggagtcaaacccgagacagacttggaaagtgaatagtgtgggatcagctatcccacagtcactagccccagccttgtttttcagggacaccctaagtggcattggggaaggcaagtggacctgcagggcactcattgacgttagtcagagcatctgaaacaagaaattacaagattcctgggtctagacctggcttgtgggaagttctgtctgcatctggggagcaccatgtacccttgtcaaatttgtggctgtgccttttagtttagtttagacagtgcctctcacttacattaattaaaagatatttttaagcctttgtagtcttggtattactcaggccggtatcattgcatcatttgctaaattttatgtaataaggtaattgtgtctacatttcttcactgttgtgctagaaaaggaaataaaacatcataaatctgaagtgagcttggtcagaggcagtcagatctacaaaagtgaggccgaagagaggaagcctgagccgagtgatgattgatccctgtgacatcacagaaggacaaatgggctaaggacagacttgatcacgaatcctggcatcctgagccaaaacccagatgcaaaaacttaaaggggatattttacaaaaagtgagggaaacagctcacttgacactggtggcgatagcctgtgggactcattacccgcgagtaagtggcaaatgttggcttgggaacggcctcgccctgagtaacaggaagaaaggcgttggctggcctccctggagccctcttctcagctgcactgccagtggctgagcaggctggccggaccgtgcactttactttatcagcaggtatttactaggtgccaattatgtgtcaagcttggtgctaggtgctgggtgcagggggtagagttaaaggacacaattccttctcttaggaagtttccttgaaggaagttgagtggctcctgaattctatctaaagagggcttaagagcagccatctggttgaagtaggggctgggggctcatctgaatggtgtgcttcactgtttggctttgttttacctgttttatgtcttagatcaacaaaaagaattttctaaaatacacttctatttatatcttaaataagaataagaaaacattagttgtttatatgtaaaagcattttatttttattggtgttggcttggcaggaggctattgagcttataggtgggtaaatgtgccccaccccctgggtacccctcttgacatggccattgctggcctctgtttccaccctcatgtcacattgacacatgggtcttagggtagatgtttgttttgagttctacctcaaggctggctgcaaactgctcagaggttgccaacctgggcgagtcgggaatcagcctcacttctcagttccacagttgatttactagtcatccctggatatcagtttgtctttctgttaaacagaataaaacaagagcgtttcctgccggtttcctgtggagtgtggcaggccagtgcttgttggcttcattcagaaaccaggccttttggaaatacagagccatgtcctcagtgactgcccttcacaggtggctgccccacctctctccgcttgcctcctgctttacattcagagcaggaaagctgttagcacaaggttcatttaaaaccccagttgaggaggttatcatagcatccttaattctagtgaatggctctagttttcccttcagcagttggagtgattaaatgtcataatatatcaggggagtaccaattatgaacatggatttcatgctgggtgcttttacattctttgattggtgttgggcatagtactaacttaccttggcagcacctttaattgtggcattcatgaattgaattggactctgagcagctggaagggtctggggctgaggactgctgccagggcttcacctgccctgtcacagttggcctgatggggcatctaggatcttactcacgtttgacttcatgctgcccaggcaactaggcagaatatttttgctttgagctgagatgctgcgttggttttcattgtaaaacatcagagtcagaaggttccctaagtgtgagttctctcattacaggttaggaaactgagcccattaaggatgtgacctactcagagtctcacgagacctttgacagcgcccaaacctctgctgcatagcaacatctttggcgcagactgggtacttgatacccacttgttgaataaatgagcaaacccaggtctctcgagatttgtttaacagttatgttaacttttttttggtttaaactgtcaacataccaaatctggttttggttcagtgactgatctaaaatattagaagattctgccagttttctagaaacagtacacagactggtcagccttcatgttgctaatgctaagtggaaagtttaaccctgtagttccttctttctctcatatgtggtgccttacagcagtggttctcaaagggcaattgcagaccagcagcatcacccgtccctaggaactttctagaaatgcaaattcttccctcctcccccagaccttctgaattagaaactctggggctgggccccggtaatgtttctacaggctcctcaggtggttctcaggcacgctgaggtttgagaaccaaggctgaagagccacgtcctaacagtgttccctctattcgtgaacagactatgcatgtgagcacacagttatgaacacgcaagaaccaggcatgggattacataacactagcaatcaaataaaatgtaatgcaagttttatctgacatatttaatatatacatggtagttctcgtgccattggtaattaggcaaatgaaaagcaggtcatataaatggctataatgaatattacctaggcaaatcaagtttttatagtttttccctattagctttttagtatctgctagcagccattactgttgatgacttccctaattacacagatgtacattcttcagacactcacagagatacactcacttacatttgaaattctggctcaaatttcccaattgttaggattccctgtgaccacctatctctggctgagttttaaaatctcaaaagcaggatttaaatgcaaatagcttatttgggaggtgatcccaggaagcactggtaggggagtgggggagtgagaaagaaaggaaaccaataaaggatttgttacccagcaggttaccccttgggccgtggcctgctggggaactctgggagactcaaatttactttagatcaagggagctggggtatttatgtaccacttccagtcagtctgggtgagggctactcacctagtgggagtaggggcaggacgttaattccctcttgctttcagtctacccagtgtacaggtctagagggctctggcagcctaagagaatcctcagtcacaggtgcttgcagttggaaactggcagatgggagggtttagaaatgacaaatgcctactgtctgctttaccacccattagtggcacaggaagggttttccctggggtcctggttctggagggaacatgggcaggcaactcaggggctgagagcagctgccaaggatggtggtaagagaagggagagggtactgtgaaaatagactctgggtctcagagtctgggccagggagagggcacgatggagtgaatgaaaaatcctggggcacatagatggctggcgtcaggtctctttgtctcttggggaggggaaaaggaaagcagagggttctgggcactggtaagagtagtagaagacagaagagaaacttaaatttcttgccagcctgtgcctttcctctaactccaacccgcacccccatcttgtcctactgttgttttccattttctctaggctaagagaactgtcagaagcccatcagtctgggaagaaagggagcttcatgcctggcctccttgtgggtgggtccgctggcacattgtttgcatgccacagtggtgaagatggggaaactggaactttgcattcttactgagatagtcctcaatacagtttcgaccggtccacgatgaaaggagaatgaaaggagagagttaagggcagtgaagagtgctgtgatagtgctgatggtatttgattgccaaccacctttattctgattatgttcattctttccctttttttaattttattttttttagagacagggccccactctgttgcccaggctggagtgcaatggtgtgacaatagctcactatagcctcaaactcctgggctgaagtgatccttctgcctcagcctccccagtaggtaggactataggcgtgcgccaccatgcgcggctgtttttgtttttgtttttttgtagagacagggtctcgctgtattgcccaggctggtcttgaactcctggactcaagaggtcttcctgcctcagcctcccaaagcactgggattacaggcatgagccatggcacctggccacttttcctttttctgtgcttcagttgttctttcttttataaaacaaagggatagttttcatgttgattgttaaatgtttgtctttattaaatttattttgaaataattatagattcacaggaagttgtagaaatagtccagagaggtccttttttttagtacccctcacctagtttctgcccatggtaatatattatttaactctaatacaataccaaaaccaggcgattgaccgtggaagaatccacacatccacacaccttattcacatttcaccagttttgcatgtatgtgtgtgtgtgtgtgggggggggttatatgcatttttatcatgtgtaagttcatgtgatcaccaccacaatcaacatgcagaactattctgtcaccacaaagatctccctcatactttttttttttttttttttttttgagatggagtttcgctcttgttgcccaggctggagtgcagtggcatgatctcggctcactgcaacctccgcctcctgggttcaagcgattctcctgtctcagcctcctgagtagctgggttacatgcatgcgccaccacacctggctgattttgtatttttagtagagatgtggtttctccatgttggtcaggctggtcttgaactcccgacctcaggtgatccgcccacctcagcctcccaaagtgctgggattacaggcgtgagccatcacgcccagtccatcctgttaatttttaaagtcatttgccttgataaaaagttgacagctttataacatttctgttcctcccagttaggaaggaaaatggcccacacacttaccaaattaaggggctactgccacgtgcgtccctgttgaagtgggacagcacagtgctctgcacagaagccattctcctgaaagaggcaagtgtgtgtttctgcccagggctgtagagaaggaagggtgagaaaggtcatttttcccaggtctttttccttcagtgctcagccctcgagaggcctaagtcatgtattaggaagctcaggcttctgtaacaaaataccatagattgagtggcttaaacaacagatgtttatttctcatagttctagaggctgggaagtccaagatcatggtgccagccagcatggcccctgacaaggaccctcttcctggcttagaaacggctgccttctcactatattctcacatggcagaatatatgtatctccctcttctatataaaccctaccctcatgaattcctctaaccctaattacctctcaaaggccccatctccagataccttcatagtgggggtgagggcctcagcatatgaaatttgagggaacagaactcaggccatagaaggtatcttcatcaagggctgctccatattctgccacctcctcagttgcaaaatcagtggggtatcttggcagagaggcaacaagaaaggtttaggccctgtattgctagccttgttaccttggttaaactatttagcccctccgagcctgagttttctcacctgcaaaattgagagattcatgtggataatgtctgaggccctgcttgctgaatctgcagctgcctgcctcctgcggccctcgtcttcctttcctccatttccactgacttggtggtgagagcccaagggccaagtttgttgatccctgtaccagcttttctcacttattcccacttctgggggcaaaggaaaaaagaggagtttgagattttgaacttcacagttttgaccagagccatcctgtttattttcagctatgtagaagcatatttgagattctgatgcttgtgcctgcctacacacagacacacatggcctgagcacaaaagtatttgagaaaaacaaggctcttattgatcatttccttcagtctcagactctctctacaccagttcacttattactcaagcatctgattctacaagaggcagaattttcgaagatgagattcctatgccctggctgacagtggagctttgaagcccagcctgggaccctctggcctttagccagggactctttggggtcccagtaagcttccccttcacccctttcttctctcccgtagacctcagggattggcccacctgtccaggtgtctgcctccactgtgtcttccctcttccctcgtatcccagaactctggggaaggaataatgttttccagtgtctccccagttttgctgtgtttgaaataagcacacaatccccttttaagattttattgcatgttaaaacaaaaatgggaaactgagaggtttgcggaaaatagccaataaatagccaacaatggggatgttataaagttatgagaaatactaaaaataacagttgtcctgggtcttggtcaaacgttaataaactagctctttccttggctcctctgactgccttctctctagatattgtcttgaggttgtagcttccactccttttctgaagagccctacctcctagcacatacacaaagcccctagagaacagttgttggcagcaatcaatgcttacaaaacagctgagactggtgggctgtgatcgctctggaatcttcttgcaggctgagattggagatggcctttgaattgtgggcagctcgggggtctcccactgcaaaggtctcacaaagtgtagaggattgcatgaccatcttttctgcctttcctctcccttcatgccacttttcttgatgtctttcctgagaaaatttgtacactccataattgcaacttgcaagactcacttgctaacaaacccaagggtgtaagtccacagggcctttcctggaataggcactcttcactggcctgttttgaaaaggctgtgttcttcctagtaatcccatggggttgtacactttaacctgacacttagcccccagctgttgcatgttgctgcccatataggcaatggattttctcaggagtcctcacactaccagcccaacaagaagccagggcttgttgctctctgcctgccagcaccaccctttcttcagatgctgagctcttctgtggcctcccattttcctgccagccagagggaggtgaccagtctgaacttcggttccagaacctattgggctactttgaggacatcaagttgtgttcctgtccacttggctgagaaaaaaagacagaaacctatatgatttaggaatactgacatagatggtaggttaaagaaaagccagaggataataacatttaattcaggatggtggtggcctcagaggagcagagaaatggggggaagtgatcccaggaagggcattttctatttcttaaaccaggtagtaggcatgtgaatgggtcatttattattgctgttgaaatcacaatactataaaatatgttctttggaatttaagaaacatttcatttttttaaagaggaaagaacacagttccttgttgttgaggtcagcatggggctgatgtaagaggatatcgacacaggaacttagcagtaaggcagtgaggacgcagttggaggaatttcaggtgggaagatgccacacatttgctgggttagccaccatgtctcccccctctcattttctcttcaggaaaagtctcagatccaagaaagatgtatgtcctaaacaaatccctccctaagaatcagttaaggtgtaaccacttttaaaagctctttgtctgtttttccactgggtgttgactgagcccacccagtgcttagtacctggtaggagcactagtgagaaatacaaaagaagctgaagaggcgtgtccatgtgtctaaagaccgggagccatcctcggaccttatgtatgtgtgagcaggtttgcatcagtgtggtacagccaggctgcctctgctgcaagaattctaaagcagaaaccctagatgcaatcagtccacaaagggtgccggcagggcaccagtgctcatcagtgcttgttatgtgccagccaccctccctgtgtcatcgcatcctccccacaccgtcctgcgaagcaggcattagcatccctgtttacaggtgagggttacataggaaactgaaaataattatcttccatgtatctttccttcccatggagtgtttctaatgtatcctccatggttatatttgggggacataaggttgccatttccataattaattgtctgtgatggggttgtgggtggggcagggctcacattggttcctagctcagacattttcttttggatgaccttggatgcccttgagcctcagaatatgtctgcgagacttggaggattccccctgcttttgccttcgtgccttacagtctgtcagggtaggtaggaggactgtgttggggagaagggtcttagttaactgagtgaccctctgtctctgtgtactcagcttgagaactgggtgggctaggggcagtttcttttcaccccttgccacatgcagatgaatagaagctggaaatttgacttgcgtgaggtaacctgagttgacaatgagagcccatgacttgctaatgcctgtgatctgtaacccagagatcatggcctggctagttggccctggacagaggcagtgataaataatgtgtaaggcattgttcaaacaggaaccttgatgaggaagaaagaagggctgaaaatttcgggagtcacctggggtggtttaccagcctgcaggggagagacttctaggaaaacgcagccagagaggggttctgtgtctctgggagttgacttatttgatggtgaaggtggtttgagagtttctgcagtcatagcggctatcttgtttatgaggcactgctgccagttcctccagaggctttccacatgtgccattgttccagtagaagcctcttacatggccacttgggatgagggttgtttagtttggttaattacaaaaccaaaggaggaagtcattttttaaaaagaatcaaacaatttaaccccaatggatagatgtgcacccttttgatgtggatctgggccctttcttccaatgtagatctactaatttggagttctctgccttccttttattacatgaaccacatctataaaacaccattgactaaaatttccagtttgtttcttaaaagtaaagccagaatttgaccacttgtgaagcaatctgagtatagatttcttttggaattttttacaacttacttccctaaccacccttaattcaagagcacattttaaaaaatgatctcattattgagtctcttcgaagtacttacttggttgtcacagaaaggttcttttacactggttccataatttatgtaatgtttaattaaattttctattttcatcaacaaatataaccatcctaagcagttttggaaatgaccccagctgactcttggtaagggtaacactgagtgtgtggaagcagaagaccatgggtgtgcgggagcaagcctgcccagtgtggacatagccgtccgctggcatcacttactgagggacagggtggcatgcagttagctcgctggcagatcacttaagcggaggtcaataacaggtttgccaggtaggtgtcgttatccctgttacagatgaccaagcggaggtgtgggaagaacaagttccttgctcacagccgcgttgctgaaagcggcaaagctgattccacagtctcaggcatttcactacctgcagactctgccctgtgggagccagctctgtctgaggtgagggagtagaggcaggcccacagcctgcatgagaaggagcaggcctgagttgagaccctgttccctctcctcactttggtattgtcttggatcctccggtttgcttcgcgccccaagagctgccttgtagaaaggcgtcactccctcacataaaacgttttgtcctgaatggagaagctgcctccagctgagtgtccaggaagtgagctattgttcacacaacatgttctaaacgttctctgccaaaaggaagccctttccctctggtgtatcttttaaaacaaaacaacaaaaaacaaaggaacctggattttgattaacttgttttttagatagaattttgtttattttggaaccagataaatgtgaatggcaagtacaagccctgtctaatcgctgtaaactgaaatgtgcaagggaggagggtggtgtggactatttgcctggcatctgtggttttacgaggactacagatgtttcccagtgtaagtaaggctggcatctggtcaagttacagagggaaacaggcacagtatctcctgctatggccctgggaaatggcagggactaaaatcccccagcaacagaggtagacaggcattgcctttggaggaggaacagatctcaccatccatgcttacagcagcaataaccttgcattttaggatgatgtcactcagggaatgaatgaattacaccaaaactgtgtcttttaggcaatgcacagcttgctcagacttgtgtcataataaattaactcctcattagagccctgccttgaaagcagggctgcactcagacctcttgtacattgtctcagatctttacagcaggcctctgttgatatgtgcattttgtgtttgaggaaactgaatcttaaggaagagaagtcaggtcatttgtccatagcaatgatcccatgagtgacgactttttttcaccttatagaagaggaagttgaaagtcaacaaagttaaatgacttgtccaaggttccacaactaattaggtggcagaaccagaacttgaactcaagtttttaattcataagtccttgttctttccacccctacacactgcctttccaatgttctcgatccagtacattcgaaatcctatgctgagctttcatagagtgaaagcgaggcttgaaacaagctggacaccatgaattaggtggataaggaattgagcagtgcccacatatggctagtgctgtgatccacggacgttattttgattttctcatgtttgcttttctcttctttaaagtgggaagaatgctagctccccaccagggtgcttgtgaggagggactggatcaccaggagggcagtcagctagtgcctagtgcagtgaggaccccactgaaagaacccagcccaggacctaacaccctgcaagtcttgagttttcacattgttgaacaaaagtgctttcagggtcggtggtcgaccttgctgtgagcacatgaattctgttttcaggaaagatgaatgagccttcaatgtagttcacatagctttcacatactccagaattttgaaggtgtatttgattttctaattttatttgatttcaggagacagaggatacaaacatattctactagctaagtattctaatgtgctgcttatcatgctaaaggaactcacagatgtagggatccatttcttttgaccctgattaatatgagccagtttcccagggtgtactcatcctgggaacactgataattgagttttcagactgtcaagtctggggttagcctgggttccagaatagagaaagccacaccacaacacagaagctgtgctgagagcccttcacccagaaggctttgtgacagggaataatggtgccatcgactttcccacattcctttctctttgtttccttcgcctctcgggcatgtctttgcttattagcatgttgaacagagttcatcacaaatgaaactcagaccagtgttaatcttacaatttattatcctctaaaagatctgatcctgaaagatttttccagtatttcagtatgagacttttcaaactacagaaaacttgaaagacttgagtagtgaatccctgaatatccaccacgtagggcatggattctataattagcattttgctgtacgtgctttattgcatctatccatctgtctacccctcagtgcacttagcaatcatgttattttttgatgcatttcaaagtaagttgcagacatcagtactctcatccccaaacactttaacgtgtatatgattaactagagttcgatgtttgtttatagttatttgggggtaggggggtaaaatttatacaaagtgaaatccattaagtctgttattccatgagttttgataaatacgtacatttgtctaacccaaattcctatcaagatactgaacattactgtcactcccagaaagttccctagtgccttccttagccagccagtcctcacccagcctcttctggtagttttccactctaaattttgcctattctagaacttcatataaatggaatcactgcagcatgtgctcttttgtatgtcttatctgaaaggttttaactagtgctttaaactgaagtctagggactctgtcaacttcatttatacaccttcttcctgtttcgcaagttcagaggtaattaggagtggtaaactgcaggaaatctcaaggcagctgatggatcctgatagtgtatttgtattaagtatgtatgtatgtatttttaaaccttaagtatatataatttggtactcagaatcctacatttgaccaccctgatattataagacaggtgttcccctgtagaatctgaggagctaagacccctttccctggccacactgctaaggaaattgattctgagtagaagtttaggatgttttctttggcctggttttatccacagccagaccagcagtgtgctgtaatgacattcagattgtgaaagaaccagaccgagagacagttacttggaggctggtgggggtgcccgaaggaccaactggcagattaaccagtgtttttaggtaactgcaggctttctgaggtttgtgtacttcctcctcacccctccccaccatgcctgggtgaaaagtagattgtgtacattgaactagaacccaaatacataatcctcattaatcttttagattcttgtcccacttattgaagccagtacttggcttataacccagagttatgtggcaagcagtaataaagttaattggaatctaggtctcccaacttttttattctttcagcagtttcttggcgctttgagtaaaagattacttttacattaggctgttctggtatgagaaggtcatttggcaagtattggttccgtgtatttccttcacgtcatgtcaagtcagggccatgtatttcctcccggtcatgttcatgtcatgtccatgtatttcctttctgtcaagctgcagatgtgggcctaagccctgacctctgagtcagggaaagggccagctggtagttgcggggtgtgaggtgcttttggggagcaagaccaaatatcagcaacccaagaggtataggaaagacaaaaatgagggggcaggtgggaggttagagccttagaccacgctctggaagccagagctccgtggctttcctctctccaccagcctagcctggtgcaaagacaaaaggcaggctttaattggagcctttgtcagggaagacggacaaagcacttttgaaacaaaacagctctgttgtctctcagcctagtaggaaaaggggagttgaaaaagaaggtgacgatgtaaaggggattgaagtagggggacacagcaattaacatggtaacaacccaaatgccccacggtaagacacagctgaagtggagactgagcccgctctgtggaaaagggagttcctcattgttagccgccatgtctggtcgcctcggcaaggacagccctgagcccgctggcagatagttactcattccctgccatgcgcctttcccctcccccatccccttctgcctccctctcctaaaagcagttgacaaggttagaaaatcaggacaaataatttacttcaatccatctttgttttcctgaggccatgcgcaattcagtctgggaggagaaggaaaaaaaatcacccagaccctggccagtgaccctttttcagatgtggaatcaaagcccactctaggctgagaggcgtctgctgctaagaggcagaagacagagatggtgatgaattcttatgtggtttctgggcctgagagtgcagctgtcagcagtctttagggttctctgcacagcctaaggaactgattttgacgtcagcagtcgcctgatgggatcggcacagagcatctggtgaggctgaggaggctgcggctcagtcgctcagcccccggctcctgggaagggggagcactgtccaagcaaggccatcgagccagaggagagggtctgccactttgcccccgtgcagcaggaagcaggttcggctgccagtggcaccagcgaaagtgagagcactgccctctgtgggcagtttgggagtgcctgtggaggagagcttcagtttcctcacctgaaaagtagggtaataagtttgcttggctgtgagtcgaggctctgcaggattgctcagagaagggatcagctgaaagttgtggagtgtgaggtgctttgggggagtgccaaccttgtgccagcaactcagagagtcagaaaaacgtaaaaatgaggagggaaagggagttagagaattcatactggtccagaagggagagtgttggctgccttccccccttcccctgttagtgtaaaagtgaccagtgtattagcgatagctaacaaacatttgtcatcgaacaccaccagtgtgctagctgtgtacaaggcatatggtgggatctaaagaaaacagcgtggcgcagggtccttaccctgaatggttctttagtgtctctgggacacaccataaaacagttaatcagggaagtaatcctgcaaagcagaaggtgtttctgggccaataaggtcatcagtgccgagtggaagaggcgaggtggaaggtgtctcccgccccgtggctcaggcctaaggagactgatgtgtgttttccaactggcagggggtcctagggcaccaacagctcccaggcagcagaaagggtgttaggagggaatgtctgatgtcaggagccaactcagttatagaaacttctctcgtgctcccatttacaccaaaggaaagtaaaaggaaagtgattcctttcccatcctcctctacatggggccccaacgaaagacatattgaccagactgattcctgctctcctgatatttggccccatgtcgtagccctgcacacagccgtgacttgtactgcctcctgaaagggagccaagttacaccaaagcttgaggtccgcctgtgcccaacacacttcctggcacacagaagacccatcaaaactctttctttcccctccttcaactcccagtatttattaaaaagctagttgtcatctgcgtggctctgccgcctggtgatgggggatggagacctctccatacagagctccacctcccatccccaccccgtgggcagccagaatcctgcggtctaaacaagcagatgtcagatggcctgagcagcagtatctccagtgtttgtttttgttcttgttttcagccatatggggaatacattttacacagccctggcagggaaaaatagtctaaacagagtcgtcctgaaaactttttgaaaatggagtatttccaagcattttttgaagacaagagtccattatggtgataactttcaagtccttatattaacaaacacgagtataagttttcagtcagttcacgtgaagtgcactaataaggaagcatggccatttctcatctctctccaaaaatgtcactcatccaaaaccacagaaaaagaggagaacactaaatggtgcccgtccattacacttaacctgcctcttcccctgaaatgcagaccatttctgggaaagctgcctgttcagatttttttttaacttaaagctaggaggttaaactgcatgaagtgtatagatcagaatgatatctgctgtgtctgaacgctcttctttgtgtagattgaaatgatcttatttcctctctgctggttctgggcatgagggtgagtctgaggcaaggagagaagatgagctccggcttctccccatctgcacagctcaggctgagggcttgggcagaccacagctccagacactctgtggtgccagggtggggacctgccaatctctgcccaaacaggacctcttcgctgccatgtccctcctggccctgagcttccaccaagacaggttccagttgctgaggaaggagtccagggttacaggctgtgagtccattgccgaggaccctgagtttttctggaactagaaccagctcagcttgacttagccatggcagttcacagaacaatagaacaacttcctagcctgggcaaaatcgtcctgagagcatccattagcatttcccagccggtctgcagtctggaacacctcacatggatacccgggtttctgggtcaggcacctgtaaccccagtgctttgggaggctgacgcgggaggatcccctgagcccaggagttcaaggtttcagtgagccatgattgcgccactgcactccagcctgggtgacagagcaagaccatgtctcaaagaaaaaaaaaagaaaagaaaagaaacctgggcttctgctggcctatgtcagttgactagtgggtgactcctggggcaagcaggaaagagcagagcggagaagcagcgagggtgctcaactctgttcactctgatgccaaaaggcccttcggcaaaatttcacaaattgtaccaccaacggatgctgattggacaggccagctggggcttcggatgttaagtgattatggtgataatgaaatatataatatgactttatttcagaggataccctggagtcaccccaccatttcagccctttccttccccagcacgctgcatggccgtggagaacagcttttccagtgcagactctaaagaaatggaaactacactttggttcattcacagattcattcaataggttctctatttaccatgtgccaggcccagcgggtgacaaggcaaataaaatacgcttgatgccaaccctcattggtgtctacagtgttaagctctgcgtgtgagtagaatagaatgcggagaggcaactgggagatgggtaagggagacttttctctgaataacattttgtatcttttgaattttgaatcatgtgaatgtatcaaaaaataagtgtaagtaaaaatatttttacaactttaaaaataggttttactggactggagcactcagaggacaacagagcggaagtggaaagcaaactaaccttttattgagcatttactgtgagctagaccttcagccaggtgctttatgtacatgatatcttttaatccacacaaccctggacaaaggcagtatcatcctcatttttatccattttaaatggaagcttgccaggtatggtggctcacacctgtagtcccagcactttgggaggccaaggcaggaagatcacttgagcccaggagtttgaaaccagcccaggcaacatagtgagaccttatctctacaaaaaagaaaaaatagccaggtacagtggctcatgcctatgatcctagcactctgggaggccaaagtgcacagatcacttgagtccaacagtttgagaccagcctggacaacatgatgaaaccccgcctttacaaaaaataacaaaaaaattagccggctgtggtgttgcacgcctgtagtcccagctactagggaggctgaggtgggtggatcacttgggctcaggaggtcaaggttgcagtgagccgtgatcacaccactgcactccagcctgggcaacagagcaagaccctgcctccaaaaaaaataaaaattaaaaaaaatagcaaggcatggtggcacctacctgtcgtcgtcgtcttagctattcaggagtcttagctattcagtgggaggatcacttgagtccaggagtttgagagcagcctggacaacataacaagacctcttctctgttaaaaaaaaaaaaaaaaaaaaaaagaataataaaaataaaaataaatggaagctttgggaggtctggggagtttcccttgtatcatgctgcccctgctgaaggaggcagcacttgaaacagacatggccagagaaagagatgggggtggagggaggcgttttcttcaaggggcagagccagcctgctctgacactatccttcctccctgtgcctctgggctgctggggccagtgtttagagacacaccctcagtttgctgcaggggtcagattcgtttccctctgccttgctgagctcagggaaggagcttgcagtctggttaacaggcagtcagatgacagcctgagccagcagtcgattctgtggctggaggaagatacctccccgagcccccagctgcccaaggagagatggcgcttgctctgtgctcttctgctgggtgtcagatgcacggctttgtctgccagctgaaggctggctggagaattgtttttccaattgtctgacccaggctccttacttgcacttagaggaaaaagcatccaagccctggtacaaaaggtcctcttttcattcctttggaaaaagagcagtgaatgagctcattatcactgcaacccaaaaaggaggaggaggggaagaagagaaggtggctgctccccactgcctagttctgcccctggccaggtttcctggggaagggggcctggatctggcccatagtggccaaggccagatggctgggacaggtggtccatactgggggcagcgctggagccattggatgctttgaaactagctttctctgctgtggtccagaagagggacaggtgtctgtgccccgtctcatctcctgaacgcagagctctatccaggactgctggactccaagaagcaaaaggccttccatttgggcctaagtgcctgcctcacctttccttcccagaggtttctgtatgcaggcgctctagaaatcatcctcactccccagagcttgtggtcatacagtatcagttatctgttgaatgcttatgatttgccaggcactaccctaggcactcagggtagcatggaacaaagccggcaaagtcttcactctcatggaattgaaattctagcgtgagcaatgagatggccaggtctggcctgtgattgcagcctctccccagtctctgctggtctgggagaactgctggggagtgacatagagatgccttgaaagggaggctcttcagtatttctagcagctaagcccagactgtcaccatctcactcccttcagagcagtacatcggaccctgtgggctggggccagagaaggcctctcttagacctgagcagcagagtcctgataccttgcaggctggtgctggtcctgggaagcatctgaaagagacctggaggtcagaccccactggcgctgtggtgagctggtaaggtttaccccaagcctgactgcctctcctctttgttctttcttccatttcagattgagaaaatcatgagttctattggagaagggattgacttttctcaggaacggcagaagatctcaggtaccgtactaagtggccattttccccacagaaactggcagtctggctcttttctggctcaggctttcctctaacacagaagacagacattcagtgggtgggagaggtcagcttcagaccacgtcatgctcctataattcagtctccaatacctagacagccccatcttgctgttatttttagagccatgactccttttacatatgggaggggaaaagggacaaaatgaattttaagctgcctattgggaaaaatttttagatcaacaatcgtaacttattcattattttatgggctttcttagatgggcttaaatcagagtgcacctcagcgttggtctctgcagcttccaagatggctctcaagagtctcatccgtgatggtggcggagcactgggttagaccaggggtctcagactcgtagcatgcatgtgaattgcctgggagggttgactgtgctgtttcctcttcccacagctccttgtgcctgactcagtttacttcatcacttaccattcttacactgtatcactgctactttggtcattcttttctaagccctagtagtgaggccagcttctgttctctttgtttgaaacagggaatggggaggccatctgagctgttttatctgatgataggattgtgctgtgttgctttctcaggcgagatgctcttaaagatgcctctcagagcagatctcacacctctcccccaagcatccaaagatggtctgggcactggggcatccaggctgaaagcagcccagctgggagcctggcctgtcttcaccttcatggaaatgcctctctgccctgaaggggtggaaattcttgctcactcaggaggctccatccaggattgacctgtcagtctcaagtgacacctctagttcctccatgggcttctgtggccctgggcaggaagtctgatgggtgggcttgagtgtgcacatcagggagaaaggaacatcagagaccacggggcctggtggggacgggctgggctctggagcctcacagccctgggttgaaatcttggctctagagacatatgtgtcttggcaagtcacttaatgtctctgcacccctcaccccatatctgcaacctttggataatagtgtcaacctcacaggcttgctgtgaataagtagtagataaaaaaaaattttttttttttttgagacggagtctcactctgtcacccaggctggagagcaatgacgtaatcttggctcattgtaacctccgcctcctgggttcaagcgtttctcctgcctcagcctcctgagtagctgggattacaggcatgtaacaccacgcctggctgatttttgtatttttagtagagatggggtttcaccatgttggtcaggctggtcttgaactcctgacctcgtgatccgcctgcgttggccttccaaagtgttgggattacaggtgtcagccaccacacccggccctgtgttccttttgtccatgaaatcattacttactcatatcgagaaacctagagaacagaggcttctgctcactggccgtggctccctccacagttttcagtcctggttcccagagccaccatcgctccagcagcaatgtttccctgggtgctagcagagagggctgagctgagcttggtccgttttcgtcagtcttggattatgctggagtctgcagaggtggctttcctggctaaatttgtggatctgttttcaggatctgttgcttacactcagtcaagccatctcacactctgttgtagcttgcaagcttttccaagggtcaagtgtttgcgggaaatggatgttcaggactgagacaaacactgttaccattttcaaagctgtgctttgaccacagggatgggagggatagcagtcagttccattgaggatggtttctgctttctgtgtccaaggagcaggagccaaaatcacttgcatatgcttgagagctgtgagtcagaaacagccattgcctcttggatttgataagtcgggagatgtggcagcacctcgggaagagccctccccttggaagggttaatgctgagctcttcccgtgacatctggtctcctgtctgatcccacctactagttttttgtttgtttgttttatttttgttgttgttgttgtttgagacggagtctcgctctttcgcccaggctggagtgcagcgcggtgatctccactcactgcaagctccgcctcccgggttcacaccattctcttgcctcagcctcccgagtagctgggactacaggcgcccgccaccacgcccggctaattttttgtatttttagtagagacagggtttcaccgtgttagccaggatggtctcgatctcctgacctcctgatccaccctcctcggcctcccaaagtgctgggattacaggcgtgagccacgatgcctggccccacctaccagtttttgtcccccgtgaacccatatgagtgttgagaggcagtctgtctctacccttgggtttttggatcccagcacacagtcttgttttagtactcattttcttgaaccatcctctatagtccagcttgggaaagtcaagaacaggcacatgtgggggaccacctaaacagcgggttcatccacccgggctgcagagccccaggctgctgtgtctgcaccactgccaggtgctgaagcgtggagaggatgggctcaggcctgcccatgaaccctgtctgatgggtcaggagggggctttccccaggatctcagggagtactgtcttcagcttggaccaaaatggaatcactgtttattttgactggtcagtatcagggttcagattgtccttgggttgggcgtcaggatcagggagaaaagatctgggctctggggttagtctgggtagaggaggagcaggccctccagcaggcagccctgcaccaagtgtgggattgcccagcaccactggttttgcagaggcgcccgcaccccccagccgaagggcacgaccacagcattggagtctcagttctgtttttagggccacaggcccctgggctgccaccactggagctagttagctgaatcgccaacagaagcgtttacagctaactcatccctgtgccaactcccattctcaggagtccaggagggtatgccttcccactggcccaggccactctggctctgtcaacaaaggccttctccgtcaagcagaagggaacttgcttggctgtcttctgataaagccagccatgttaggtattgagtagctggtcaagcaggatccttctggggcctgatgagaaccctctcttttccagggctcatctacagcctattgggataccagtatctcccagcatatttagagggtaatgtgtccagggcatatttagaagccctggacttctgtccctgtacctgttttatctttttggcctgtctccatctgtacttgggatttggccctggtttcccccttgcccttggccatcgctgtcctcccccagagtgtgagtggcctgctctggggtggggcacttcccctgggctctaacaggccccaagagaagtccgtccccaatttgtttggtatactcacctaaggaacatcaagtgtaacggccttatttcattgcctgtttttataagaagcacagtcattcgtaaagtggcaagtaggggggtcacttacctgtgggctatgccctttgggtctggtcattcctgtgtcctctcctggctgtcctggaaactgtcgaacaaagctctaggagcagtccctctctattcttcctgacaagctgtttccagcccctggagctagaggtaaagtttcatatctccgcccttcatatgcatttgtgcagccaacatcggctattgggaaatctgtcatttcgctctgatgctagtgctgctgtctccttctccctcagcagccacagcagcagttgcttctgctccgatgtgatgtccgatccctgatgtattttcctgagcttggaagggggagggtgaggaggggaggaaggggagggccagacattacgagagtgagcaaggactgtggagccagcagcaggcagcgtggagcccaggagcctttagacaaagcattctgctgcggctctgtcagcgcgcacatccaccggcagcaggcaggaccacagctgcccggctgggggattacaagcaagaatgaatcagcacccggggacacttgacttcatgggcatagaagaacctgccacgtaggctcctggagcagacttccccattcaagggcaggggagctcaagtatcccccagactcggcatcttggagcgctgcggcagcgtgcatccagaaggccgccgggtccctgaccatcatctgttctgcaggagacagaggagagggagtggaggctggcagagttggtcaccagggtcttgtagataaccaaggaagttggcattgtcctgccccaaggggcagaaagtacctgggaacggcagaatgactttcaccgtgtcaggagttcactggaggtgatgtgtttatagttggttcttccttttccttccttgtacctctttttcctccttttcacttttttctttctttcatctgttcttgcccacaagaatcagagaagtaggttggggttcaggcatccagctcagaacatccaaggtctgccagaaagggctgaacttctgtcctccctgcaccaccaaaatccccatgctgatcgaggagcaaatagatgtcctcccttccctgctcatccttagaggagaacgccaagatccagagaccctgggacgactgtggctgtctttatcactcagccaaagagagaacagcgcaggacgtgaatagacttaagccgccacagctcagctgacagaggaccacttcctttttctctcttttatctggttgggttttgtcttctttacccaagaactgaatttgcctgcctgctttctacctgagcaggcaggtgagtcactggaacagctgttatcagaagaggaaaatgaatgcccagcccctgaaaaccagcctggcccaagaaggcaacacttcagacggcgtgctggcccaggagacgccctgcttgccagctgccagagtctagctgtggatcgggctcctggcccactggccgcgcagcccggcggaatgcgatgctgccgtcccagcagagccacacctgagcctgacccccgagccccggcccatgtgccccattcagccccttgctgccttgagcctctgagcacaaagggccggtggccatggtttgcttattccgggactgctgggggaaaacaagtaaaagtctcttttctccccctgccgtgttctgtgctgcttgtgttgcatgtgctgggtcccggtgaacagccgccgctgctgcttccctcccggagccctcgctgtgtgcctgtgtccctcagctgcatgaagatgtgtgctctctcctgactggtttatgctgcaaggtcgcagaacttgcccctcgccacggccccacaggggctccagaagttgcatggatgagaggagcggcggggcttgtgggcacttaggagctccctcagccccctctagtgcctgtggggacagactttctgaaatatcttcagcacgcacgctgatgaggagttgacctggagactgttgggatttggcttcccccacccccgacctgtgggcagagatcatgcatgtgcagccgtggccctggagcagctcagacctgggggtgtgagtgggcagcagccgcccgaggctgggcagtgtgtggacagcaccaggtggtcctgtccttggctgtacacagaagaggagctgcgtgtctgctgctctctggtctcttgtatatagtttggctgtttgatggtaatgactatgatgtggcaatgccatctatcttcctctgagtgccgctgctaccgccttaatggtttttcccttttcaagcgtctgccgattcctctctcatcaggtttacggacgctggagcagagtgtcggggagtggctggagtcgattgggctgcagcagtatgagagcaagttgcttctgaatggctttgacgatgtccacttcctggtaagtggctgcaggcctcctcaatggcagggtgctgctcagtggaaacaggcctccctggcctcccctctggccccacaggagtctgcaacagtacgtagacccaaatcccagggaaagctcactgaggtcactcagacaccaggaagtcagccaggtggtatgtgccttcttcccaaactgtccctctccctctgccccagaaacggctccagagggagctctctttgcagatctgcttcccaagaaggagggtccctgattcagccctgtgtcccctccctggctgtgtatcccatcaaggctgggtacgaggagttttatttatttctcaaaacttggtgtcaagtgagttgtcactgaagcaaggagccttgcctccagcagaaagaccccttccctgcccagccaaggcccagtgcctggggtagagtccagagttacacagccttatatacccgtggcctcagagatggcccagaggaaaggctgagttgatggcctggaggattggttgcttctttgagaagctctctcacaaaacacaaagggccaaaaataaaaagagaaaccagggtgtttcctctggatccctgcagaatagggacccatttaggaccctgggctcaggatctggtgcacactctgtcatttcagaaagtagctctgatcagggtacctgtcactgtccctctcttggaagcccttctagaggcatctgcatgcgccgggcctgcttccaggagcaggcatttgagccaaagttagtgatcatggtcgctgacacttctcactagcgcttactgtgtgcttggcgccgttcttagtggtttgcgtgaattagctcattgaatcttcccagcagccctgggatgtggactcgtattaatccattgcccagatgaaggaaatgaggtaggtcccttgctcagggtcacactgtcagtcattggcagggtggaaatgtgtgtccagtgctctggatctggagatcaggctccagccactctgctgcacagcctctttcttctctgtggatacagggatgggggcgtggccacctatgtgctttatgtcaccttctagcctgagtcatcttggtttgagttagacccacccgctccgaggggatctctctcacctgtgcccgccttgctccgctgcctcagttgagggctggggtcagagtcagcatgcagctcgcaccacctgcactctgttctctaatgggggcttctgagggtttctcgctgatcgggttgtgtttggtgcctcctgaatagtggcctgcccagggagctggcctgaggcttccaggagggacccacctcacccagagccatctccaactccagggcaaaagatactgtggtgtgcaacaatgcaccctttccaagccagctttgggacagttaattttcagcttttagaaatcttaagttttaaaatagcaattttttttctttttaaaagttaaactgaatgtatttatggttcttatgacctaactcctgactcaccacgttcctcggggaaggatgacaaactcggggtggagagggggctcaggcaatgcgtggggacccaggttggcccctggctcggagtgttgaggggccttccttctctcaactcaccccttcctcaggctggccgtcagatgggcaagtgagggtggtcttagggtgttccctccctgtacttcaagatgctagaggctgagctgttgcttcccacctctccttctgctgattttggaaagaacaggattcctacccctcaaatagcccgagactccgtaggactggagcagagagcagctgagcaggcctttggagaagtgtggccttgggccaaagcttcatgcacagggcagggcctctgtaagatgcgtctgttcctatgctagaaggaccctcattgagggcggcctgcagctcagtccttccaggggctctcagtgctggcaggtggagtctatacaagaaggaacgtcgagcacccctcgggtgagccgggacctcagatacctagagtggcctgctgtgcacagcatcctgggtaaccacgtgtgaatggccaggtgggctgtcaggcaaattatgttttaacagcctaaaaaaagaaggcaacttgggaaggggagcgtttctgttattgaaatattccctcattgcatgtggataacttacattgcattagctacagtggatcccatgtggttaggtttccaataggctacaatgtttcccttggttctgaaatgccctggagactcttctacaagatgcagaagtagcttccaggaagccaggctggacatgtctgaggagcgtctggaaactgaggctgtttgacagtcatggtgttgctgtgggatctccctgtgatagggccctgcgagttgtcataggagaagtacagggcatttgtgcacatcacacagctccctctcagagtggaagggactgtaacgccatgtggtctgatcgccctctctgcccgaatcccttccaagtagtctctgccatgatggttttttagtgacaaggaattcactaccttgtaaggaggttacccattcattctttgcattgtactggctgatgtagagcattctttatattgagtcaaaatctgtttcctgtggcttctgtctcttggtcccaggtttacgttttgggaccacacagaacatgtttaagcccttcagaaaattgaagacctctgccccaggctccaggtgccatgccctcttattctcctcttgtgatgtggtgattgagctggacaggcaggcaacttgaactttatccacactgtcttgcttacagacagaaagggcctttgatttagaggggcagggccagggcagtgggggctgccaggtgctccctaggatggtggaactgacaccagacgcagggagagagggaaacgtggctcacacatctgccagccagccagcccacgagcccaccacactgcacctgcatcgtagctggttccattttcaccacaaatcttatccacaggaaatgggctttcttaggagaagggaggaaatgcatttaatcagcacggaaggaaggtaattggtggttggcaaatttgtagctccgggcgtgctagcgcaggtctgatgcccttcactcagcctgacgcccttcacagaagtgttgattgaataaacgatggtggtcctgatgctggagtgctaagtagatatttaaaaaaccacatttttgaagaattgctaatgtggggaatgtcccccttgtagtgctgagtgaagaaactgacacagaaattcacaatatgatcttaatttctgaaaaagaaaacatgtatgcataggaggtgcaagggagtgagccaagatgttttcagtggctatctcaggaggactccgggggcttcattttcctctttggagtgtaatcgtttttctccatttcccaccatgaatagatgtgaaatcagaaaagcaaataacgtaggtgtcttaaggaacttgatggtccagctgggaaaacaaagcacataaaagagcagccagtgtcaagtgcagcggaggctggcaagcaccgccagcagaggaggaggcctggatggcagagatgctgctgctgcccaagtggcagagccaagtccaacctcgaacctctgggttctgctgtctgtcccaggggtttcgtagagatggtgggacttggaaagatcacagagacaggaaaggcctgctgagaggggccaacctgtctctggtgagggaggaggctgctggggggcagtgacgggcagggccctgaccaggcgggagagatggctgggcctgacctcagggctctcgaaagccacgtgtgggagagtcccaaggtctctgagccctgggcatggggggatggtctctgctagtgccccacaccaggcaaaaagccccttgagtgaggcataccttagacatccagggcacagctgagagcccacgtgtggcaggcagtcatggctcggggcagtggacaaatggaagatggaaatgaggctggcagcaggctcaggaagggttagaaatggatactgagtcggccaggccggatgggaggccgcctgctcctcccgtcaatttctttctctgcaggctcctgctacgtggcagataggcccccgctgtcttcctgtgtgtttctgaggtggtgccagcttgttcctacgtgttggagagaaatgacagataaagagaggccaaaggcataagctggggccaagaggttcttctactggcttctttgaaactttccaaccaggtccccaagcccctgaggctcccttcctgttcctgtcccctggatttgctcctcactctccagccctctaaaccagcttcacgtgaacagtggggcttgtcatcacctcctatgacatccctccttttgccttcttctgccccaggcccaagaggccactgccagcctaagcgagctgccactgggcaccattatcagaatggtcatggccaagaggccctctccccagcccccacctccacccccgtcccatctccctgcacagcactccatgagctgactgctgtcttggagttttctgcccagttgaagcagagccttaaacaggaggatcagtggagctgaggcttggaaaggaaaggaatcctcttagacaagtgtggatccagcctcctggactagctaaattctgtagtcacttaagaatgtaattcctcggtatcccaggaggaagaatgtaattccttgctatccaaggaggaagaatgtaattcctcgctatcccaggagttgatgctgcaccagggcctcaccatctctgccagactctcccttggtctcgggagcctgaccaagggcagcccttttagcaagtgagacaagggacaggctcatttggggcctatttccagcgagtgcacctcttgccccccctccctttcactgcctgactgcagcgcaggcattccaggtgaccagctggaatcactcaggagccctcctctgactgccccaggtactgctctggccttctccagtcccctttacagtagaaggaactctgggaacattctgaatgcctgttttcatgcctgctaatttgaccaactgctctttaaagtggagttggactggctgacagatcctcttccgtcgctcctgattgctggcctcgttgtgagcagcagcagaggcgtctttcctggcacctcgaatgtctaggtactcactcagccaaaccccgcattgcgggctctcagtacggtaatgtgcccactgtcacccctcaggtggcgtggagctgggactggcagccacgtccctggacctggagtggtgcttccacctcccaatcttcccttcccaggaagatgcagcccctggggctcatgctcatgtgccctcacaaggttggagcctggcactggggcccatcaggctgggtgagtgcatcacccctgggctggtccaggtcagacgtccacccactgcatgttgggagccattcaaccataggctgagaaaggagctggcaaggaatgagatgcagttcggctctgtgcactggctcaggccccccaggttcttctgggcctgtgcagccaccaccactgcctggcccgttgcttctacccgcctcctccccaccctgctctctatgaagctccgggttagttaagtaaactggatgggggaagctcaggagaactcaagagtctacttagtggcaaagggaactggaccaggagtcaggagagctgggttcccctccaggtccccgccctgtgtgactttcggcaggttacccttcctccctgttcgtcgtctgtcacgcgggccttcatttgacctacttacttcatgaggcataaactccgaagaggacacagtgttatgtgtggtgacatcgtgtcagagagcaaaaccgcatgtaaggacgcaaggtgggaaggtggtgtttttctgaaaaaggcagtgggcagcagtctttctctgcaggctgcagaggttggttttgtctcagtcttgtcctcagatccatgagttaaagctgctttgggtggtcttgggaccaagcctctgactccagactcacttggtcccagcagatctacacggctgatttgggggtgactgtggcaccttgacctcagccaagacctcaaagaggaaggtgtttcaggatggcaggcaggagatgagtgggaaggctgccatgtctgcccacagagagaatgggggcaccaaggacctgcttgggagaacaggggtcagagtgggggggtgctttcatgaaactgggaagagtttcccaaacccatgtgctgtcatatccatccttgagagcccttcccatgacgtgacagataacaagggcctcagaagtcacctgcagaggccttaggaactggtaacacttgactcttcctggtggctgtcaccactgagttttatcccttgaggtgaggccaggggtggctggggtatgggataggaaagcagagagctgtgggtgggtcaggccaagtggttcctgctccttctgccagctgttagttgagggtaggatgtcaatgtggggctactttgggaaattctgttgcagagtcctggcagagcagatgaacaaaacagccactgagcgcctgattcctgccctcaggctgatgctgggtagcaaaccctgtgaggcaggcggttccactcttgtttagcaggtcctgctttcttaagaaccttgagcagctgaaccgggattggaacccctttctaccacagctgctttgcatagtagctggtactgggaaagccctcgccccaggtgggtgactgcacgcaggcctcagggagcatggcttctatttcccatcattattaagaattggggccatagtggtgagtattagagagccctgtcccctcctctttgctttctgtcccctctcccgatggttcttcctgcccccacccccgggccagccccacagcagatgccctgggactgggaggaaacatgtgctccccctcctctctgggcccatgcaccatggccattatagccccagcctcagaagttggtcctggctgagaccagaaacctgttgtgtgtttagtcacctgcaccccagacgaacgtgctgagtaacatgttctggggactgcataaaccacctgtagtagcggccggccagcattagcaaaggccggagaagcccgagtgcccagtggcagggtgagtgacgggcgtgcttgagttggtgccgtcgccacaggtgttgataaatacagtgaaatgtcatgggggatattcacatgcagtagatgggcatgttaaaagaggcaggttaaagaaacaggtggcaagtggtggggaaaaaaaagaaaaactgtctgcattcagcctataatcccaattttgctgaagttttttttcctaatatatagctcagaaaaatacaccaaaatggtagaagtgatcccaatcttccttttttaagaaaattaattaacttaggaagataacaccgaacagtggccttatgtttccccctgaggtgatagacttatgggtagcttttacatttttctttgtacttcattttcaatttttttttttttttttttttgagacggagtttcgccctttcccccaggctggagtgcagtggcgaaatctcggctcactgcaacctctgctccgcccccagttcaagcgatttctcctgcctcggcctcctgtgtagctggaattactggcgggcactaccacagccagctaatttttgtatttttagtagagatgtagtttcaccatgttggccaggctggtcttgaactcctgacctcaggtgatccactcgcctcagcctcccaaagtgctaagattacaggcgtgagccaccgcacctggcctattttcaaatttttctactaataaacttgtattattcaagaaactcaaaagaatcttttagtgtagggaagaggtcgagggccaggagaaatccatcacgttcttagagacagcgtcagtgtcacagtgtcacggtgaaccagcctgtgcctggggaagctctggggtggggaggagcaggcagggaagagggcagggccagccatgcctcccacatctgcccggggtttgttactaagctttggcagctcctctcccagaataggcaggccccaaaactcaatccagcaagggtgtggctttgtccccgcactcagctcttcctaccctccctactcttggttagcggaatctgcccttgtggcctaatttgcaatttctcgtgtgtccaggttctccccgccacataccccctctcccctcttaggagggtcccttcccacagtgccctgatccctgagtctgagaaagggaatgggtggtgaaggggagaggctggagggctgcagggagaagcaccttgtaagtccaggatcatagctctgtctcgtttcttctcttgcaagagaggagagttcagccttgagtttcctgtgactgatggggcagtcaggggaactggcaaagtgaccgtctgagaagagacaggcagactgaacatggaaaggagggtggagggggctgccggccgagtgtaaagtctggagctagagtccaggctggcgcagctctggccccaagaatcagaatctagtggccttggtttgggtgaacgtccaatgcaagagagggctgacgtctggccattggtgggcccaggactgcccctccacaccatggcccatggatttcatcacaagactcaagccttccttccctgggctctccaggacagagtggggcaggtgatagggtggtcccaggcctttcccactggttcaaggtcggtaagccctgggccctctgccttttcccaggctccctctggagacccaagagtgggaagagtgacatcccccacacactaggctttctgattgtggttatgaatgaagcctgctttcccaaactgctttttatctgctggacccccctcctgcagtcccccaacccccaccattgtcccttgtccctgccccatccacaggcctcagcatgtgggctctgggtcaggctctcagctccagccacagtctgcttggtgactttagcaaagtaacttaggtctcttggtattctcctccgtcaaatggggctttcacccctgtctacagtggagctatttagaggattaaatgagattagtgcaaggcacttagctagtgcctagaacacagagggctgacaataattttttttcttttaagatagggtctctctctgttgcccaggctggagtgcagtggcgcagtcacagctcactgcagccctgaccccccaggctcaagtgatcctcccatctaagtctcccaaatagctggaactacaggtacacaccaccctacctggctaatatatatatatttttttttttaagagactgggtgtcagtccgggtgtggtggctcatgcctgtaatcccagcactttgggaggccgaggtgggtggatcacctgaggtcaggagttcaagaccagcctgaccaacaatggcgaaacccagtctctgctaaaaatagaaaattagctgggtttggtggcacatgcctgtaatcccagctacttgggaggctgaggcaggagaatcgcttgaacctgggaggtggaagttgcggtgagccaagattgtgccattgcactccagcctgggtgacagagcaagactctgtcaaaaaaaaaaaaaaaaaaagagactgggtgtctcacaatgttgctcaggctggtctcaaactcctgggcccaggaggcagtcctcccaaagtgttgggattataggcattgaaccattgcacctggccctacaggggcatcaatagttgtcacctgtgtttagactatgactggtattggtggcagtgtcgtcattttcagctcttgcagtctggtgcctctctgctgggtcttccaccaactctttcccagcttaacccccatcttcctagaaagcctcctttcccatctcaccccttccctttccaggtctttttccgatcctgaagagactagctgagagtctagcacctctcaaaggtctgaatagaaaacacttaccatctattgcctctaagggtgaatcacctaggacacctaatctacataataggaaccttggtccccacaagcctttatctttttttttttttttttttttttttgagacagtctcactctgttgcccaggctagagtacagtggtacaacctcggctcactgcaagctctgcctcccaggttcatgccattcttctgcctcagccgcccgagtagctgggactacaggtgtctgccaccacgctaattttttgtatttttactagagatggtttttcaccgtgttagcctggatggtctcaatctcctgacctcgtgatctgcctgcctcggcctcccaaagtgctgggattacaggcgtgagccaccgtgcacagcccacaagcctttatcttaacccagacacccctttcttttttctttgtgtgtgtgtgtgtgtgtgcgcgccaaagatttatttcttcatttcttgcatttgaaggactcttcgatgacatccttggcctgagactccttgccatagtccttaactactacacaactgcaaccaaccactttccagggtttcccctctctgtctattttacagaggcctgcccattcccctagtttcttgttgtcatcaaccttacttaggttgatttgccagacacctctttctattgactccaggcctttagataaactctttcaactagttgccaatcagaaaatctttgaatccacttgtgacctgtaaggccaccacccccaaacttcagctttgagttgtccctcctttccagactgaaccagtgcatacctcacatatatcgcttgatgtcttgtgtctccctaaaatgtatgaaatcaaagggaagggaatcctctatagaatgtaaatttcccccacaagaggcagctttgcagggccatttcaaaatatgctaaagaaatatatttgggggtaaaatactttgtttcggggctgctgtctgtcatgcgatgccatactggagtcaggttggcactcggtgtcttgttgctacagagtccgctgggtcagtcttaggatctctgctttaatgataatgtgggactgttgtgcctgaattccacagggaggagggtgtaatgaggcaggtccaatgcccctacccatcatggcctgaacctgtttttcaggtttctgtgggatccccttggcctagagggggggtccattcagtttcctggggggctgatggttttatttttggttcataccgctgaggtaccagatgctgtctggcagagccacaccccctgagctggccacacgctcccagtcagaacttctctgcggtttggatgtgtcagggtcctgtttccagaagatccgttaaagtcaaagcaaactcctacctaccccggcctcgtggagccttcctgcggtcctgccatttgccccatcctgtagacagggctgcaggaagcagcccagccagcaaccagtgtggagggagagggagtccaaggcccaggccggcccctccccatctggggctgccctgcaaccctcagtggtaacttaggacagctcctatttcccctttggctaaaagggtctacaccagtgtgtcaccactcccaaacagtccccttcctgggcctttgccactttgttgaatgaagacctcacctgcagttaagcaaaatattaacacgtgagatgcctttcaagatgcaaaaggatattttccttctaaaatcacatgggcaggaaggctctgaagatgttagagccccagtggactggagaaagccaggaagaaagcagtgtgggtcctgcagtagcccctgccgcttctcctgcctcctgctctcccaggacgcccggggccgacccgggccgacccttgtcatgctccttccgttcgcctgggcctccatgctttcagctaccttctgcatcttcaggtggagcccagtgacagatactcgcaggaaggagaaagcattcaaatggcttaggttgatggaaagtgacactgattacagccaccatggtagacgcttcacgtgtaccttaccaaggaagggcacccagccacgatcatgggcgactctacaaacccagccccttactgaactccaataggccaggctggcttcttccagagtcaggctggcccttggcacagtgcccgtgctatgtatccagaggcctgggcccacatcctgaccctgtttctcccttattggaggccctggcatttctgaacccactcacctctaagaattggattctgtacagttaaaggaacagtgtcccttccccgagaggtggagaaaaggtggccaggagggagagggtcctgggaggagcatttatgcgcgatgctgagagatgggattctacggagggaggcagcattggctctcagctcagcaggggctgtgccccagcccaggacgggtgtcctgctcctgctgtctggcaggcgtctgcccgcacccccacactttgcttttgtcttcagtacaccctgcctgccccagcaggaagagccgaggaagacgactggggttggtcagatggggcctgagcagtccctttgccatgctctagtaccatggccttggataagtccagtctgctctccaagcctcagtttctttctgtgtaatgtgagcagctcctatctgaaaggtttattgggcggatttttgcaggtcatgggtgtgaagcccctagcacagtgctggactgtggtcagaactcagtatcactggcccgcatcttcactgtgagcccaggacaggccacacgtcacacgtcacctcccacaaagcccggcagagggtgcccagggaactcttgttatgcccagagctcagtgacccaggggagcacttcttgctgtccccttcccttgagttctccaaagcaggccatggccatgatcacaggctgaggagccaggccgccaggggccatcctggctctgcctcttccatgggagcactttttcctctgcaaagcggggagcagtcggacacctgccggcgatatgaagtctgagcgagtcaggacagggggaggcccagatcccaggcgaagatcagtgctctgtcccgccttggttgctgggagccctcctgtcccctcttcctcagggactggacccaaaccaggccaggccggaagactagttgtgtgtttcagatgtcacttggagttgtgaagcttttatcaaagctgagacaatccctgttaactaaaatccctaggacaatgaactgttgtcctttattcacttcctaattatagaagtgtcctgccatgtagtaagtactcagtaaatgttagcatggtagcagataaagtagaaaatctcttttcccccatgaccctccttgtgaagaggtttctaaaagccagtggtcccttctccctgagtaaagagggtgtggtaacttccagaaacgtttcttgccctttgaggatatgtggcactgagtagtcaccacacaagctcatcccccggtgcggagatatggctacttcaggaattgggaggaccccgcgctgcgcccggaatgtgctctggcaatggtttgcctttcttttctgtcatttcctttatttttgtgtgtttccattcatctcttgttcctcaaagctgcacacagcccgcccttctgctggccaaggtctggttagcaaagggcctgtctccggcggatctggctttcctcgctgtcagccttcaggtgccctgaaagctggcgaaggtttctgagtcaatgctggggttgagtgggagtttagaacatcactgcggtgccgcagtcactcttggacgtccacgtcctcttggaggtttgaggcaggctcagctcagccgttcgctttggtatcctcataatcaggtagaaagtctgggccggggccaggggcagtggtgcacacctgtaatcccagcacttttgggaggtcgaggcaggaagattacttgagcttaggggttcaagaccagcttgggcaacatagtgagaccccatctctacaaaaaaaaaaaatagccaggcatggtggtacatgcctatggtaccagctacttaggaggctgaggcaggaggatcactcgagcccaggtcaaggttgcagtgagccatcatcacaccactgcactccacttttaaaaaaaaagtctgggaaggcggctgcctctctctgcctttctgcaacagcagacgttagatttggtcccagagccactgtaggaactctgtggtgactctcagatttgggggtgacttggctggcctcagacctggagtggtgcccaggcctcgcttgtgcccagcaaggggtgtgttctgcaggtggagcagagtagtgggcttccagcctggctttggggctctcttcacctgggctctctgaagcttaagtctggcagtgtcctctgtgggacaacgtttatgtcaccatgcacaggctctggggagactcccgtggccagcagtcaccacacggggcgggggccaagcaagtcatggtctgcatgagctggcccaagtcacttagcttttccaagtgtaaagtaatgcccaccacaacagagtaaaagtccagaaagaggcccagaaatacacaggaatttcagacaccatagaggccattccagattggggggaaaagatagctcatcaagaaatggacagcttgctgccagggcaaaaataaggttggatcttgactcttacaccttacagcaaaataatttccagatggattaaagatttagctataaaaaaggaaacaaattacaggaaaaaatatagaagaatgtaaaacacaatcttggaaaggcaagatctttttaagcctgacataactgagaagctctgcaagaaaagttgggtacacttagctacaaaaaatagatttctacatgaacaaagccagcataaaagccaaaagataaatagcaaactggaaaacaaatatctaactcatttcatagataaaaggttaattttcttttttttttttttttttgagatggagtctcgttctgtcacccaggctggagtgcagtggcgcgatctcagctcactgcaacctccgcctcctgggttcaagcgattctcctgcctcagcctcccgagtagctgggattacaggcgtccgccaccacacctggataatttttgtatatttagtagagacggggtttcaccgtgttggtcaggctggtctcgaactcctgacctcatgatctgcccacttcgatctcccaaagtgctgggattacaggccgagccaccgcgcctggccaaaaggttaatttgctttattttttgttgtatgtacacacacatacacacacacttgtgcacacacatatattgttgtttttgtttggaaacaggctggactgcagtggtgcaatcatggctctctgtagccttaatctcccaggctcaagtgttcctcccacccagctttccaagtagctgagaccacagctgcgcaccaccattcctggctaatttttttatttttgtaaaaacagagtctcactgcgttgcccaagctggcctcaaactcctgggctcaagtgatcctcccacctcaccttggcctccaaaagtgttgggattacaagcgtaagccattgcacctggccaattttcttattatgtaaagaactcctacatagctacgcagaaaagaccgacaacttcatagaaaaactctgaggctgtccgggcgcagtggctcacgcctgtaatcccagcactttgggaggccgagatgggcggatcacgaggtcaggagatcgagaccatcctggctaacacgatgaaacccagtctttactaaaaatacaaaaaattagccaggtgtggtggcgtcccagctacttgggaggctgaggcaggagaatggcgtcaacccaggaggcagagcttgcagtgagctgagatcgtgccactgcactccagcctgagcgacagagcgagactctgtctcaaaaaaagaaaaactctgaggctataagccagttaactcaaggagctctgggtgtccccaagtgtgcggcaccagggccatgtggacagcagcattggggctgaatctggctccaaatgcacttaccatgtgaccttggcaagtcaccagggctttatgggcctcagcttcctcagttgtagggtgggaataacaacagtcccaattttgttttgtttggttttgttttgtttttgaggtggaatcttaccctgtcgcccaggctagagtgcagtggcgtgatctcggctcactgtaacctctgcctcccaggttcaaaatgattctcctgcctcagcctcccgagtagctgggattacaggcgcctgccaccacgcccggctaattttttgtatttttagtagagacaggtttcacaatgctggccaggctgatcttgaactcctgacttcaggtgatccacctgcctcagcctcccaaagtgctgggattacaggggtgagccaccgcgcctggccacaatagtccctattactaaatggcttgggcaggtccagcgtggagtagggagggagtgctttggaaatgctagatagataaaacgtggaaagatgctcatcctcacctctggatgagatgatcctactccgataagaaatgtgcaaattgaaactgcagggagactctttccctgctgtgttgctgatggtgtgggggatctagcactggcgtcactaagaagagcagaaagagctgtcagtgttaaggcacgcacccttgattcaagtaagcagaaacccttcctcataacaggcctagacacgacactcacggggagggtgttcatgcagcactgtgtgcagtagctgaagttggagcaaatgtccttcaacagggaactggctgaataaattatagcatattcctaacctagatgatgctgcagcttgtccaaaggaggtgggcccacatgcactgctgcggaacaatctcctgtgtatattccgtgataagaacaaggcaccgagcgtgtgcgagaatggcatttgtgtgaaaatgcagtgtgcaggcacaggcctgtctgtgcccagcggggctctggggacgtccaggaagtggcagcagctgcaactgcgagggcctccatggctgagggatgggcaggacctgtgaattttgcatcataggccacactgtgtattttaaaattaaatctgctcacactatcttgtgacttctgtaattagagacgtcctcgcaggggccaggagcgtgaaggagagagtcaggctgcccagggtcccctcttagctccaccactagatgtgtgatgtcaagaaatttctgacctctgtgtgcctcagtttcctcatctgttagattaacgggattaacagagaccctaacatgcaggttgtgagcatgaagtgggatgcgccaggtgaaagctctcggccctgtcatatagtaagaaaggagcaggagcaccagcctccgcccccacatccttgcatcgtgcttagcgctgcaggtgggcgctccgtgtgcctctccaccctcagctgctccgttgaggccagtggaggtctcagaaaacagcacggactgggctcagctctgacccacccttctccctgggacaaggacgcccttttctgacagtctcccccttggaggcttctctccttggggtgaggctgggtcctcgggtacccaagtctgtcaccagccacccgcctgaggtggttgttacaaccttagaattataaaatcctgtctaagaggaaccttaggatgagtccactagttctttatcttggatgcatggaacctgctccccagaaaaatgcacacacactcagggggccgggacttgtggctgggcctgggcaggcggcacccccacccttgtgtgccctggccggcctcagcaccctgtgcatattctggagccccagctctgcctagctcccctgggagccgcccggatggacgtgggcagtctgggcagacttgtccccatgccctcttggtgcctgcagtgaaggagaatttggtgcagggccctgaaaggcccacctgaccccctcagggccaccagccatccatccaggaggggccctgacatccacctttctgctctcaggggtctaatgtgatggaagagcaggacctgcgggacatcggcatcagcgacccacagcaccggcggaagctgctccaggcggcacgctccctacccaaggtgaccatcgccggccctgtagcctcagcccgtgcggagccagggccacctccctagcaccacctgcaccaagaacaggggaggagcagggctccagcacacgcacatcatagcaggacctctacccctcaccctaggagctccggaagggccgcacacaaccctgtttgcttcctcactatgccctaaggcccttggagagtcagcagagccctagggcagggagcaggctcctctggggtcatgaggaggttctgggggtctgcctggcccaggagcctggtacccgctggcttggcctttcacccagagcccccttcatggtctctctggctcactggagccctggccagcctgcactgagccctggcaccgggcccctccccgagtgggcttgagggaagtaccgtcttccctggggagccaggagctggtgggcctgagcctctcccctgcacttgtgctgaatgcagtggccccgtcccttctacctgtccagagcttgggaagcgcccgctctgagggcacacactattctcttgtccctccaggcccgtgacctcagcggagctcagggcggaggcgttctgcagaccccccctccctacctaggcttgtctgctagggccatcttccagccctgtcggtgctccagcggctcctgccttccccatggggaagccgagaccagcaagtgataggaaaggctgtgcgaagtggggggctggaaggtgctgaggaccccaaacacagagggccccctggccacagtctgtgtgagctggctgggtccatggtcctcgggtccctctcctgtgagtgctgagatgtcagtttcacctccctccttgccctgtaggtgaaggctctgggttatgacgggaacagcccccctagcgtgccctcctggctggactccctggggctgcaggactacgtccattccttcttgtcaagtggttacagctccattgacaccgtgaagaacctctgggagctagagctcgtcaatgtgagtagtccctgcgtggcccggcctggactctccagaagtctgagcttcccttaggggcagcctggcccagcggaagatgctgggggctggagcggactgtgagtgagttggccacctgacctgtcacctcgctgctcctcatcacccaggtcctgaaggtccagctgctcggccatcgcaagcgcatcatcgcctccctcgcagacagaccgtacgaggagccgccccagaagccccccagattctcccagctgagggtgagtcggggagggacagaaaggaatgtatgtttgttccctgtatttgcaggaattacatagaattctttaggattcttcagagaccactgtagtgtaggagaaagcagctccaacaagaagagaggagtacaggagaggaggtttagagaagttccccgccacctgtttctacttggggatggccgatcaaacacataaaacttgggggatagtaggaaaacaccaggccatggctgggtattgaactcagctctgtgcctggggacagggaggggccgagtcaggtaacacctgagacaaatccaaaaggccaggactcacagccacctgggcaccccccaaatctgagttcgaattcccaggctggggtggctaagacagcttgcattttaaaaacctcacccatgatctgttgctcctgccggtaattcctgacaacagaaacgggttagactcagagcctgcagctgaggaagagctctcccccagccccaggccagaacatgcaggaatggcggtaactagagcagccgctccccgagccctcgggtgcactgggcctgccccgcaggtctcaccccattgaaccctcaggggcttcgtgaagtgggtcctgttcatcctccttttacagatgagaaagtggaggcccagccttgctctgggaaccaaacacacaactgacattcagatatagacactgagaagccaggattgtattctgttggggacggtggctttagggccctgactgacagggctccattttttctcaagggggtgctttgtttggtcatgtgcagaggcctgcaatggatcaggacagaagatttaatcttttataaatgcaaaagtggcttccccgccctctcgggggacactagtggacggtggctgcgtggtgccacctgtctgacacccctgtggtgttggccccttcgctccctgctgcttctcccggtgccgctgcctgtgccgtcctaaccagtggggctggctgatacctgtagtcgggcactgggccgagggttgcaagttccacctggatttttccctccacagtgccaagatttgctctcccagacgtcatccccactgagtcagaatgattcctgcactgggcggtcggcagatctgctgctgcctccaggggacacaggcaggaggcgccatgacagtctccatgaccctgcggcaccctcccgagcggagcgcttcaggatccaggtggggcagggggagtggaggtgcagccaggctctacctcattcctctgggtgggacagggcctcccagaaccacctgctgccccatacttgagcacagttgggctggcaccagagtcaggaggcactagcctgctctgctcgcccacacccagccgccttgcgtaaggcccacccagcacccatggtgccgagctcgggccgcacaactcactttagctgtcagctgctggggccactcctgtgtcctgtacttccctccctcaggggttcagatcccctgtccgctctttctctgtggcctcttgcgtcctgcactgcctcccctgctggccccagagccctctgtgctctcctggcctctgagctccttcttggccccttccttctctgcttacccacgttgttccccagaactgctttccctgcagcttcacctcggcagcattctcttcctcctgctcagcaaaaccacagccagaccagattctgttcttcctgttctctgcctgcagccccgtggggggcaccgctggagacgcctcctccgctcccggtgcccgctccagccctggcggaggtgggcccgtctcacactcctggctcaccttctcagggcatcatttccaggggtcctggatttactcaggacctgcctgtcctgcctccctccttgtacggaccttggctttgtcctttgtcctcttcttggcctgtcagacacaggattagcaggtgtccctcaggcccctccgggtgaacttcagcttcacccctgcttgtttctctgactctcacttctcacttctggctctggggacttcctttccctttctacaagcacagccatgagttttaaaggatttttaaacacattgtccagcaattccggttgctgttgagaggctctgcgcactgctgggaagggagggcctccgtgtttcctgaatcttttccttcctctccattccttccaccagtgccctggacagggacccatgatctctcacctggaccgcagtggcctcccccaccccctagctgctgccagaaggatccatttggaatgcattcctaggcacgggcgggtgcttcactggcttccccgctgtgaagatccctcccaggccctgggctgggtcccaaggcgtcccagggtctcgtgggcgctgttctctcctttggtctttgtgcagaacagcctggcagcctgtgccccccacacagactctgccatctcctctctggtcatttcccatctcctttgagactcatctcggacaccacagagactgtccttcccaagccctgctctcaggcggtttgggtccctgctgtgcctctgctgtggctagcacctcccctctcccgcagtgtgtttgaattgctggtctgccccctgccatctccactcgacccttgaacttgctaaggtcactggcatcttcacccttgagtgtgctggagccaggcagcaagcccatgtgctcctctggagcaaggagcaggtgtccaattgcgtgtgtttcgcaggaggagcaccgtgaggccaagctgaccctgcggcccccgagcctggcagccccctacgccccagtgcagagttggcaacaccagccagagaaactcatcttcgagtcctgtggttatgaagccaatgtgagttgctcccaccctcccagcagggccggcctccctgctccttctcggccaggcacctgcggccaagtcccagcagggactccacaaagccaggcccagggcttttgagctgttctccactctcagccactcttgacagctaaggcgaaggggtggaggcctctggatcctttagctagggagttgaatggagggtctctccagctggggcaggagagggggtgttgttattgagaggggtaactacttgattgtgggacagtcccaaattggttgggtcacccctgcatggaaacgcaggatttcctaagcctggccactgctcgcccccacagtatctgggctccatgctgatcaaagatctgcgagggacagaatccacgcaagacgcctgtgccaagatgcgggtagggtgcctgtgtgggctggagggcgctgtgggactggccagcagaaggcagcaatgggggcagtagctgcagttgcctgggccctgctgcactatgtaaggatgggaaggaagctgggacctgtggaagcccaggaggcttagccctgagaaggggcactgacagggccaccccttgtttcctgtagaaatctacggagcacatgaagaagatccccaccatcatcctgtccatcacatacaaaggtgtcaagttcatcgatgcctccaacaaggtgtgctgcttacagggactcttggtgggagtgggacccacatccccgtcagacccacagggctccagggcaagcaacccggctgccctgtctcatctcttatctccctagagggtccccagtcctcttattacttcccactttgctaagaggcgtgtctctcatctgctggcctgggtgcctgctgtcagccccgtccccgccctagtgatcactgctgttagcctcgccacctgggctccactggccgcacacctgctcacaggtgtgattccctccgtgagcaaaggactttctctgtgtgccaccgtgtgggatcccaccttcctgacacccttcccactttgcccccaccctggaaggtgggaggggctggggagagcttgtggttgggtgtgaacattttactgccttagttgttgtggtaaggggtggagaccccaaaccaaaatcggggacccccacccccaccaataaacaaaatgagaagatgaaggggggtttgcttgatgctctaggctgggacagagaacagtgacaatggtaacaggctggggcagggggtgccagaggcatgcctgagcctgagaattccagaacacggctttccccagcagaacgtcattgcagagcacgagatccggaacatttcctgtgcggcccaggacccggaggacctctgtacctttgcctacatcaccaaggacctgcagaccagccaccactattgccatgtgttcagcaccgtggatgtggtgggtggggtcctggggccgggtggggcaggcttgggttgcagccctgaggcgtccagccccattgcagggcacagatgcggcgctgtcctggcccctggccagtgcctggcaaatgtttggttcatgaatggagcccagcagcactcaggccggtcccctttcacagtgatgagactgacgcgcagagggaacagggactggcccagggcactagggacaggaggttccagctttttttttttttttttaagagatggagtctcactatgttgcccaggcttgccttgcactcctgggttcaggcaagttacccacctcagcctcccacgtaactggataataggcgtgagccaccgcccctgactttccagctttttggcgagtgttttcttaggtcaggcaaggcctttgtttcccccggctccctgccctaggtctccaacctctggctgggccgcctcccagaaatgccctctacttccctcttaggggcagtggtgccctctttggcagattttcttccctcaaattcctgctgaggctcggctctggatgccactgggccgaggagagttcattctcacacagctgcccacagggagcagaccagaactgacagcccacaggcgggggttccctctaacctgcaacaaagcatgagagtggccccaggctgcttcctcaccccgggaggaagtcagaggggtccaggtctctgccgccctcagggatagcagctgcttccagaatctctgtggctcctggaatacaggcagctctgggcatccccacactcctgggacctcatccaccccagtcctctgtttgctctgggccagtgaaggttaggaggaaccaggctttgctgcttgctggctgtgtgagcttggaaacatcgcatctgcctgcttcctcatctgtctggaggggatataatgtggcccacctcaggggccactgtgagatggatgaggtggtccacacagcacagtcagtggcatttacctgttgctgacttttcccacatacactcagttctgctgtaacgccacacatacgctcctaacaatcactgtgctgtgtaaaatcacacaaggaaaaccacagggtttatggggaaatggagttaggggcacagcactcacagactttgtcggtgacacattaaaaataaaagcactagcaccacttacattaaatggtaagaaatacccaagtactgctgcaggcacggcaccctgccttggaaaagacctgccgtaggcttacagcagtgtgcacctgccctccccgcagcccagctcccggccacatcctgtgtagagcgggaagaacaacagagacctaggaagagtaaaggagggaaaggagggaagagtggaaggaggtaggagcgctcccgggtagacttagagggggacacatggtccctgcgaggaagggcatatccagtgtgaagcggctcctgaaccaggtgcttaagtggtgatctgcttcctcccagaacctgacctacgagatcatcctgacgctggggcaggccttcgaagtggcctatcagttggccctgcaggcccagaagtccagggcgacgggcgcctctgcagctgagatgattgaaacaaaatcttccaaaccggtgcctaagcctcgggtcggcgtgaggaaatccgcagtacgtgggccccactggccaagatccccctctccctggccccagggattcaagggctcagggtggtcagcgtgaggagggtcttctggcacttccagaaagctggccctccagggaaatgaccctcttaattgtcccccaaccctgccaggtctcgcccctggaaaggcagcagctcctctggcctgggcgggcctctcatgctcctgtttccctccctcgctgggctcccccaagggcaaggccgtcaaggggctgcagagagcggcctgcaggcagcccccagtaactgcgccatccctgtgtctgtgtctgctttgctctgcaccccaggtgccgctgccccccgatagtcgctgttgttactgtcacacctgcaccacccaccgtccttcctacctaccgctgccatctgttagtcctggagtcaaggtctttacgcctcctgctgtcttgtgtgtcagtctccccgaagtgaccgtgagcgctcttagcctctggcggcctctccctctgcctgtgtgacattctttcccctcttcctgagatgccctctgcctgttctgtgtgtgcttcagccctctctgtttttctgttgtgtgtcctctctccagaggtctggggtgactgctgtggtcttgccttggggtgagctctctgggcctaccagagagacccgaggctggacatttgcaagccccatatccccttcctgcccagtgtgagtgggtctggggcttagagcaggaggcccgcctaggacaggggtcctttaactgagcaatcccaagaaatcccggagagaagctgtgcctggaggtggccctccccaagatgctccaggagggtgtccctcctccgcctgcccccaggggcctgctctttggccgaggagaataagggctgcccctcccagcacaggggccacagcctggcctgggggtgggaggggcctgctgcctccagccctggcacagagctccctctgactcttgactgcttccttgtttggcagctggaaccacctgatatggaccaagatgcccaatcccatgccagtgtctcctgggttgtggaccccaaaccagactctaagcggagcctcagcaccaagtatgagaccactatcttctaaaacaacccactccctgtctccactagtctcactgtgcctttgccatccgatctttctgctgtcctcaactctctccttccagctgctgatgccaaggccccacctgcactgggacctgctcctcttgggcgggcggcagcgtagacgctgtacacttgcagctctcgcacctaccaccaccgaacactgtgaattctcccccttgggctgaggacagcttgagggggtgagttgcctttgaggtgggcatcaagagggctcaggggttctgttgcaccctggaagcctccacgggcaggcactgtgaaccccgacgggcagggcagtctccagcaggatcccaacggcactgatagctccccagggttgggctgggctctgtgtggctccctcctcctgtctgctgtactgagccacagctgggcaccgttgccaagagctagctgactgttctcacctctcctgaaccaaccaaccactgtgaccacccagtgccagagtccccagcactctgctcacagccggcctgcagccccaccccactgtcctccgctactccgaggtgctggcctcactctcatggctaggcccttgtgagaccttgagctcagtgatgtggctggaccagggacagactgctttctgtgagggcccaagatatgcgccaggcccttgggtccgtgctgactgccccacttggggctctgggtatctgaacactcacaggctggctcacacagcaggtgtctcagtcctgatgggccttcccctccaaggaggtgggtggcatgtgtgtggacagcccctctatcttcgccatggagtctcaaggcctggcagccttgggcctggctctggagtctagctcactgaggaggaaggccttccgtagaaccaacgaggaggcggcctgtgccctgcacacacggcgcaccttcttccctcacagaacagagctgctggaggacagggacctggaccaagtggcctccattgtcctctgggagctttctgacactctccacggtgggggatcacagatagacagcgccgtccagcatgcccctgaccacctccctcagcctcctgactcctccgaaaggagaggccgtcccatcgcagcagctcagaagctgggatggtggagctgagtctttgaagaggcaccccattctccagtgtgggcaaatcagtttggatggcaggagacaggaaggaagcggcgcccataggcagccgtgcacacatagcagagtccactaggaaagccagtcggccagggcagtcaaaacccaagtcgataaactgggtgggtcctgcgtacccacccatccttgtgccttcctgagcagagtcactgagccagaggcagtgggggctgcaggctgtgggtgctcaaagcaggcatggagggtgccccggggaggctgtgagggatcgtctgtcctgctctgtgtttcctttccatttcctccaccgtccgcaggccccattggttaaccctttcctccccccattgtttgcttctgccaagctgagccactgaggaaccacactgtgctgcggaaacatagacgtgggggcataggctcccactgccaccaccgccatcgcctcacctgcagctctgaagacccaggcctcacctccgcctgcaggacctcctcttggccacttggcctgggcctgccaccaccacgtcctgcagaacgagccctgccttggctgtggagaagcactccaggccgctagcagatgggactggcattccagagggtcaagaagtgacttgttcagaacacattgtttttaacagaaaaaaaatctttttataaaatgaacttttaacacttggctcaaacctctaggtcatactgccaatctttagacaaatggccatggggcagaggacaggggagctgaggttggttcagaggccagcctgcatagcctctgtcctcaggacggaacttgggtgcagctcagtgggtcggaagagaaggcggtggcctgtgggtgaggggaacggagcaggctcaggcagaattgagtacggtgcgtctgcttttcaaacccaaccatatcagctgctgctctttatgaactgcccaacttcctgtccctttcaggggctagacacaggcttctcgtaagaacacagccttagaggcacctgagcaactcaaaggtttccggtccatttctggggttcccgatgggaaggttcagtggccaaatgaagataagtgtgcagtttctagtgctgggaagtcttagccagcaccagagcgccaggcctctccctggcctcttacctgtcagtgatcggagcactgccctgggctggccggcgccgtactgcctgcgttgtgtcagagaataggaaaagcagctttgtttggggcattaatgcttggagtggggtcagctaaggttgctacttgccaatttgtgatttgtctaatcagcctgtgtgattggggctcattttgattctctgaattatcggtttgacggttacacttggctgctgggcccatccctggcccccggtgtggaaaaggctaaataaggtgacagtgcatcgatgctcccccgcgtggcctttggggcaggctggcatcccggtgcgcctctgcttcttaagctttcctgctgctcgctttgtttttaaaagtaacttgggttgcattcttccctctggactagagtagaaatgcaggggaaactgctgtggatttgagaggcaaagttggctcagctgtgtgcccagttcctcctgtgggcactttagcaggctccgagctttcctggcataggtcaatcaggtcccaggatgaataatccaggcttcagcaacactcctctttcccagccagcaaaggctgtgaatttgaattctttgttggtatgtatgtgcagggagtactgttaggcacattcttaacccatgtggttggccagaaatcagaagtggggctgtgtctctgactggctagaggccaggccttgtgggtttctatctgctaagcacccagcaggttggggcctgggactcagctctctctgcggtagaggcaggccctcctccacttcttggtactaaacgaagatctcgacaccttgcagttttacttcatttcctgcccctttcagggcctgtgaggatgcccatgagctaccgctgtacagttctcggccccggctttcttccaagagttgaccaggaaccctaaagcatccagagtagactgcgctgccactgcgcacatgctggtgcccgtcttcctcctaaggggccaggccacatccaagtgggcctctgtcgggggcggggcggtaggtccgaaagaaaccgcagacactacgatgcactcctcaagctgtcttttgtgcttagatcatccataggtgtttcttctgcttgaagctgctatatcatctttatttattcagggtattttcatattggaagccttggctagtctgctctagctctgggttctgtttagagattggtttatttctgaatattcaagaaaggaaaatgactgggcctttctttcttttcttctcctctgggatgggtagtctccctttcctagaaaggttattataactttaaggacaggcttcaagtgggaaggcccctacttttgcacttctccaagtgcaggtcacaccaggggcagaccctgtcgctgcgtttctgaactgtgaaggagcccattcgggtgggagacttcagatgggctcagtacctgtcccagccacaggcttcttgtccacctcttctcccctgcccaccagctgctcagcgcataagaccttcccgacaggctctgcgtgtgcagctctctgcgtccctcctgggccctccagcgtcagacactaatgggagttcccgagatgctcgggtttgagcagggagcaggcagagctgcagtcagagacattagaaaaccagtctgaattgggtctgtctttgagatgcccaggccagcagaaagcagctcagaagtattgttgctcatggtgtggcaatggactgaactgtaatgaaaatgttatttaatctttgtctctgtattttgatacttgaatgactttcccttttgttttactgtatataaaattgttaatctgtctgattttgtctgaattataaacactttgaggtaccaaacataaccaatctgtgcaacaacatagactgacctcagtacccaagagagtgtaaatatttctgggcttccagctttggttttgttattttcataactgtacacaacttagaacagactgaattaataaatgagaagcgacatgaacgcagcctt

SEQ ID NO: 37782 - DNA, 62085 bp, Homo sapiens; identical to SEQ ID NO: 37764

SEQ ID NO: 37783 - DNA, 210704 bp, Homo sapiens
gaagtcacttcccatcccggttcgcttggggggaaaccaggcgtccctggaagggaagggaagggagtccgggctgcgcgggtcaggtagcctctctccggtcgccgcgtgtcctcgccgtccccaaacctgcccttcccctcatcaagggaactccccggggagtccagaccgcgatccctttccttggccccggggtgcggggggcggacacgcgaggcgtgggactgatggtagccctgcctccaggaagcaggcaggcggggacctctgggcgctcggaggggcagctccgagggcacagggtacagggagaatcagccagatccctccctgccccgggcagccgcggcgggtgtggccagcgcggaggcaggacgccgccgagcctccaactttacctttccaactccgacagcccgtcgcctttctgaccgcgtccctacggtttcccggcatccgcctccctctccccaccacacctgaggaaaacttttccctcgcccctcaattcaaattcagcagtgcccacggttgccgcaaaccgcccggtccctagcaacaaggttccggccgtagagcgagagcctctaggtgtaaggaaggtgatgtcgtaaagccgggagtgtcgtaaaccaggtgcggtggggaggggggaggggtggaggcggaggggtgggggggaagggggagggagggggaggaggtgactcgagcatttagacacaagcgagaggatcatggcggatggccccaggtgtaagcgcagaaagcaggcgaacccgcggcgcaataacggtgagtggcggaggggaccggggagcggcggagtcagggggagctgggcagccggggcgcccccgggggtgaggggggcgagccgggctgggggcagccggggcagggacggcaaagtggagtgggaaagtagaaagtagtgctctctgcccccctccgctgccgccgctgccggagccgcgccgcggccgctcgctctccctgaaccgttatgtctcttacctggtctctctccgcctagcggctcccgccgcccctgccgcctccctggaccgttagccggcgccgacgccgccgcatccccggcgcagggcgggcggccgggacgcactggccacttttctggtcccgggtggagcggctgttgcttctttccgcacttttccccactcttgtgcccttcggcgcctccctctccccctcctcctggccccctcagcgcgattctccctcagcgcccaggcccccgggagccgcggaacaaacttgtgcccggcgctgaccgtgcaaagtggcttccgcgcgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcgagtggggtccacgtttggcggggcgcggcggggcggcgcggggaacaaggcaggaaaggtacccacttaacgccgccgggagccgcgcggatgggggcgagctgggcggcgggtgtgtttgcggagttgttacctgggcttagagaccgggaagcaccacagacagatccccctcccggggcagacgaggtctctgcgccgggatgggccggtgtgcgtgcgcctcgcgcttttctctttcggtttttggggaagttgttacctgggccggacgcacggagcgctgaagccggataatggggcttggatggcgctctgggtctcgggtggaaggagggtgggggagggggcggacggaccgacggacgcgcggggctgctacttgcaccgcagctgcagtgtttattgatttgtgctgctgtgccaagggaaacacacacccctctgcctggcgtgagagttaaaaaaaaagagagacagcccgagggatcgagacctgaacatgtggtggtggttgcacagtcgccttttccagtttggagagacgttgtaagttgattgtatttctggttatctcggggcgatgctatgctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcggaccgaggggctcgctttggttcctgcgttatttttaaaacgacttttaagagaggggcaataaatgcgtctataatgggaccgctgcagcgtcgagaaaacgaggaaatacgtgtttaggagaaaactctctcgtgctcccccagccccaccccccgcgcctgggctccctttctccctcccctctgggatgcgaaacgcgaggttttgtaacctttcctggcaattttagattttgtgtgggatttcctgtctagaagcagatacgaagatttttaagctgtttcaagatgtttccttccaatccataattatatttttaatatattcgagccatcattaaaatcactgctttcgtgattttaattattcaaataaacacttgcattttaaagacgtctgttgattataaacgaaaggtattttggtattctcattgtggagagatgacttgttatagcaaggagtggagcataggctattgcaattttaatttcctgttttagcgtcaaatagtgtgtgttccatattgagctgttgccgctgttgctgatgtggctttatgaaaggtaagttggttcggaaagagctgttcgctttttaccttatttaaaatgttgatcgccagagaaaggggcttttcttgttgctgacgacatgtgtgtgacatgtgagtctgaaccacccagcgtctgtgcagctgctgtaaacatgtttacctgaacaggaaagaatggatttttctccttgagatcctgtgatatgaatattacactcgtaaggcatatcaacagatgacttaaggggggaaaagcgatcctgaaagatacttgaaatcaacaggaaagagaggttcttgatcgctgcagcaaatggcaacttgtgcaggtagaaaaaaagatggtgtttagttttctcctgcatgtatgtcagccccctcctgtctgctgctttcattctcaagggagggatttatttaccacgcttgctgtcagtgtttttcctttgtgtttaatattagaaaaacagatttgcgtctgtttagcacaaaacgtcttgtctgcagtatgcattactctcagaaaacaaaaggtgtttaagatagcactgtactactacaggtatcttccattttcatcacttttggctctgtccttgtatttctttttgttctcaaatgcatttcatccattgctggtgattatagccatgctatttgatttagccttatattttgcaaattaaaaatgaagttatattccattgtgttgtgaaacctcagtatatgtgctggttaatatttcttagcagtgcagtcatatttaagttgcagatgtttattggagaaaattgcctggcaaaacgttaactctcaaatctttttaatgaagaaatatgtgatatatacagtggaagattgtcgtagagatagtttatgttgttatatatgtaaataatgttttattcattttgaaataagatacgtggattttgctgctaagccttctgtaaaatattttaatttcctttctggaatatgtctgaaggtaggatattaaaaggagtatcaggtaatgtaactgacaggggtaaaccaattgagtaaggtttggccaaagcatcaaaccttgtgtggtaacttaatgatgttagtcatccgtaaaggagtgacattagaattgcttgaattagtttttaccatttataatttcatgctttgttgcattttaaaaaatctgtctttttctttttctgctttcttctatgtggttttcttcttgttctaccttttttttttttgagagagagatgtactctactaatgaccacatgctgattaattctctttagatggaatagaaggtacatatccttctgtcatcagcaccatttccccttgctgtcattggaaaccaccagtagaggatgctaacaaaaatgattattggtgtggtagcatcataagtctctctatcgactgtgctgattgggaccttcagtataattctgagtcttattgttacttaaaactagccttggttaaattaggcataagcattttctagtttgccgaaactagaaagaagcaggactgttttaacttgaataattttataaatttgagttatttaagtctctaattgagattgctgttaattcattcttgttttagagcagttgtattactccttattttaaaaagattttgttttatgttcttaggtttggagaagaatatgtaataattgacccatatttatgttgcatatttagaatactttttaatcacccctttttaaaattcatagtaagatcccttaaaatatatattttagatgttaaaatacatctaaaatggtcaaagtttaagagtagcaaggaaaattacaattgattgataatactgtgtaattatttttatataacttatgtagacttagactatggatgggttggcagagagctactaacggaggtggtaactagcagtcacttagatgttagtgatttttagattttatcttttccttccccttcaggtcttttcctactggtagccctcccccacctttttagttaagaatcagtgagtgcatacgttttaaatttgtcagttgtaattaaggaatataagtttgctttgagatcttatatgcagtaaaactctgtagttcgtacgttgctgtatgcttgtatttaaataattcctttcaagaaactatataaattgcatataaataattgcatgagactgtatttagttatgtcttttcattttgtgttcttataggtatattaatataactgtaaattttaagcctctcattaggtagaacattagaagtatttatttccttaattatttttagtggtgtttttataaatgcatcaatatcagtaccgtaatggaatagccatactgtttatcttgaactaagtaggtattgaattgccaggtaagcctgtgttaatttcttattttaggatgtcatggttcttcgtgtgtgtgtgtgtgtgtgtgtgtgtgtgtgtaaatagtttttcatttcctgacaggtatttcttgaatttagtattctaattcctgagggctcagtagtgaataggtgtgattcacttaaatgtttatgaactcagaaactttgccacaaagtcacgagatacattgtagcatggagcaaaacttaaagtatcttataaattgaaaatattaatcgtttatgaagatgaccctgatataaaaagcatgtgaaatatttgtttaatactgttttcttcctttctctagtctctagtatgtttgaaatggcatacctcctatgtagtagcttttgaagcatgtgctgagaaacttctgttaaattgagaatgatatttttaaaataagagcataatgatttctcatagttgtgtttttcttttgctttatcctcttgtggatttacctgtataaatcacttttaagcatgtggttagagccagatgtaaacacagatgcagtatcatgtggaattatattgttagctactcttaactacctgtattgaattgcagcagaggaggagaaaaatcatgcagatgttggaagaagatatgcattagtgtgcaagagtacagcgagaggttagaaaacttgaagctgtagaaataggattgaaaaaggtttctttgcagtacagtcactaatttatgtggaaatgcatgctctttatttctaattgagatataagctaaaataaaagtccattgttgaaagaaaactcaaaaaattttaaactagaaaaagtgtcctgattaggaaatatgataaaatgattttttaaactactttttaaagggtagatgttgtacatattactggctaaataatcattcaactagatatgaactaaaagtagtaagcaagtagaaatatatgtagtagagaaagttttgtagcaaccctagttaaaattaaatttgatctattatgtaggcattgccatataaactaatcattcttttgcatggggcagtgttttgagtattatgtcactaaaggaaacatctttaggacattagttttactaaataaaaatttcaatatgttatgagcatgtctggattttagccttgatggaggtgggttacgctgttaacttaaaactgggttgcttaaaaagatggcaatataatacagtacttaagtagcaaaatgctctctaataagtaaaatttgctttatgattgttttcagagaaaacaacttaatttttagaacttcattaattttgttaaagcatatttttggattatataatatggatgtagataaatggaaagattatgaaaggaaaagcaaaaaattgaattcaagtgtctatttgtattatagctgtgaaactttaagcttttttcattctctacaaagttacttttctctttcttcaaacagctccctgttgtttaatacacgttccctctatacatagggattgcatttatctgtccatatgcacatttctcctcctaatcaacattatgtatttattgagacttggtacatggaggttgaggtatgaactatgtttgtagaaaaccttacagtatggcaacctgggaaaaccttcatctcttttgcagtaacaactacatctgtgctgaaattattcataacagatgttttgtgatctcttaattccctccctctcccttcccctcccccattcagatttaaaattaaatgtgaatggaagataaatttataaattatgttaatttctttttattgttttattctatattgaaagtcctctgttttctctttttaaaatattctaattttaaatgtttaagatattttaagtactctgatttcaattatcttttaataaaatatgacaccattatttatatatctgttactattcatgctcacggcctaaaatatattctgatttcccttactcttaaggtctttgtattcatttaatccacaattctagcagagtgtttggttttgggtttttttttttttttttaagtagatagtgctgagtgtaactagtttgctgatgaaaaaaactcattttcttggaatcatatatttttaatatggaagattcatcttttccaaaataactttttatctgaaaactgacacagataagctgaaatttagggtctttaagtagaaactctagaagagactttaatgtgtgttttaagaaggggtaatgccaggcagatacagtgacatatggaataacatgtagtgaaatccttcaaggagtagattttctgaacctgggctcagggtaaccttgctctgccttgaatacttgaaaaggctgtcaaaatcactgtatctctttaacgttttctcctttctaccctaaagttaagttgctatttgctcctattgctacatcacttttctgaatctcttttgatacacttggcttttgctttatttgggagggagaaagtaaaggaaggaggaattggagtagacaaaaaataactttatatgaataaatattcattaagaaaatgaagtggaataattttggactggagagatttgggagaatcatccaaagccattttgcagtaaagcagacagtcaaagagataagatgactttgccaagtttatgttactagttagcttggactaggtcacagctttttgggttcctagttcggtattcttttcattaggtcatttgagcatatttatctaagacggtaacaagcaagaactagataccatgaattttcaaatttattatacttaaaaccaaaatgtgtagaatgcttcatcatctcaaaggcaagttctaatacatatgcatacatctgtcaaatttagtagttgatgtagttatatcacttaaaatatttcagatgcagagcattagtattatttagaggcatcctctcatttggattatacttttggtcactattcccaatttcagctcccattcactctatccttcctaccttggacccaatctaatatgttttttatatgctgttggttttgtagctagccttgtaaaattttgtacctcttttgtgtgttttgtatttacataagtgctataagtgctactttgctctatcatttactttctttttcttttcttttcttttttttttttttttttttttgagacagtttgacagtttgactcttgtcacccaggctggagtgtaaaggcgcgatatcagctcactgcaacctctgtctcccaggttcaagtgattctcccgcttcagcctcccaagtagctgggattacaggcacacaccgccatgcctggctgatttttgtatttttagtaaagatggggttttgccatgttagccaggctggtctcaaactcctgacctcagctgatccacctgcctcagcctcccaaagtgctgggattacaggtgtgagccactgcacctgacatataatttactttctttacttagcattgtttgatagctagatatgttgctatatgtacagctagttcattgcttttaaccttgcagtagttcatttatgtagtaagcacaaattacctatcaattcccctaatggcagattcccagattgactccaattcttagataccaataattctgtaataaacatcctcctacgtgttgctaatggctgtggaagagtttctcagcactaccatatctagggacatggtattgtccagacatagtattgctgagtataggtcaatcacatatttaataattactaaattctgtcagattattttaaaaacagcaacaccattttttacgctcaccaacaatgtaaaagaactattttctcacgtttttgccagccttcggtattgtacaacattctacattttgctaatttttcagttgctaaatataatctgatagttgctttaatttatgtttctctgtttattagggaggttgatcatttcttcatatccttgctagctgtttgggtttccctttccatatctggcctattcataccctttacccctctttttggatagatttccatttctcttgtgtatttaagatgataatccccaacgtttcagtcatttgactttggtacaggaatccttaattttaatgtcaaaattttgactttatgggtagtaagaagtccttcctaatctatagattataaagatattttcctggattttcttctattagtttcttagttgtattttttgtatttatatgtctaatgcatcaggagttcaccttttgaatacaccctttcttaagaggaacaagtatagcagttaagagtttgggttgatcctgtaacttactacctatcaccctggccgggttacttagtctttttatgcttgagtttctctgcatgtaaattggacatgacagtctaagaattgggaaagtttaaatgaagcatatgacgcattgtgcctaatacatgttttaagttttcaacacatgttcatttaaaattttacttatttattttaaatatatcttggatcagctgacaattttttatccttttgaccagtattaactccagctaatgtaactaccatctgaaagggggttgctgtaaaatttgtacattgtttgtgtaactttgacatttaacattgcttagttcagaccttggacaaagctgttaaatgatcaatagacactgaagcttcatcttaatgctacttttggtatgtctttcagctttaggaaggattccttggatctttttaagggccattatatgagagagaccttaccatatcacttttatgtataacattgacatgaacttcaaggataatgtcccattgttattctgttacataaatcaaagaactcaagtccaaggaataaaagctgtgcattctatatttgaatagtctaagcaacatggagtctgcaccttctcatatatccatttggctgggaatgtatttaagaagatggctgtcttactgtgttcctatggtatagatcaggactattctaagccaaaagttaaaaccataccctggtgtgtgtgtgtgtgtgtgcgtgtgaacttaattgaggtataatttatatacaataagatataccactatgcatgtacattttgatagagttttgacatacttgcatacatgtgtaactgctaccacagtcaagatgtaatagaacattatttccatcatcctaaagagttcttgtgtacttaatctcagccaatcttccccacctattgccccctagcaatgatctgcttttggtcactagaggttagatttaatgtttctagagtttcatataaaccgaatcatgcagtatgtcctttctgtgcaccttcttttgcacaggatattatcaaaattaataagtatcagtagctcattccttttgtattgctgagtagtattccattgtatgaatgttatatcaccaaatacacaatttgtgtcgccattcacctgcagtggaactattaacttgggttgtttctggttctttgctctaatgaataaagctactgtgaacatttacataaaatttatatgcatatatatcttacatttttcttgagtcaatacttaagagtacagttatagtacaggtaactgtacttctaagtacatatagtaagtatatgtttaacttggtaagaagctgcaaaattgcaaactgcttgtaacaaacatttttacatttccaccagccatgtatgagagttctggttgttccacatccttgcaaacaattgtccatgtttttaattttaaccattctagtagatgagtggtagtatcattttggttttgattggatttcaccggtgactaatgatgtttgaagatcttttggtgtatgtattggccacttgtatattttcctttgtgaactgtctgttcaaataatttgtccatttttaattggattgtttgtctttttattattcagttgtaagagttctttgtatattctggaccaaaattttttgttggatacaagtattaaagatatttctctctttctgttggcttatcagttttcttaatggtaccattgaagtgccaaagctttaaattttgatggagtttaattcataattttattcatttaagctttgtgtcctttctgagaaatctttgcctattccagatcttcaggatttctcccatgtatttttagaagcttatagctttaccatttaggtctgtaatccatttcaggttaatgtttggtcttaactcaccagaatttggcataagaatttttatttgaaatttttaaaaatgtttctcagggcccaactaatacccaaagctcaggattatagaggaacacaagtcctacttccctggttttgaacatttttaactgagagtgagtacattgtgcctagttggggttttcaaggttcttcatgtccttgacacattttaattcactgaaatatactttattgaggatacagtttcagagaaagatgcctaaggagagtggccctagttaggggaatgcgagtgttgtcttcaaggtttcttatttcctacaaggttttaaggaatttagcactataccaattcattttcatgttccgtagcttttatctttagatggggagtttgtttaaacctaacatttatcttgagtttttaagggatgtagttttctccttgagataaatgcttgatcttactgatttttggctacatattttacctcctcactttgttatagctaaagaaaaagtttttagttacttttaactttgataagttgattacagatgggtttattatatttatttctttcatttcttagaaaatatagatgttacttattcctatgtaattcttattttaagatagttttttaacttttctgttttattttatcacctattcctattccttgaaaattcgttataagtaacctgtgccttatttttgtttttacagatctcgctttttaatactccttttagctctgtgtctgtcttgaacgttctgtatattaatgcataattccttctgagctggtatccttaggtgcatttatagaaaaagcattgaactgggaaggagtcttaaatttcattttcttttcttttttctttctttcttttttttttttttttttttttttttgagacggagtcttgctgtgttgcccaggctggaatgcagtggcatctcggttcactgcaacctccgcctcctgggttcaagtgattctcctgcctcaacctcctgagtagctgggattacaggcgcgtgccaccatgcccgactaattttttgtatttttagtagagatggggtttcaccgtgttagccaggatggtctccatctcctgacatcgtgatctgcctgcctcagcctcccaaagtgctgggattacaggcgtgagccaccacgcctggcccgaagtgttaaattctaatattgaatctgccattatttggcctctgaaattgagaaaataattccatttatctgggcctatgtttgttcatctgtgggatgaatatgatggattattgtatgcaaggtaatgagaccctgaagatgagagatgtagtaccttgccctaaggagattatagtgtggtagggaagaaaaatgaggaaagaaacctttagaatacagtttggtaactgatgtgatattctgtcttatatgcatagaggggatggtgcttaaaccaagtcttaaagtatgtgtgtgggttatcctagtaaaatatcctagtggaaaataatattccatacagggggaatattatgtgcaaaggcataacacacatgcacacacatattgtgggactcaagtcacgtttggtaaaactgtagggtgagcggaagaatggctagagatgaggctggagaattggatagtaagcaaatgaagaaaaaatgctttatattgctttcctgaatttagattttatcttggacatgatgggaaattaccacaggtcttgaagcaaagagtgacatgattacatttatatacagtaatttataatattatgtttctttatatactcagtgttaatatgattaaaaatttaagaatatatatgcttgctttactaaaagtgaaaaaagttgtaaaacctgatgtatcctgctttcctgagtttttgcttatctattctgataatactaatagatttgcatagtaattgcttcgaaatggtgctgccactaccacttctaccaccaccataaattagtagaagacttacgctactagaagcataagcagccttacgttatagtggctggtatctgtgcaccaagtttggctgtgcatttctagtccctgcactgttagggggaattgtatatttttttttccttttctcaaatcagtaaatcagtgcaaacaaatgtgttgtggatttacaaacctatggaataaaatgtttttacttctatcaattatggctctccaaagacataaaatactcttcattcactattactagttaattttctagattatttctggcatttattaatggttctgcatagagctccaccttgtgaacatgttattgtactttgatatcagttctgtgtcatagatatttaataaataaaataaaactttatttacctgaatgtttctcattcagaatagctgtaattcaggcctggtatatgtttttatttgaatagaaacagttcactgtttttttggaggttatgctgtatactacaagatagattaaaaccagtgcctttttttagaccagctgctgaggaaatacctttatcatgtttcaacctcttaagtttaataattctcatgtaaaaattagtgcttgatttatgcatcaattttctaaacatttcacatgtgatctactttgtatattcagggacttttgtgttctatgttattatatagcgtattttttaaccaaaactttaaaaattaacctcatttcattagtatttgtttatactttactataccttgtttacatgcttaacctgcctatgtattatctgtgacagtaatgaaactgaatggttataaaatgctatataattttatcaagttaagctgacttttttggtggggaacatcatcttcctcttgctaatagataaaggagttttactgtactaatttcaaaaatggtataaagcagtaaggcagatcttcacagcctattctttgacagtatattaagcatgtggagaggaaagcaaggtgttagctattttaaggtttcacagcaacactcccatcttgttcattttcacctgagttgtatagagcctgggaattgctatatatctttaatgtaaagtcagcagtgcaagtaacagtattggatcatacttccaccattacattctctgagtttctgatcaccacattctcacagataaggaaaatagttgtagatggatggtctgaaatgtaaaaaggataaagaacacaagaagtggtaaatatgtttagtttcagacagacattatataaaacttgggaggagggtaaaattattgattagctacgggtaggcttggtaagttttaacgcatgttaaaatttctaagataaggaataaaaatctagaaggtatgtgtaccttacaaactagtagagaagggaagtagaacaagaaacaatattcaatctgaaaaaaaggtaaagaagctgaagaaagaaaacatggaaaagagaagacaagtagcacaaaagtacatagcagcaataagtgcaaatatattagtaattacagtgcatatgagttgaaaaaatcctccacttaacagaaactggttattagatgggataaaataacaaaatatatttatatgctgtttacaagcaataccttaaaaagcatattctcgcttgaaagtaaaaaggatttaaaaagatattcctgacactactaaccaatagaaatgttgtatggctatatatatcatgtaaagttgactttgaggcagaaaacctgtccgagagagtgagggtcactcaatagttataaaaggaaggtataattttaaataagtgactacctgataatacactttcaaaatacattaagcagaaactaggactgcagaagaaataggtaaatttatcattattatagcttatttaaaataatctctgttaatgtgagaacaagcagaaaaaaattaagaaaaatatagatgattttaataacaggacttacaagcctgctgtaatggacacgtatggaacattgtattccacaactaaagtagaggaggaacacttagaaaaactgatcacattctggtcaaatacagccagctttaacaaatttcagtggattggcatcacattacactttctgtttacaattccattaacttaaatagaaattttgtgtgtgtgtgttttggaaattaacatgtttatttcaaaataacttgtggatcaaagaaaaacttgtaatgatagcagtaaattattgtacacgacaacttatgtatagctaaaatgggaatttatagattttaatgcttatattatgggactaaaggttgaggaataataaacatgcaattttaagaattagaaaaaaagcatactccccgattgaaataacaggggaataattaatgaactagagaaagtaaaagtaattcaaaaaggaaacaatgcaactaaaaatagattatttgagaagagtaacaaaattagcaaaccactggcaagattaataggtggggaaagaagtcataaagcagtatctggaatgaaaatgggaatgttactacaggtgtttcatgaatgatcaactttattttaatgcagttgaaagattaagtggaccaattcctaaaaaaaaatgtagctcatgctggcccaagaagtaatagaaaatggaatacccttaaaacaaaaaggaaaaatattcttacaaagaaaaaaataccaattctagacaggtttactggcaaattctacaaaacattcaaggaacaataattccagttgtacagagagtatttcatggtttggaaaaagaaatgactgtccccaacttttttttacgaagctctaagtataaaaaatgatgattgtctttaactcagacctatgtacaaaaattcatagattagatatcatcacatggtagtacccccttatccatctgtaggtggttacctatgctcaatcacagtccgaaaatattaaatggaaaattcaagaaataaaaattcatatgttttaaattgtacgcccaggatgtggatcctccctttgtccagcatatccacactgtatatgctacctgcccattagttaccattggtagccgtcttggtcatcagataataaaaaaaaacatagtatttatagggcttccatgctatccatggtttcaggcatcctcagggggtcttgaaacgtatgccctgttgataaaggggaattactgtacttgaccaataatgtgtaagaaagtaacccatcataaccaagttgggtttactctagaatttcaaagttggttttatattagaaagtcacttaatagaatttaccacatcatctgtttaaaggaaaagaatcatgtgagcatctcaatagatccatctgtgataaaactcttagcaagtcagtaaatgagaaggcccctttcttaacctgataaaggcatttttttccaaagaaaatttccagccctaccttctttccacttcatggtaaagtattgaaggcattggttccctttgatatcaaaggacaagtgtgcctgctaatgccacttttagtcaacattgtactagaagtatagctagtacagtaaacaaacaaagatacaatgattagaaagaaaaagctattattatttgcagattatatgattatctgtgtaacccagaaaaattcacagatgaattactcaaagtttaaatttggatgcagaattattatacaaattcaattatttttcagactttttgctggcatagaaatgcaattaagaggtagcattatatcatcataaaagtataaaacactgtgagtaaatctaacaacgtgctcaatatctttatggagaaattatgaaacattggcagacataaagatctaattaaatagcataatgtaccatgtttataaaaggagacttgaacattgtaatggtgccatttctccccaattttatctgtaagttctgtgccatctgatcaaaatattgacaggtttttgttgaatttgacacgctaatccaaaaacttacatggaagaactaagagataatagcaagatactcattcatgaaatggatctgtgatggcactgggattgccaatgagtgaaataggatgaccctttcaataattggggttgttggttaattaaatggaaaaaattggggttggactgctgcctcacactatttagagaaaccagtggaaggattatagatctaaatctgtaggtaaggtaaaggtataggtaaagtaaaatggtaacactttataaagatgataggctagaatatctctatgactttgagtaaagataaaaaggcataaaacacagagcaaaagattggcaaatatgactacatcaaaattaagaattttgtttcactaatagatactgtagagtgcctaatcccgtatttagcacatatcaaaatctaccacccagggaaataaagatgaacaatctgatagaaaactgggcttgaataggcacttcacaaaagaataaactcgtttggccaaggagtgtattataagatattcaacctcattaggaatcagggaaatgcaaattaaaaccacgttaagaaggcatttcatgtctcctagattctcaaaacttagaagccagctaatactgctgttggtatagacatggaacaactgaacacttaggcgttgcagatgctaatgtaagtaggtacattcactttgggaaataatttcacattattaaagttgaagatacacataacactatgacccagtattcctatgtcttagagaaatctctatacagacataccaggtaatgtatgtagttgtttatacagtactgatcacaataacaaaacaaaaaaataaataataggataagtaaattgtagtatatttatacaatggaatgcaacacaatactgaaaaatgaatgaattacacctgtgcttaacaacttggatcatcctaggaaaataatgttcgaacaaaacaaatcactgaagaatatagtgtgattccatttatatagaatcaaagaacacgcaaaattaagtaatatattgtttaaggataccaatacacataatacaagtctatgataaacataaaatttaggaatgagtgaatttggacacagagtagatatcacaggtcaggataatgtgtgtttaaaaaaaaacgatggtggaactcagatatttattgtattacttattataccttaaatttattttatagaattctttaatgtttgatattaataattactgatagtaatttatggctactgataatcaacatttaatctaaaatagtaactgaaaaaataaaagtgaatgatttttgggggaactcagtatttgccatgtatttcctatgtacgtatgtttaatttttgtgagttctcaaatgtaatcaatttcttttgagtatctttagtattttatactatctttgtatttaatatagcagataaagcttaataatttctttctgttttttttttttttttttttttgatggagtcttgctgtgtctcccaggctggagtgcaatggcgcaatctcggctcactgctgcctccgtctccccggtcaagcgattctcctgcctcagcctccccagtagctgggattacaggcacccaccaccacgctggctaatttgtgtatttttagtagagacagggtttcaccatcttggccaggcaggtcttgaactcctgaccctcatgatccacctgccttggcctcccatagtgttgggattacaggcatgagacaccgcgcccggcctaagcataataatttctaaccctggttgtgtgatactccaaaatgtattcatttatttttaggggtataggcatttttaattcttttatatttttgtagtcactaaatttacttggcttctacctttacatattttctgtttattgaccaccttttaggaagtttgagaaaggtattaccttattatatttttttctaacttaaaatatgtgtgttactattgcacttgtggatataacatttcattttagaatatttacattttattttgtttatcaaacaatagcatttttgtatcaggcactattctcaatatcgttaaaatattaatttatttagtattcattgcaaccctatgagaaagatcctgctatctttgataggtaaagggaaactgaggcacggaaagtgttgggtaaggtcacttagctagtaagtggagcctgtgttcaaacctaggcagtctggttccacagtctgtgcacttaaccactaagctgtaagagaccatatgaagtagatctctaagaggagtatgtcatctatttcaatgttctttaataaacagggtactatttttgagcggtgccagcatattgtcagattatgatgaaataattatattattccctttgtttgatctgagaatgtaaaaagcaatactggtaaattacacactgctggacattgcttagatttactcttcaatgaattttgtgtccgtacgttcatgagatgagaaaaatagataggcaaaagtacctgttagtctgattgcagatctacccgtaatgcacaaatggtgatagtgtactttcttcttccaaaggtgggttaatggagtcatgatttaaaataagagtttaacagtagcgtgtataaatttgatatttatacatcataaatgatgtataaatcatttatgggagagtgatatttgattcagggatgttgacatgatacctttgggaaattctcatagtaaaatagagttagactgtcaacagggaaaattctaagtaatttgtgaagaaactagtagtagtagtctaaagtgaggcaccaggcaaagagagaagaatcagacaaatcctttagagtaatagttctttacccattcagacccacactccatttagagcatttactgtagaagttcttgagagaagatctcatcctgtagccatatatgctcactatatatatagatataaaacatctctaagaatttcagcttctctttgtgctttttgttagctactttaaatagcttaactttcagtgacacatggttttaacaggcaaaacacatgactgttaatgatttttctttagagcagaaatggtttatatggcctaaattcacttttagagaatcttctgagagagagtatttcctgtctctttgcacatgtgtggcatattgtaaggacttatttacttttaaataaaaaggaaagctcttgcagtgaagtagacatttattttgttaagaacctatataaggccaggcgccgtggctcacatctgtagtcccagcactttgggaggctgaggtgggtggatcacaaggtcaggagttcgagaccagcctgaccaatgtggtgaaaccccttctctactaaaaatacaaaaaacttagccaggtgtggtggtgcacacctgtaatctcagctactcaggaggctgagacaggagaatcgcttgaaccggggaggcagaggttgcagtgaactgagattgcaccactcactccagcgacagagagagactctgtctcaaattaaaaaaaaaaaaaaacctatataaaatagtttatagcagtttatagctgtgaccatcaagtcagataatttgggatgttcacagagagctctgggtgattatgacagtgtaccacccacatctcttatttgttttgcttcatttctctactagggagaggaggtcatataatatatggtatttttatgttattttagataaatccatatcaacacagcacaggagaacaaattatacccctggtagattttggggtataaacgtcatgaaatgtttctcagaaagtgagaaatatttcttgattgtatctttaaaattaatgcaaaattgttatgttactccataatttatttgtgtgcattactgtaaggttcatgtgtattcatattaaattttttcttttaaaaattgggttcaatgaattatctaggatgattgcattgtttgtggcatcaagtgttgtttctccctttccataccaagcatatcctgcttttggtacaggatatatttttttcagatgtcaaaacacctagggatacattttatgaattactaacttacttttttaggacagacttgaaatcatttagagggtaaactctagcaatatagaaatctgttttttgttgaatggagtagcagctaatctttaagacccattgatagcattttagtagtagcacttaacattcagaaaagaaaaacaaatcatccagcttctgatcttcagttttatgtaactttacaatttggtacttgatgacttggtattggtatgagactgaatagtgtgatgttacaaacatgtgatgtttgcctaccatgttctaggcactgtgccaagtgctagagatggaatggtaggtaaagctgtggtctatacttagggagttcacagtcaaatgaaggatacagtcacaaaacagacacttgtataaagcatggtcactataatacagagaaatggaaagaatggccagagaaagcttacttgaaaagataatgcctgaactgaatactaaagggaggtcagtgggagagacaaggaagggtagatattgattgtgagtgcatgagcattgaaatgagagggcccaggggaataggaagagaggaatagcctaaaggagaacaggagcaaaggcacatgggtgagaaacaacatggaatgttctggacatacaagcagatctctgttggaaggagtatgagataagggtaagagagtgattggagttgagtctggagagatacgaaaccaaatcatggaagctttttaaatgccatgtttaggagcttgaacttcatctttttgtgagttggacagtcattgaagggttttaagtaggggcccaatttgattgtattcaggttgagtagagtactctgatagctgatgtgaaggataaatttgaagggaaaaagattggaggcagagaggccatttgggaagtagttagcttgataagaggtgacgagggcttaaactgacacttaatagaaatggagaagagggagtagatttcagagtctgtactttttttgttgttgataaatagtaaatttagtaggactcgatgcttggaaatgaccagtgggagagaaaaaatggacgagattaactccaaagtttctagctgaggtgattccagggatagcgatgacaccaaacagagtgaatatatgaataatcagttgaggagacaaacggaagtcagttttggatattttgagtttaagatggttgtgacatcactaatggaggaaggctaacaaggcagttaacctttgaacttgatgctgtgggatatagatgggggtcctgggctggaaatacagcttgaagagttcatcagtttgcaggaggtgattgaaagcataagaccatcaagggaaggtgtgtgggctgaagagaaaaaaaggtcagaagacaggagcttggagaacagaagtgtttcagagtcaagtagagaaaaagaagccccacaaagataagaaaaggaactgaaaaaaatgaaataatcagtgggccaacctgaagatccaagcaagactagaaaccacacatttttaatggaacaaatctatatcgttgtgatttccttagaagccttaaattggtgggggagatcagaatgtaacattagtctaggattgaggttttaccagatggtacagtaaaagttgtgagtttagggaaaccaagttgtttgaagttagagcagtttagatgatcagctgtgccaaatattgcaaattatgtgctgtacattattctttacgtatattaactcttaaccctcaccacaaccatagttgttacagaagattctagaatgtaagttccataagagcaaggtgggtatgctttgttgtctgtgctattctcagtgcctgacatacagaataggctcaaatacttgttgaataaatgagagaatatgagatacatactattattcccattttacagatatggaaaccgggtaagaagagattaagtaacttacattcacaatttttagtggtagagccagtaggaaaggaattgagcccaggattagggagctgatggaaaatagagaaattttaggtctggagatctctctgaggatagtggaaataaaggcatgagagatgtagaaggggagaaagttatcatcagagagtaaaatggtggaggttatgattttttgagatagggttgttcagtgttatgacaaagggtcaagtcttagcagtggagtaaaggatgtttattattgaatctctgtaggcgtcgatgtagatgttgaaggctcctaaggttatactagaagtttgaatagagaggaacattatgataccatcctcataaatgaagtggtataattggagatctatagataagaagcagcagagagtggaatagataagctttcttatttcaattctagctttttaaacgtagattgaggttagatctggtttgctgaaaagacaggaataaattgggcttgctgcatataatttatttcccccatatggataagctcgttggaaagctccagaaatattcagaatataaatacaaaagtttcaaattttacctgacatgccagctctacttaaggtatgaattctaaatcttgtatctctcccctgcaagaaaagctacctcctcctttttatatagtagtagaacaaaatttttgtttgtgtttgtggcagcacatctcacctctttgtttcatagctgttgggtacacattccaaggacggtaaaaacaaaatgcacttgctcttctaaatctttagccactggctagtggattgcatttattctcagtttccttgccgatccttttacccttcccctcccccatttttctttttgaatggttttgtttcatgaagctcttgagagctttctatgttatattgtggcacaggaaaaagtttattcattttagcactaaactgtagttaacattttaagttaatcatttttagaatgttttgatgagcaatcctgtttcatttttagagatgattcaatctgatatttcatttgcttttaaagtctctaatttcttttcatctatttccatagcattgtaatttgtatcctgaacgtttctcttcagagaaatataaaaatccagcaatccattatagtattgtattaagcctaagatttcattatttatcatacacatttatttatttatttttattttttatcatacacatttaaagtacggcctttgatttatagaatttttcattttgtggttgtgcctgcttatctttgtttttgtgtgtgtatgtctttcacagaaattagtatcattctgtcatagctcttaggaaattcagagttaatcaaatatgttataaaatgtgtttgtataatgaaaaggttggaggagatgattctgaaggtgccatttagagcaggtgtgctatggtttggtggctctctattctctgcccgctttaaatcttagtaggcagcagatgaaatactactaagtgacctttgacacagaacccatgaatgctccaagtatgatttcattttaccgtgttctttgtaaactcaaatgcctgtcaaatcagatgtgtgtttcgatgtttttactgaatgcgccttgaggaggagactaaagcttggggtcaatttggcataatccccacgtttttctttttctattatagaggtttcttggggaaggggtgacatttctttctgaggaaaaggtgcaggctaagtgtaggtggactttctgtcttctccatactttttctgacagcctcactggatcctggtgatatcatacataaatgcagagcagactagatgggttgctggttggtatttttggttaccatttgatctggtgtctttggttatgtaataggcacattaactgacaaattatattaagtaaatatatagccatgggctttttaaaatctcactttttaaagtcaataattagattagattgtctcccagtaattaagtttttcatatgttcatggatatatgtagtatatattaaaagattatttgtgtattttttacattaatttggtaattttgacaatttgtcaactcaagtataaaatacttacatataaatatacttaaataagtatttaagatttaatgtcaactttacagtaatgaaatagaaaattcttgaatgttactcatttaaattttctgatttgagttctgataatctgttagaaaattagtaatatgcttaggctcacttcaatttccccagcagaaactattgtatccttactggttagaagctgccaatagtcattaattgttaaaatataagaaggttgtaggggaccatatgacaaaagaactagttacctttacagtttgttcgctgtacctcatacactttgtgttagaagaaaagctctattcagtgccttgagtgaaaagatccttacctccttttagactccgattgtgggaattttcttgctatcctggacattttaacttgttctgggttattttgaacatattaaggtggactcctggaatagttgagaactaattcatgtttgtttgtttttctgaatcagcagtttagtgattaaagcttaagattcttttaatagatttaatgaaaaagaaatcttaacttgaaatttaaattaatgaaaaatattaccagaggagatgtctgatattttgatacgggaaaatacagaaaataaaaacatttaaaaatttatccagatgttaatgtttgactggaagttttctactggaagaattagtttggattttacaatttgggagaggcagaagggagttggggaggtggtcaagcccaaattagcatgttgaatatccagattcacagacatttcactaaaccatttatgtacttagcatttttgttgactagtcttttcatttatagtgctcttaaatcactccatttgtcagttactccatttacctgaagattaaagtatacactgtgatagaaaaaaatagattggcaggggcgggggttgtattatataatgtaataaatcctattaaacctgttaaagtagaaacattaattttacgttttagaattttcttaatgacaggaaagtaaactggtaactaaaattcattttgttctgtaggtttgtggcattttatgtggggaatgtagatgctaagtgttatgagttgtccacctgtataaaactacttcccagaagccttgatgttcccataaagagctaaagacaaaaccaaatcaactgctaacaccttttatgggagatcaacttgtgtgggttatgaggcccaccttgactaagcaggatatgtaggtaaacctgcccagttggaattagtagctgatactctaaaaggagaatggtgaacaggaggccattagcagaaacagcctcattcatttatagagatcatcttgttaaaagggaaatcagcttccctagatcccaagggggtattgaaaatgctaggagagagcctagaaaacttttctgtgcagattgtcagaaaaaggtgaaaatattttcttttactgtaaaaagaaagaaattcttttccttcttccaaagatgccttaccacctttgaaaaagatttttaaaagtctcagagaaaatgaaatatagattcttaaagtggaaagggaccttaaaaatccatctggtctggttcattttatagatagaactgagaacctcaaaaagttatgtaatttggcttacatcacaagagctagtttgaagcagaagctacgattttcttactgtgtccagttgtttggaagtatgaatagtcatcattaaaatgtagggagtttatagggaagcttatgacaactattagttaatttacaatttgttcactgtagctcatctgctttgtttcagaagaaaaattctatgtcttgtgtggaaaaactcttacctccctatgaacagaactataggaaatttcttgctaacttggatgtttcagctacttcagggttattttaagtaactggatagttggttttcagaattctagttacagaaactagtaaaagaatatgagttgttgatacgtggaaactttagacccaaaataaaggtaggatgatgtgagtttagtgcttacaaatttgaatgaaatagtacctttttgaggtgttttagtagttgcccttaatgatttattttaaattagatggctttgggagtaaaaatactgcttttagcaaaaaataaatataaaattgaaacttttgcacgtagagttttttttttctttttgagatagataaagccatctaatgtccttttctatcatgtcttgataagtcaagagcagaccacttgatgaagaaaaatgaaatatcatctaaaatagaaaaatatcctgttaggaaaaataccaccgttttttcgctgcctttagtctggttgttcttattgtgtgaagggaacttaaatcttgtcaaattacatacattgtaagtcccatttctgtcttaaaagtataaccatgcatgctcaattaagtcagttatcgtcttcagactgtacttttgctaattaagtcttttccttggggttaagataagacaagatttacagatttttaagtttaaggcctgtaactactgaggatggtttaaagctttgataagtgagatgtggtgctttaaaggaggactttcctttagtctcttaaaaacacttggaagatatttattacagttttccaaagtaagataaagctcagctttaataatgaggaccttgaagtttttttatgtggtggggaggtgttaggaaactcattttttaactaccttcaagtgattatcgaggcaggtttttcttccctatgaggaagaaaatgaattgtgcaatgccagtttaaagaaactaaagcaatgtatttcttacataaagtagatcattctctctccctgtgtaactgccacctgtttaaaataagattccagtcttgcctctgtcagtcttaatgtgatagactctcactcagtgaagatctatggatttattttattgaaaacatttgtttagcatatatctgtgttattttaattttaatgtttttagagatgaggtctagctattttgcccaggctggccttgaactcctgggttcaagtgatcctcctgtttggcctcctaggtagctgggactacaggcatgagccaccatgcctgggtaagatctaatgatttatttgattgaaaacacttatttagcatacattcatgtatttttgtaacttgttgcctcctgacaggtcactagacataggaaagtgcctcttttaacactttcataaacctttaacataaacattttaaatttcttcattatagtggaaatagcgtctccccttattattggacattttgaaaaattaaaaaaattttaaaacaatttttatcataaatactagatgggaataattatatatgaagcttgtctgacaagttggatttttatgataggatagaatcccaggagtagaattattgggcatacccttttaagcctcacagtaaattattactaaagtgtgttgcaaagattttatcagttgtatagactcccagatatgaattccagggcccttcaggggaattagtggggacattttgcaaagagcaacagatggtgtctggaaacatgttctttaatctttgctgtgccacatactagttgtagatatctgggttagtaacataggttgtgtgggccttactttcctcaccataactcaggtgaattttaactattctactggccttaattctcattctgtaaaatatgagtataatcaaggagaatcagtgcctatatattaccaagtgatttgtctgggaaaaaagcagaagcagggaatgtcagatgtacctagaaaaaggagcaagttaggggaaatgcacaaaacatgatttgctcttctggtttttttaagaatagagtctaggctgggtgcagtggctcacacctgtaatcccagcactttgggaggctgaggtgggtggatcacttgaggtcaggagtctgagaccagccttgccaacatagcgaaaccccatctctactaaaaatacaaaaattagccgggtgtggtggcgggctcctgtaatcccagctactcaggaggctgagacaggagaatcacttgcacctgggtggtggaggttgcagtgagctgagattgcaccattgcattccagcctgggtgacagagtgagactcggtctcaaaaaataaaaagaaaaaagaaaaaatagagtcccataaaattatgtcagatagacactcctcctgagacttagggattttcaaaccatttcaaatagaaaatgaaagtgtaaggagacaagtgtgtaactttccaaaagaagttgtgttctgtgtccgttttaggttacagaatgactcaagccaaaaaaaaagtatgttattcattcatttacacaaaatacaaaatattttcattatcttctgttatttgtttaaattgataaaattatatttatggtgtacaactttattttttgatatatgtacacattgtggaatggctaaatcaagctaattaacatatgcattacctcacatactttttgttgtgagaacacctaaaatctactcttcacaattttcaggtgtacagtatattaactgtaggcctatgatttaccatggatctcttgaatttattcctcctgtttagatgaaattttgtatcctttgaccaacatttccccaccccttctacaccccagcctctggttaccaccattctactctctgcttccatgatttagactgttttagattccacgtataagtgagatcattggcatttctctttctgtgccttagcttatttcacttattataatgtcctccaggttcatccgtgtcgttgcaactgacaggattttcttctctttgaaggaagaatagtattctgttgtgtgcgtatactacattctctctatcagttcatctgttgatggatacttaggttgattccatatcctggctcttacgaataatgctgaaatgaacaggggagtacagatacctcatcaacacactgatttcatttcttttgtatttataactattggtgagactggtggatcatatgatagctccaatgttagtttttgaggaccctccatactgttttccatagtggctgtaccaatttacattcccagcaacagcgtacaggggtttccttctctctgcatcctcatcagcacttgttctgtttcatctttttgataatcaccattctaacaggtgtgaggtagtctctcattgggttttaatttgcatttccctgatgattagtcatgctgagcactatttcatatacctgttggcaatttgtatgtcatcccttatgaaatgtctgcaccctttgctgtttttttattaggtttatttattttcttgctatttagttgctttagctttttacatgttttggatactaatgtcttatcagttgtatggtgtgttttcaaatattttctcccattctgcaggttgtctcttcactcttgattgttttatttgctgagcagaaatttttagtttgatgtaatcctatttgtctatttttgtttttgttgcctatacttttagggtcatatttagaaagtcattgcccataccagtgtcagagagctttttccctatgttttcttgtaggagttttatagtgtcgggtttcatgtttaagtatttaatcaattttgagttgattttcgtaaatgatgtgagatgagggtctaatttcattcttctgcatggggacattcagttttcccaacaccatttattgaggagactgttttttccccattgtgtgttcttggcatctttattgaaaatcaattgaccataaatgtgtggtctctctattatattcatattttttaagtaaattattttatgatgagaaaggtggcaaaaattctgcattatctttgatatgtaagaaaaggccatttgggcacagattggacctgattatttctcttttcaagaagcaagtaccttatctctattcttattccaaagtgatttaatctctattaataatttaggcaactaaacatcattactgattgtaggagaaatctgagtctagtctgtctatactgatcaagaaccaggactacctcatggagactttggtaaaataaatctcaacagcactcaccagatgaataaaggttttcttgaactagtttaagatacttggttatcagttgaacacaaatagtaataatttaaggtttcatgaattgacatgtctataattagcttcctaaactaagaataacaaaaaatgagtagtttgttaattcctaatagcctgtgatgaaagttattatctggggttttttttgggtctgttttaaaaattaacactttggctctgattataaaatttataaattggaaattgaaattactggataaaatacaatttatgttttaaaaacattttcaagtggaaaaaattacagcttggctgaatagtgataattttcaaactaagcctttgagttcactatttagagttctctgataaattgttagagttagaagtagtgagttcattgcttgactgaataaataattcatatggcacaaaagcagctttttctttctcttcagttcccttctcccccattatgttcactttctctcttgtaaaaggctcctttgcagccaaatagcaaccttgtgtgaatatgcagggacttgggcatagtttcaacctcagtgttagctgagtatctggagtcatggaagagaattaagaatctgtcttgaatgtatattttctagtagcaactgaaaagaaatatagtagttgtaaattgctagaccttactcttacggtacagttgctctggaaatctctttttagcaaaataggattttatttctggatatagaatctttcgtagtgtctgcgtcaaaacaaaattaagttttaaaattgagtaaatcatttattttttctagttttttcagaaatgcttttttactagactaaataacttttcagcatcagtctgataagcatagaattttcaaaattctttacttgctattttagaattctttattttctaagaattatgaagactgtattaggtatttatgtggacttcctttttttcctaccttttattatagcaccaaaattggaattacgctagattattttctctctgctgtttaaatcataagagactcttttattgggtcagggcaattgtctttctagcacaataatcttctttgataatgtcactactggaaattatgtttatccttcataaattaactaatccttatttttgtaataaattatctgatatccttcagaggttatctaaaaatattcctttaagtctgcatgtattcagcatatttcatggtataacaagacttttacagttgtataacagaaatttaaaataaggcaacggactgtaatccagacttctgtcaactggaaatttttatgaagtagtattttgctggtatactgatacttcaccaaatacaatgtttatctttaaagaagtttctaaataagacaaaacattatgtttagtaaaattcaatgtagtatgttttactgtatactaattctttatatagcccataatcataatacataggctatataatacatgtaaagcatataattcataatacataggatacaaatcaaatatatgagctttattttgatataatcagactttattctgttacctatttgcctttctttttcaaacttttaagcgttgcccttattttcataagacttagtgtttcactcagtattaaatttatccaaagtcattgtgattttatgaaacattgtgattttaagtgctgaaccatgttgtttttcaatgtaaaatgagtgtaacttttagtaattattgaaatttaagcgttactgtgattttccataattctatttcggtagtcacaaaaaaacaaaaatttggcttcttattggcccttctagtgccaacactggcattgttgaaatacatttctaaggaagatggtgagtgtttcacttcattagtagctgcatgacaagccaccccaaagtttaatggcttaaaacaacagtaattcattatttctcataattttgagagttgactgagtgagtcttctgctttgtgtggtcttggctggggtgctaggaaagagggcagtccacagtggcctcacttacatagctggcagtggatgcaggctgctggcgtggagcacagttgggggtggcctgggtgcctcagctctccttaagtgtgcctctctgtgaagttagttgggcttgcttacaacatggtagctggattccaaaaagaaatgttccaagggcaaagaagctgcagccttttaaagggccatatttagaagttacttagcattacttctgcccattctgttgatcaaaacaagtcacaaggccagcccagatcaacaggaagagaaataggcttcatttgttaaagatggagtagcaagattacactgtagaagagcaaatggtttgggatgtattgttgcagccatctatggaaatgcaaactaccacaaggaagtgcagtttttgctgagcatgggtatttgccattaccacatttcagaaactggtatagtcaagcacacatggatttgaccactggatttacactagggtcacttaagagctatcagccactgtcttctcatctgtatgacagtagtagtatcaacctcacaggattgacagttaagtgagataatttggaagtacacagcgtagtgctggaaattccattactcccatcctgtttcttttcccatgtccctcatgtttaatttttatatttgtgattataatacttaaaggtatgttttaaagataaatcataattcatctaaagtctttgtcttaccaagatagttcaatagttccaatctgaataaagtttataacattaacataatttatagatcttctaatacaagcatctgtctaatgctagaattctttataaaccactgtatataggctactcacaatgtaatgagctactaattggtagaaacaagtggctatttgccatagttctacattctgttctaccttctattttgcagaaaaatcttacagctttcctaagccatctttttaggtcaattccagaatttgtttatgatcaaattgacaagtacctagccaaagagattaagatactgaatcagagaaagaagtctaaagagataattttccaatgatcatttctaaagaaggaatagagataaaatattttaaaacaggtactgaatagtcacagtcaaaggtttgattatgagtcagctttgttggttttagtctcattagtcaccagcaccaccaacctgtcatattggcaatacatagttttggtcaccaggagaaggagtcacagaaaaccagtactactacttacagaagattaactgaaagcacatgtcctgatttgttcttgaagataagactgaggtgaatattgcttaaaacagtatcagcaaaatacaaaatcaagtgaaatattacattgaatataataattgaaagaatgaggatagacacaaagaacttttggatgctagtgattagatattagaattagtttctcagaatattttaaagaatttaacaaatgacagtgttatgaattatgtgggcagtgcttaaagtgggaacagagcaaaagaagtggatttagttttgtcaagtctgtctgttcagcgttagggggaacattttatttcttctgaaacaatgatattggaatcccatttcatcttttcattttcaaacactgactttataagtgactttgggagaagcttttaagttttatataaagcactttttttgtacttagcacaaagtgggcacctttaaaattacctgtttgtatagcagttaatttaaagaatatgttcatgcatattactatattttctcgattctaaaagctcatcaattgtaaggcacattctttgatttcataacaactttttaatgtctctttttggaaaaataaaacacttttcttgggggaggaggagaatttttctaaggattattctgaattcctttgggccataggcactgtagcaaatgctgctcttcctgatctttaacacttttaggattgatagtgtcgttctgagccatgtccaggaattactttggcgaggtttccatttcctatttaattaaaatttttttactaattatattacatttcactagaagttaaataacttctcttgaaagtcatccagaagactttaacagccagatatttggtatctgctcagaattatcacttgtgaaaccttcattaaacataattcagccacatgtcacagaaagttctgcatgtataataactttttgtttcaatgctgcattatagtgatctttaaaagacattttaagaggtaatttagggatttcaaattaagttaaaatttagctgtgcatagttctgttgatgctgataagtgaacagaaggtaaattcttagtcatgtctaagttcacacagagatacaataatacacgtgggtgtaatacaaagcattatagtattttgtatagtatctcctttgttattaaaagttcttttgatatctttggtaagactcctattgatttgaaaaatgttactgtgaaaaaaatgtgctttaagagttgagaaagtaaattattcctttttttctctcagcagctgtttaaggaagacagagcaggcattggataatattcttattaaggtaaagaatctgggtgtttgagccctaaagtcatacagcaagtagtccacctggaatcatgaaccaggtcttcaggacttccagatatttgtgctgtatactatgctgcattttcaacaataattcatttatctgtgggtttgatttaatgagactcatttattcaacaaatatttattaaatgctattcttgccagtcattgtgttaaatgatagtgtaacacagtaaacaagacagatatctttccatgtcctcacgaaaccagcagctttggaactaaacaaataattataactaagatgagcattaagggagaaattgtaagatgataggaaagaatataacaggcggacttaacctgctctgggatggtgggggagtgttgaatgtgaactgagggtaggacatgagaaataacttttgggctgagattggaagaatcagcatgagttagcttaagcctaggaattaggagaagggttaggatggaacattgcaggcaacagaaatagcatctacaaaagtaaaaggaagaactgaaaagattccagtgtgagcgttgaaaagaaggataagtaaatgtagagaagaatgtaggaaagagattatgcattcttcaggattttttgacctatatcctaagggatattgggaaaccatggaaaggttttaagcatcggggtatgccatgattaaatttttcatttgaaaatcatgagtctgactatagtatatatagaagcattgttgttagatgctatttcggtaggccaggttggagatgatggttacagcagtggagctggagagaagggaatagatttgaaatttgggatgtgaacaaagccttgtatttgacagaaatgtaaaactattaatagtattgttattgttccacctatagaatctgattataagattatctctaaaatactttcaggtaacttgtacttaatgttaggaggaagtgactatattataaatataatttagaaaacatcgttccttaaaaaataatttttgaattgtgctaattcttgttattgtttgacttcattaactaatatagggagtatagggagaacttagttttaaaagataatttgacttcctgatttatacataaaacacataagtaattttggacatatatgatgtgtatatatatatatatatagtgcaggtcatcttgtttacaccacttattaatgaatatcagatttggaaggtgactctttaggattttcctattggttgattgattgaaacttacatgaagaatttaacccttttgtttcaaatagctttctattaagaaacacttttttcatgattattcagagaatttattgctggatcattggctctagagatagactgctggttaaattaaaagatgccggaggaaacattttggaaacagacttcacagaattccttatgaacttctgtactttcttaaccaatcttatttctttcatgtacctatggctgttactagcctgttgtatcagggataccatagtcaactacctatacgggccttaactataaagaattaggccatttagggaaataataatgagactggggctttagagaatttgtgctcatctaactgagtagagggacagctaatattctgctccatctgatggtgatcatgggagtattcaggctgattgttacccaatatttcagtttttccaaaggatcctaaaatacagatttttatgtaaattagttggtaattaatttaggtgtttttaagatactctgtgacaataactctacagggcaaaatcgacctgttaaatatatttggcccataggctgttgttttatagccttgaccatatagaaatcttcaatatctatttaaaagtaagaggtcaaaagtatttctaggaaaagtgaatgccaaaagaagggaggaagggaaggcataaatgagatactttttaaaagaagtacaaaactagttatctaggttatatttttaaactaagttcaaaaagaaattcactgtcctgagaataattttcatatgcttcagaacatacttctagcaacttcagccatctgcgtgtgtataactgggaactcagagtaggatgagaatgcacagggcgtagagaaccaatgaactgtagatgagagtgtagtggttctctgaaactgttgtgagcagagtacagcaggaacaagagacagttgatattggagcaaaatcaggctataagaacatagcgatctgagtacatcatgggcccctgaaagcattactagactaaaagcataattttttatactgatgatcaagaagaggtcatattggtacactaagattgaataactctgctcccaatagcacatgtaatacacaatcactgtaggaaatcaggaaaatatacaaaaagtagcatatggtttttttttaaagctaggaatgggtaaaattctaaagttttctaaaagtaatgaaaatagaacttggcaattgttagtttcctaatagctaattagtttccaaattagtctaatttggcttaaataaaaagaatattggttagctcacataagaaaatacatatattaggattagttacgccagtggctcagtgatttttttcaaggactcagtttgtcgtctactctactctttatccataatatttcctttatcccaacactgtagttgccaaatggctgctggctgcaatcaggattgtgtgtttcctccttcagatccaaagagagaaataaacttctcttggcgttctcatgggcaatataggttcttttctctgagaagtccttatgcactcctgcccccaacttgctccttattgtcctaaattagcttaattctaaatatgccttaactaatcgttggcaaaagggatgagcttaccataatggattagattaattgtggtctacccttgcagctcaggacagtcagcttaccctgaggcgcattgaccactgggagagatgtggatatagaaatccaatcatggatcattaggaagaaggaagcgttggataggctctcagcatggtccaccacagttgcattaaggattgtgtattacgttttttacttatgtgaaacaccaccttcccccatcaagcctgtaagtatgaagtcgagtccctagtgaatctactctctgactcctgtgtttcaagcaccctcattagcagagcttatatagttcggagttgaagaatttttttttcccaaaaattctcttctcatttaatagacacctgtctgtagagtaaactatgcaggccataaatggaacaaagatagtttaggaaaatacagtttcttaaataaattacttttaaaaagtatattttctctcagctcttctctccaaaggagttttgtatcataacctctgtagtaaatagtgtcatctttattgtctgattataaaggtgaagtataatttatgggataatttacaaagcaaaaaagaaatacttatttttaaagtttaaaaattttctgtgtagaaaatactataataatgcatgattttaagaatctgttattttggctaaaatatttaaccagccaaccatatatcttatttctttcagttgctagatttctgaatgttagccaaatattttagtatctgggtcacatagtcattacaaacaaatgtaggccaaaatggtttatgcttctcagttgccagctcagttctctctttgactttttattatttgtttctctttgaactaaactttatttacttatattagcacagtactgtgttaattctttgtgtagaactggtcttcttgtgtcgttttgccccaaatcaaggtaacaaacaaataaatgactgtgctcttggctgttatttagaattgttactatacaaaaggtcacacatgttaaattacctactgcagtgctaattattgtgaaaccttgttcaaaatgctagagagactgtgttttggcacttctgctgtaacagtttttaaagatccaacctgtatgcattttggtattgaaatcctcaaaactcctaaagaccctatgttaatttaaaatgcaaagttgtctcacctttttatactagatgagatagcatttttcttaaagtaaaatgagaactcttatgtgttatgatatagaggtaagggcagggaaagagagggaaagaagaaaggagtacattggagtaacaaaaattccaccttcatttataaagtgctataggctctaaaactccattctgaaatactcttttaactttgaaaggggtatgtttactgccagcttctgttaacacaggaaccatggtttttctgttcttaaaattaagaaccttataccttttggaatttttaatatttttctctatgtttgtaatgcttttaattatgtttattactaactgatgttattaactatatttataatttgtacactctattctgtttggaaagtacaaaatgataccatagatacttcctgaatttttttagaaaaatcaaaattttattcatctttattcatagcatcattggacattcagttagtaaattttccagataacaaacacctatcttctttgattgctagaatagttaatctcaacccctcttgttataaaatatagtgactgtggattgttgatgaaaatttcttaagacagtgtattcaggaagacactgcctcagggctactgaggtatgtcatagggccatttgtcctttcaaaaataattctcagtagctattgttgctttgcatttgtataaagtgtctgttttttcaaagcttgatattaattctgatagctactagtgtacagagaagggtgtctgtgaataaagtaagagaaagaatgttcataatagatttgaagagcacttcaatgagtaaagtacttggactttacaatgtttgcttttacttcactaagtcctgccctgtgcccctgctcctgcccctttatgccatagtctcttttttaacatggtacttggcagtgttccaggtagttattgtaagaaggatgagcttagacttggagctagacaaacatgatgggaattaaaacaggataatttaatagctgtgagaccttaagcaagttcacaactgcaaaatgggtttgtatatactatctctcacggttgtaaggattaaatataatggatatagtttaggaggtattttaacaaatgctagttcctttccttatactttaagataaatgacccacttactttggaaatggtatttgcctattttagtatgatgctataaggtttaaagggtcagtatccctaaaatatgacagctgttaagatctctttaattattcagaaatgaatggtatgtgacaagatattattggttaattcagtggatcagatgaataaaatgtgctgaaatattttggagactgaaaatataaatttagatgcaagaaatatattttaaataaacatggaaaacagtttttttatccgagtctaatcacgttgaaatattttatgaatatccccagagagttcgtaaattagtgagtgatttttttaaatgcaaaggtaaatacctagaaatcatatatacacttaaagtaaaatctcacagagttctcaaggccattttgcatttactagtgccacagtagtggcgttacagtgagctgcagtaacctgaaacagtactgcatggatgctctaataaattgcatgtctggaggaagcagctaactatggcgaccgccacggagcagtgggttctggtggagatggtacaggcgctttacaaggctcctgcttaccatcttattttggaagggattctgatactctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggacgcagtcttgctctgtcaccaggctggagtgcagtggtgcgatctcggctcactgcaacctccacttcccgggttcaagccattctcctgcctcagcctcctgagtagctgggactacaggcacaagccaccatgcccgcctaatttttgtattttcagtagagacggagtttcaccatgttggccagaatgatcttgatctcctttttttaaattaaaaagtaaactttaatgtcgaaaatgcaaacctggggagggcagaaagatcacacacaaggctgtcacttcacacttggaaggttgcacagcagccaggcagagaccctcctcacttcccagatggtgagggggccgggtgggggcactcctcacttcccagacggtgcaggggctgggcagaggcactcctcccttacaaatggtgagggggctgggcagaggtgctcctcactttccagacagggcggcggctgggcaggggcgctcctcacttcccagatgggacggtggccgggcagaggcgctcctcatttcccagacggtgaggaggccaggcagaggcactcctcacttcacagacaggacggcagcagggcagaggcgctcctcatttcccagacggtgaggaggccgggcagaggcactcctcgcttcgcagacgggacggcggcaaggcaggggcactcctcatttcccagacggtgaggaggccgggcagaggcactcctcgcttcgcagacgggacggcggcagggcagaggcgctcctcatttcccagacggtgaggaggctgggcagaggcactcctcgcttcgcagacggggcggcggcggggcagaggcgctcctcatttcccacacggtgaggaggccgggcaggggcactccttacttcgcagacaggacggcggcggggcagaggcgctccttgtttcccagatggggcggcggctgggcagaggcgcttctcacttcccatactgtgaggcagctgggcagaggtgctcctcacttcccagatggggtggaggccaggcagaggcggcgctcctcctcaattcccagatagtgggcggctgggcagaggcgcgcctcacttcccggacggggcggtggccgagcagaggcgctcctcacttcccagagtgtaggggggccgggcagaggcactcctcgcttcccagagtgtaggggggccgggcagaggcactcctcgcttcgcagacgggacggtggctgggcagaggcgctcctcacttcccagacagggcggcggcctggcggaggcactcctcactgcccagacggggcagggcctgggcagaggcgctcctcacttcccagactgtgaggctgctgggcagaggctcttgtcgcttcccagacagggcgggggccgggcagaggcgctcctcactgcccagatggtgcggtggccgggcacaggcgctcctcacttcccagatggtggagcagcagggcagaggcgctcctcacttcccagatggtgcaggcagagatgctcctcaggtctcaatctcttgatctcctgatccgcccgcctgggcctcccaaagtgctggattacaggcatgagccaccacgcctgccctgccgtgtcttctttctcctcctaagcaactgtcttagtctcctgaattttgatattctacttaacactctcatgttcttacgcatgttgccatgctggaggcgtccttctctttgggaagcctgacccaccaacagtgcctcaggagatagacatggaagctttgccggtgggggccgctcgtctctatcacacctcagttgcaggggaggggtcggttgcagctgcagcggtggccccgacagttttcttttgtgggacctgtggccggcagctctgggtggagaagacctacttgatccaagagctgcaggatccttgggctgcatgtcctcccccaccatcagcaagcctggagagctgggcaggtggtcttcacccagcaccttcaaggccgccttctctggccacagggagcagcccggaactggggcagggagcactgttggaagtgggtcaggcttcccaaagggaaggatgcctccagcagggctgtgtgaactggcgactccatggcccttggagtagaaactcactgcatgcacctgggccttgtcagtctgattcttttctgtcaagctcttgaggtggacatttccctccaagggcctgggattgtaccaggaagaagtgaggtttccctgagtctccaggggcctagaggtggaggctgcttccccattgctacaggggccccttttattgtcctcctgcccctgggtctctacctggtctttcacctctgttgcttctttgggctcttctgcgctcacctccgtcttcgggagcctggctgggatcacctgatcatctaatgaaggaagttgaaggttaaacttgcctctgagacaagggatccttacggggctgaggtgtccaaacattatggagttgtgaggagacagcacgggtttcttccttgagggggggctccagaccacaggacgcaggaccctctgtggggtgcccgtgttccgagggataagacacagcctcataggggcgccgtcccacctgactggaaaagaaggcccaagatgtcgctgacggttgaagaggagtgggaaacggcccacaattccccgggcaggcacaggtgcaggagctgcagggtgagcccggccagctgggaaggcctcacggacaagacgagcaggttgccgatggcatggccaggacctgcggcagaaccaggaacaaaatacgcttagcgagttgcccattttgagtgagttgtgcacagacgaaactaagggtcagaagcggagaggatactcctaagtcacccacttctctgtggctgggtgcacactgggcatctgggagtttatgacatcactatggggctggtgacagagccagtgtgtggaggagtgcttaggagcccagcgagggtgcctacaagaggagtcaaagggcaaagggtgagacccttccaccggtccagctggactctagcctcagggatatcctgctcctgggggcaagtgtgtggccctggatgggcccccctgtggggctgttgggggtgcgaggctgatccgccagagcccttccacctggcgcctggcccaggtgctggctagcacccagtggccctgttttggccggccctgtcccccaggttacagggccagaacctggaagcagagcgcaggaccagccagatcgcgccaggcttccccggggcctctccagtgcctctgtgccacctggagccaggcccgccttctccatggctgccgtggcctcaagggccaccagccttgctccgcaggtttccaaagagaggacgcagtgccctgacctgactggatgcacctcttaccacatgcctccctggcaggcagggtctccactttttacaaatttgcctgagaccattcctcaggtcattcaggtggtcatggcccagccaggctttgaacccaggctgtgcgattccacagctggcgctctggcctgtgtgcctcatgatcatggatacagcatctattcttattttttcatgtagtcctggggtacttagcaccgtggcatatctgtaataagcacatgcacacctcgaaggaggtcttcacttcaacatacgagttgaccatggcatgctctgggctccagtcctctacaaagacgtagggcaggaactaccagttgtcagcacagcaccatcccacattgctcttctaatggagcctttcaccccagatgttctttctcgtctgatgggaaggatccaagtatgtaaagattatgttatagatcagctttggtctgtcctaaaagaaatttgccagtggattattccatatggataaaagtcagtttctctggtcttcctggaatgtgtctagaaagcaaatagattatttacaagttcatagtagatcaatgtattggattaaaatatgacaaacataatttggtcattgtgagcatgccagcttggtcaactattcaccacacatgatgccctaaatataactctaggttttcttatgcccaagagagggacatactcttgggtgtctggactagggaaacatgtatgaaaaaccatttggccactctacatcttgttattggagaattgaaaccatctatattcaaagatattattaaaaggcaagaagttaaaaaataaaaaaataaattgcatgtctgttgttatggaattttataactgtacataccttttatttaatccattcacaggtcatattataggatatctttcatttaataagtatactaaatccataccttatactgttgagttttgatagtaccagagggaaaaaagaagaaaagcatggcctctatctttaaggagctatttaacagtcatatgaatcactcgattgagaagatccatatgtgtaatataatgaattccacaaaaattgcttattaaaattttttgaaaaagtaggggtgagattgaatatagcaaagctttattgttgatttttgttgttggccaggccaaatttgtgaacattttacatgatcagctatatcgaaatacatttgtatgctctactgaatatagggaacataatttaatatttaatttaaactccaggttaccatcatttacaggcattctgtgcattaaaccgttttgcctcttctttcttcctcagtaacacgtttagggccttttgatgcattggaaagaaaaggcagttgcgagctgctggctctagcaaatcagagctaatcaacctgagaataatgtttgcactttcccgctttcaagtctttgctcaaactgctctctacctttgctcccacaggttagtcctttcccccaatctaaaatctctctgactagccctgaacttactttttatagctctcactgtctaccatctccttcatcttgaatataccaggacagactgggaagttccagaaaaaaacagacataatacttaaatcatctttgatacctaatttgtcctcactgccaattaattaattttgttttgttttatttaattttgtaaagacagggtcttgctgtgtcacgcaggctcctctcaaactcctggactcaagtgatcctcccacctcagcctctcaaagtgctaggattagaagccgtgagccactgcgcctggccataatttaaataatcctttagattcctgtctctgtccattttcaaagccagggttacactatcataacataccccatgatgtacaccattgctaaaacaatcttcctgaagtactaattagatttttgagcagagaataaaaccatcctttccagtgttggcaaatattcaacgtactgtcctgaaatacctgtagtacttccaagtttctgctttgtgctcacactgttttctttgacctgaaatgcaatttctatctataaaaatcttagtcattatgaggtctagcaaagatctttttcttctatgaagccttcctatcgaccctaactaaaatctcttctctgagttcccagcgtatactgcttgagctggagcaagactccagtgatccttggaagaaagtgggaggttattttcccagtgcgattccaggaaagtttaatgtcttatagttcagtcccctttagcattccacatacagttagtgctcaaatatttgataattgctctactcacaaatatttttgtgtgaaattgctagctattctctatccaagaagtaatgaagtatataagcttcttcaactctttgttgagcccgggacctcttacttatttctgtatcctatctactcttgagtagtagggtcattggaaagcaaccactgggtttggggataagttgtgtgtattttagaggaggaagtaaaggtgttactggacttttaaaactgaagctttttctgttttaaagtattttgcttcccgttactgtatttataagatgatactggtatacgtagtgtcttggctatttatctattcccctttctctttaacacaatattccccaactttggtgtgatactgaattgaaatctctgggagtgtggcctaggactctacacttttactaacaatcagttgagatgcttatgaaggtggtggtagtagtgataatggtagtgatgatgatgatgattgtattagctctgctttcgaaggcttatgatgtacttactgcacttttctaggcagtttgcaactattaacctaatgttcacagcaagcctatgtggtaatacgctattatcttcattatacaaatggagaaactgtggcagatataaattaagtaacttgtcgccaaaatgactttcttataaataggtcaagaatccatgaaaaggatgaggcatatttttttggttgatagtttttaaactcactttctaaaggattgctttaagtgatgtgaatgatatgaatgtaaactggttcttatataaattgaagtatcaatatgctgactctatataggaatacttcaacaactagacctaaatatagatacttgctcttgcttttaggaagcctgtcacaattcttggtgaaaaagtaagcatgcacccaaaaacgtagaacattgaggaaaatttttaaataattacactttctaaaatacatgattttaggaagagtgctttattatatactatatatatatatatacacacacacatagacatacacacgtagatgcatatatatttactctatatggatgtgtgtctatatgtatagtcattcttcagtatcctcaggtggttggtgccaggacaccctcagataccaaaatccaaatactgtcccacagtatttgcatgtaagctatgcatatcctctcatgtactttatttatttatttatttattgagacatggtcttgctctgtcgcgcaggcttgagtgcgctggtacaatcatggcttactgcagcctcgacctcctgggctcaatcgatccccccacttcagcctcccaagttagctgggaccacaggcacgcaccaccatgcccagctaacttttgaacttttttgtagagatagagtttcattgtgtcgcccaggctggtcttaaactcctgggctcaagcgatcctcccaccttgacctctcaaagtgttgggattacaggcataagccactgcacccacccatcctcttgtatacgttaaatcatctctagcttacttataatacctaatacaatacaaatgctgtgtaaatagctattatattgatttttatttgtattattttttattgttttgttgttttttaaatttttttcctgaatattatgtgtgtgtgtattgagatgttactttgtgatttaatgtaattcaagtaaaactcgttaagcatttattttctgttttagtagcataagataaatttggttttatatgctaaaatattttatctttttaataataaatgataagaatattttgttcccttttagttcatagactatgggaagtggagtagggagtgaaagtggtggctgtggtggtggtatggtggaagtaatttgtttaccatcactgcctgtccaaaataattttgatgaatgattttaggtgttgcctaataagtgctctgacttttgaaaccagttgaactaacaagcatgttgtgctttgctagaaacatcttgtaagttctgactttgaacagacagtggaatctaaattgagttagtggaggacatatctttacaactaaatctaaagtgtttcaactatttctttttttaatctcctgtttatttttcttgtagaattaatatttttgattgaccaatcataattgcatacatttatggggtacaatgtgatgttttgatatatgtatacagtgtgatgtgcttatgctaattaacatatctgtcacctcacctataatatttcatattgagacatttgaaatttgcttttattattttgaaatacttaaaacgttattattgactctcgtcaacttgctacggaatagatctcaaacttattcttcctctctacctgaaacttcataccccttgatcaactccccccaccaccctcctaccctagcctctggtaaccattgttctattctctacttctatgaatttaatcttattagattccacatgcaagtgagatcatatggtatttgtttttctctgcctgacttatttcacttagcataatatcctccagattcatccatgttgttgcaaatgacagaattttcccctttttaaatgctgaatagtattccattgtctgtatataccacatttccttgattcatccattgatagacacttaggtgtttccgtatcctggctattgtaaataatgcaacaatgaacataggagtgcagatatccctttgacatactgactccagttcctttggctatataaccagaagtgggatcactagatcatacagtagttctatttttagtttttttgggggaaacttccatactatttaccataatggctgaactaatttgcattcccaccaacaatgtactgtataagagttatcatttctccacacactgtccaacatttacctttcatctttttgataaaagctactctaacaggtgtaaagtaataatgcattgtggttttaatttgtaattctctagtaattagtgatgccgagcattttttcttgtactagttggccatttgtgtgtcttctgagaaatgcctgtttaggttctttgcccatttttaaaaattgggttatttgttgttttgttattgagatgttggagttacttaaatattttagatattaaccccttattaaatgtatgatttgcagatatttctttttatatttcctgtttacaaatttcctgaacttctctggctgctcatttatatagaattgggatgagttatgtcacctgaagcagtcaagataagactgtttctactgatatccatatggcaggcttactttgttacccaatccaatgaaaaagggtgccaggatgtgaaagaaaaatagatgtgatggccgggcgcagtggttcacgcctgtaatcccagcactttgggaggccaagtcaggtggatcacgaggtcaggagatcgaaaaatagatgtgatgccatggaacattctagggaattaccatttttagagagagttttgataaaaattttacgtatttttaaaactcatattcttagtctgaagagttggaaataaggttgaatgtatgtcttaaagctaatagtataaaaagagaagtgtaaaatttaagttaatcatacaactttctttccctaactttatgaattgactttttgcaatttccggagctaatgaggtgaatgtctgaaattgagtatgtaggttaaaaagttgaaattttcctaataaaattgtatctctttctaaggtgtaactctttctttctttgattatagtaaaaggagcatctgtggttcttaagaggtcttgatttttctgccagctagttgtgtgactttgggtaaataatgtcatatgactggacctgtttctttatttgtaaaattgtgtgtggtgttaaattctaagactgtttttaaaaaaatttttgcggagactgggtgttgctttgttgccaaggctggtctgaactcctggtttcaagcagtcttccccaccttgacctcacaaactgctgggattacaggcgtgagcctccatgcctggccaaattgtaagactcttataatggatgagtagaatatatttaagattatataaaaacacaagtcacttcatgatcatcgtctgctggaacatgaaaccagctttcttgtgtagatgtgttatcagtaatgttattcacaccgagaggatcattctgtggtttttaattcatgattttgtaatctgatagtgacttttcattatgtctcctgatttataattacatcacagccattatgattggaatcattgggaagagttgaaatgagcaatttagaattgtttctgaaatacagaaagccttattttttggtgggggttgttggaggagatatctctgtgttctgtaatttcatttgactaaggaatttatctttggtcttctcccagagtgaggacatgaatacttccatagctatattccgtattaatcacagtttgctttgtgggtttcattaggctaaataagaaaaacgtcgttatgtattttctgctttaaaaaatgcttcttgatataaagtcttctcagatcagtcccacatgtgataaatctattcaaactattaaactgcctcaatgtgcttgtttctctcttggaaatctatccatttctgtgtctttatgtaccactcactctcccccatcatattttaggttataagctcctttcctttatatctcatagcacccaggaaagaactttgttagtctctgaatagtttataagtgttattgctattgagaattttggatttaaattattggaatgaatagaataatgctatttctagtatatctaactgagggtcagtgttattaactcaaagacatagcagttttattaagctctaggctttgtttctgaagtcagtttctcttaatcataagtggattattcactttatattctcttatataatgccttggtatcaggttattgataggtaaacatcagaaataggctggatagatatgcatgcatgtgtacacatgcacatgtatgtgagagagagagagaaggattgcacatagaatatatgagaatttgaggtgtgtgtaatgtttataactcatctgagtcttacatagctatctagttatgtacacttaattttgcaccttttatagttgaaattcagaaacattttttaaggaaaataaggacgtgtttttctttccttcatgttttcagtttagctttatttgattgtatttttgctaaagacttaaattgtcaataactattgaaatgggccaacttatagctgagcacaaagtatgttaggacactgagatatatcttaacatttgggaataatttaatgtgtctaatacttgagaaggatcaaaacagactgtacaacccaataatcataaagcctatggtcaaaaatcgtatataaatgacaggccctatgaagagtagccgtaagaatcaagagaaaaagaacctaaattggtacagaaaaggagctgagtcatttttatattataattagaagttggtaacgataaattttgtcttcccagtacaaaaagtatcatgatcaggcaggattacgctaaagtgtaacctctaacttcttgtggtatgtactattacaagtagttgatgatttaataaatataaatatagatgatactgtcagagtgtttccagacattacagttagcttttaggtgaaggcagtgcttgacagaacctaagtttgtgactcaataatttattatataatctaataccatttttatcttgtattaatttgggttataggataattggggtaactttttggtgagggattgaaattttcttaaaagcgttttcagaagatactagaattttatgggattcttttattatagcatgtcttctcaaatataatattaggactgcttgaacaggaggcaaatcatattcacgttattttccagtttagagttattgctcttatcagttggtgggtgtgggaacaacttaataaagtttgggtaatttagttttcagtttaaattctcaactggcaattggccgaaaactcccatctgaagacatgatcatccaaatgtcattttgtgatttggctactgtctgcttgacataggaaagcactatcaagaaagactaatggagtgactatcaaaaggaagtcaatggtaagagttttcatttaaattgtgtgtgtgtgtgtgtgtgtgtgtaaagcctaccaatgtattatatttgaattaaaattttagaacttttaaaatctaggacataatgacaagtgtttgaattttatatgtctgtcacttatattttaataaaatatatgcaaagaatggttttatagataagagattttacatacttaatgttgataaatagtataaaagtatggaaaatcaattatatagttcatgtctggtttaaaaattcaatttttgtagttttattgtagttatttaaaatagtatattataaaattgcttgactgaagtttaacttctaaaaaatttgtactaaactgagtttttctgttcagtttcataagtgcttcttaaaatagacatgcattttgtggtagtctgttgaatgctgtttggttttttactttcattataaaataggaaagaaaaaagtataatatcatatgacaaaatccatttagtttaacattagttctttaaaaatgtataattgctactatactttggcggaaactattaaatttgtaagataagacgtttatactctatacccaaaacaaagtgaagtagctgttcataatatggcgcagaatcaaattttggtgataaaatcagacatctctctcctgccttacacatactcccactgagaaaataatttctaaatttggttacattttcatatacttcagatgaccttaaatttatatttttctcctgaatatatttgattcctgcatatccctttttttgggcatctgtgtccaatcagatccatgattagtcatgttagctttggacaagagtggaggtaggatcttagcaagtttgaaatctttaagattgatgtttatctgagattattccagcatgtccacggacatagtagttttgtgataacaaggtaatggctgatgaagattagcatattaataatagattataattctgttaaccattctattgtcaaatacgtgatttttgcgattcacatagtttaagtaatttttcatgcccaattagagatgtcaaaattatgttaattgaatctggccatgttcttagctgttttctagagcttaataacaaacatatcaggaagagctcttgtgacaagcacccagcacagcatctgtcattatgtaatcattccaatgtttacagtgaactaagtacttgagatggcaacattcatactttagtccctctgtctagtaattcatacttgtatagtctgtctactatgtgtcacccatttaggtaggtgctgagaataaaatggtggggttaaaaacagatattccctgttattgaacttccagtgccaatggtaattacagtgtagataataattacacactgcaactggaaccaatactataaaatggcataagttcctataagggtaggaacaataaagttagtgtataaataaagcacagaacctacacatttatttattagattgaattgataacttgcttttgaacttttaaagttaattctattaatatctgctaagctaggcatcagaaagactaaattctaaccatagagaaatacattttttatgctgctattctattttcttagatttcttaagaatttacaacaaaaccctgtcaaagcagcattcttacgtgagaatttcacttacgggagagttcttacaggatttcaagaaggaaagccctgaagagggacactgatttcctcaactgaatttaaaattgttacatgcagacatttttaaaggtagtatgattttccttaatcaagtcaactttatatctttttatctttttaaagaagggaatgtgacatttatgtttttcatacacacacacacacacacacacacacacacacacacacacacacagagaagcatacatgttgattacgttttggaaaataaaatccaaagagcatttggatgtctgaatgtttatgcttcatctccgcagtgacttctaaatttagtttttttctggatatactcaaagtcaccaacctgagttcaagtattctgatttgaagatctcaacttagagatccaggcagtcccccttgtcagtgctaggagaaagatgtccttcccataccttccagaaagagtgtcttgaagaaatatattccttcctgggtaacgtgctttggaatgtacatgatattcatttttctttgacagctctttttggttctgtttagttggctttgatgggttcatgatgcccagtggagaatttggtatttagccacaaaaagatatttaagacacataattatgtaaatattgcagatggaggatgatacatagcatttcttttatcaaaatgaatttgaattgacttctttctaaaacaaaattctaccaatagtcatcagtttttaattatataacttctcaatataggaaataatcagtgtctgattggctgtgtatgttggagtgtaatggcttttgttttgaatttggcagtttctactctcagaagaaatgagttgcgaattacagtggtgttagaagaaatgaattggaagttcgaatgagaaaaatttaaataaaagttattgtttatagatatggaaaggaaaataatgtttttagttcaatatgagaaagaaccttttaaatgtagaaataaaatggggtgcctttctacatccattcttaagaatttggcagaagttatgaagaagttaaaaagaaggagttcctgctgatataagtcacgaggattatttgaaggaaatttatgtcacatctcgtaaaatcatcatattgacaattataaatatgtaaaactttatgtgcaatagttattactaaaaatactgagctactatttatagtgagatcattattaaataaatttaacagatagaatagcaaatcacatttattcattcagtatattcttaccaacaacctgctgtatgtcagtcattgcataagactgatgtgatgccataggtcttgcagggaatgtagacattaagcaagtaattacaataaagtatagtggcttatgatattataaaaacaaagcagtccttaagtataccttgcaattgatctgtagtatattaattttaatccgctcatactcctcatgaaatgaggttgttcattttgatgtaaaaattagactgacgttctttgcagttagtagagactgaaaaagttcttattatttgtataacttatttaaaatgagaaactgctgtggaaagatctgcaggtttctgagataccaagaaacgtgaatatgagcagaataaacacatgcatattatatacattataaacgtcatttaagacaattatatgaagcagttttacatttaaaactaccaagttgtaatagttaagaagttgggctccagagtcatactggttgggtgtgagtattaactctgacacttaccagctttgcagtcttaggaaacctgcataactctactgtgcttcagtttccttacctgtaaaatggggataataagagtatatatcttgtggaaaaatatattatttgatatatgaaaatgctagaagagtatctagcatatggaaagtgcatagaaagggctccatatgttgttttagttaataattacaataataatttcctcatcttaaaaatatcctgcttcattcataaagttgtgccaacggaaataattgcagatgatgcttaaaatacatacaatatatatttcagagtggtatgtaaagagcttttattattactgctaaacaaaaaaaaagtccgtgaaattctcatctaagctttggggcctctttagctgaatttcagcagtcactcaaaggctttctagagatgccatctagagatactttataacctagtgtctttttttttttttttttgcaatacagaatttttttttcattgtaagatgctgaatgagagaaaattatttcagtactacaagtatggtttcccatgaccacaattagttctaatgtaaccagtcaacagttgtctattgaaaaccactagctattaatatagtatcatggtagcctaaaagaattatgctatccttctacttaggctctagggagacaagagccatgtaaagaatacttaaagcacaaaatgtgagactgctctgccactagttcctgctctgccactaataaacagaggtatcttagatatatgaacctgttacaattatgaggccatcttagcatctcagtacccttattatatatatcgtgtgtatacacacatggccatccaatatttctttcccaaattgaaatgagaggaattcattaaggtggttttaatttccaaatttactgagtaaaagaattctattctaaaaattattttgtataatgcccttcaaattgagttttacatgtactatttcaaggcttctcagatattcccacataaattatctagtgtttctgcatcactttgcgatcttttcattaatgtcaagtgtaatgttttttaacttcacaagggaaacatgaaattcctttagtgtgcctcattttcagacattttcttgttgattaaaattcctttttaaataaagtttcaacatgtactaaataatttgtttacctttgaattaactttttataaatgaattttaaataatgacagcagtcattacaaactctgctgttggcaacactagagggcatttctagttcttcagacagtgtcatgagttctcagaataatttaccaattcattaaacagcagattagcattttaagggaaaggaactaaaacaagcacaatacatatatcatacatatatatagtatgtatatattatgcatagacagataatataaatatccatatataatatatacattatataatatatggataatacatatatattggatgtatgtatactcacgtctgctttaccaaatgttctcactgaatcactactcctaaaaaggcgggagagtatttgtgatctgctcactgaagcaccactatattatccagttgtttattagtgtcgtggaggtctatgctctgataggtttagcatcaagtgaacattgagtaaaaaagtatatgtatatactcatacatacatactcatcagaagttagttgctgtgcttattgaactactagatgctaacatagtcataattagaataatttttcagataaaaaatgagagttaaaatagatgccctttataggcttagtagaagatttaagactacctatattttgaattactgtattttagatgttaaaatattttcaagggttttgaatgcaaacatttttagggaaaagatacaattatgtaatattaaatatataatattaaatattaacatgcaatgatatgaaagaagacaagtttataagaaaattcaattagcgtaaagaaaaacttttttttcttgggaggatttgcttactgcggtgtattggggaaaaaatcttatatatcattaagtaatcattaacacggtaaaagtaaagtcaaggaccagcaaaaaataacctaattgttgtgaaaataaggtgacaaacagacaatcccatcttacactgtaacatactttgtataagaggggatacatgataaccactagaacagtggtggatgtgcaggtggtagatacacaagggatataagaaagtctttctagttcaaatgtatttctgccatgtactttacccagtagaaatgcatttacatttttaagaggagcgtataaatctctcaaatatttctgttgatacatatacctatcattcacttaaatacctgagtacctactaagtataaaataccccgttattttatgtttggcacagtgaggctgtaacagtttatactcctattatgtagctgagaccagttggtctcttttagagaggggagtatcagttagttacagaaggactcatttgaatcatgagataatttgtgagaatgcagacccaagtaatatgctctaataaaatcagaaggcagcatgcttttgttgagaaatggaggtaggaaggtaacaacataaaataacctactttgtactggttcagtataccccataaactgtcatctcttttgtttgtttgttttgagggtacaaattatttcattttctgatattctctttcctaaggtattgttggactgaaacttaaccaattctcctctttttctgtctctgtctgtctgtctctctctctgtgtgtgtatatatatatacatatatatacacatatattctttctacacacacacagtaacagtatgtgcaagtcaaatttaattttaaaataaatcttttaaagcgtgggtcaatctgtgccagtcacacacagggcagtctgccgtatcttttgcatccttgttttgtactgctcgtgaatgttcgttatatagtagagtaggtaattccatatttacttgtactagaatatatctggcttaatagatgatgttccaaaggcttgaattaaaaaaaaaaaaccttagtgtaaaaaatttcaggcatacacttaagagagactagtgtaataaaccccatggcctagatttaacaatcagcaaaattttgccacatttgcttcatctactctcttctttttcctcaactatttttaaagtagatcccagacttcaagtcttttcactcctgcattctttcatatgcatttctttaaaagaaggaatttttcttatataaccacaatacctttattacatccaacaaaattaacaataactactaaccacctcatattctctctgtattcagtttctctgcttttaactgaaaaatgtcctttttacgtttagattgttctttcagaatccaaccaagatctgtatagcatttggttgtttggactgctgtataattaaaaggtcttttctttcccaccacttgtttacctcactcacccccaaacccccttcttcctccttccctccccttttccctttaatgtgttaatgaaaaaactgggtaaactatcctgtagaatatcctccattctggatttctctgttgccttctaacttgttcctgtagcctctgaatttcctgcgaactaaaagttggcttgaaagacttaattagtttcaggttcagctttggttttggtgttgaggatggaaggcatgcaggaatactttgcacatggaactgtttcttcatactgcatcacatcaaggagcatataatgtctgcttgtcatactcttatcaatgctaaaattgggcagtggtgccaacccaatctctctattgagagttttctaccaatctttcctcccgtgggaaaagttgctgactgttctccaaatcaattctgtcattagggtttgcaagagaatgaatttttaaatctgccaccccttacacatttattagtggaaattcttctgtaagaagaagtttccttcataaattacacctttttgatttatctgaaacaatgtatactggaaagaagcctggtgtcttaaatatcatctgttaatacctagtgtaacattccaaaggtaacttgagatactgcaaggaccacatagcaccttgagtacctattttacatgtgactctgaggactttcacagaataaagatatttcttattttaatgaacgttgtcagtatcaggataattttatgtagtcaacatatatacagtgttggtcctataggagttggagaccttttgccagttttatttggtcaaatacattattttgtgatgaaataactgtgagtgatgagttgagcctcaaagaacatgatacttcattaaatcaacaagctgaacagtatcatctaaccaaagctgtagaataaatggtgataaacttaaattcaggaatgaaacaatcaccatttttgttacaaatttgtccacccgtcatcactaaccccatttttatttaatactggtaatgaacaaaacctgaagaagaaataaaactaaaatatttcatttgtagatgacatgattaattatctagaaaaatctacagcaatcagctctaaaatgatttattaaataataaaaatttaataaagtaccagatatactgtatctttataccatgtgaaaatcattctgggaaaatatcccattcagaattgcaacaaacgatgtaatatctagcaatacatttgagagagatgttagatctttggaaaataaattaacatccagtgtatttgaaacaattttaagattcaaataaaagcagagaaactgtttctaaatcaagaatattggcaaattatttgactaaaagtaagatttttgggtttaacctctaacttccaaaatttctagtgatttattttatagtgattctgtaatgagaagtctcgtcctactaaatatcaaaaggttttaaagcaagaatgtctaaaacagtgatgatgatgtaagaataggtgtgttacccagataccagaagagacttctctgtctgttggagatttaagtatacattttctggccaggcccagtggctcacgcttgtaatcccagcactttgggaggccaaggaggtcagatcacttgagatcaggagttcaagaccagcctggccaacatggtaaaaccccatctctactaaaaatagagaaattagctgggtgtggtggtgcacgcctgtagtctcagctactcgggaggctaaggcagaagagtcacttgaccccaggtggcaggggttgcagtgagatgagattgtgccactgcactccagactgggcgacagtgagactgtctcaaaaaaaaaaaaaaaaaaaaaaaaaaaacaaagtaaatttcccttgaagcccgacttcatggccggtgagagtcaagagacatggcctggatcccgtgacttacacaaatccctgtggctgactcagaccttagtttctctgcctctgcttgcatgccaccttggtttctgccagtgtcaatacatatgtgaaaccagcccctttactagtttcaaacatttaacattttgtgagttaagaaatcctgaataggtgatagaccagcaaatgattttcttaatttttgagtggaacatgctatctatgttcattcttttcttctactcatactttactgaattaatacagttgttttcttaagaggaatactgaacaaataagcttgttttcattttgtaaaacatagattactggagcactatgaggaatacaaaatttgtcccatctgttatcatatacagtaactaaatgtatgacaaaataatctttcctaagagaggggcacttaaaggatatttgttcagtggtgttggatagtactattcagtgatatgtcttaaaactaattagacaaaaatcatccgtatattacacaaccataggaataaaaaagaaaaggtaacagagagaatacctttacatctcatatttgaagaattagtagaactcacccagaagatacttgaatattaaaaatttttgttggaccaaaatattatgattaaaaggataatagaaaattgtggaaactacattaaaaattataaggaaagtgataataggtataagttatatattgttgtaaatatgcaagtttagatatcaagattataatacataagtgagaaatgaatatgacagattaagaatatgaaagtaaagacacatgaataataaagaaatatgaggtttttttcattgtattaaaggacataaatttttaaaaagagaaatctaatatttgcaagtaagcagtgctaacagacccttttgggaaataatgcagtaatacatgctgagagtcacaataatgtttagaaatttcataataacatattaggaaacactatgctaattattttacatatatatatatataaaatgcccagcttaaaaactaattatagaacagcaacataaaatattacatttaaatgattatttttggagactatagaacaacactgttcaggagagctttgtggtgatagaaatattctgtgattgcactatccaatatgtagccatttggcacatgtggctgctgagcccttaaaatgtggctagggcaactgagaaactgaatttttaatttaatgttaattatttaaatttaaatagataaatggggctagtggccacaattttagatagtgtagttccagaaataaagagaaatgtttggtataagtgaaaataaaatagtaaatttatatgccatgattacaagtatgtacataactaaatgtacgtatggaaagtgatagtcataattaaaatatttgtgttaggattgaaggaaataggtaatttttttaaaatgctaaatttttaaaaggttacatgacaataatgtaacacttcagcattgtactggtactgttcagtatggtagccaccagcctgatgtgcaatttaaacttacatctgtttaagtaaaattaaaaattcagtaccttaatcacactagccacattccaaatgagcagtagtcatatatggctaatgtttgccttttcgaacaatgaagctatagaacatttttgccattgccaaaagttctattgtacagtgttgtagaaagaactggtaaaaggaatatactggaatcagtcactgatagtttatttgtcagtagtttctaagggcacatgagaattaaaactggaaattggattcagtaaaaagtataaaggaagagtaacataagatcctactcctgtaacttagattagtgcttttttttttttttttttttttttttgagatagagtctcactctgtcgcccagactggagtgcagtagtgtgatttcagctcactgcagcctcaccacctcctgtattcaagtgattgtcctgcctcagctacccaagtagctggaattacaggcatgttccaccactcctgactaatttttgtacttttagtagagacggggtttctccatgtttcccaggctggtctggagttcctgagctcaaataattcacttgccttggcctcccgaagtgctaggattacaggcttgagccactgcgcatgacctacaccagtgctccttgaagaatgggctatgaactggtgctggtttgttaatcaatccatgactaaatgcttactctcaatttctatattggtttagaaactcttacagccatgtgatatttgtgtcattcaggcacatcacctgtctccccggttgaagttcaggccagtagttttaacgcagttgcctggagagttttatgcaaagtgagctgagtatagtcatgacggtagtccatgaacctgggtccccaaaagggagaaaacagtctttcactacagattgcgtgagaaacattggccagcattaaagaaggaaagtagattgctcagggaagttttgtagggaacttaaaatgagatgttagtatggcttagtaatctgtatttgcaggtgaaatgaaaaattcagccctaaatctctgaatatggtaaacttagacttcatcttctgcaggtggaaatgaggcaagggatccattatccacagcatgagtaagtttctagtcagttcctctgtctagggagtttgttttcccttttcgcccttgttggcctgggagactcaaccagcttagtagtcttttcctttcagtaagatttccaactttgggttggtctttacccctttttagctctttttgtcgtattatctgcacttagtactttgtaactgttttcaccccttccccccaaagttagttcaaaggcttacagcatgttgaaaataggaaaattgtttttaaattaagtgagtttttgtgtacacttatttctttagtctaaagttttgttttaaatctctttttcacatttaaacctgattccctgagacaagatataaaattgaattatttgtgaaatgtggaaaggtttttattgcctgtaatcaaagcataatctgtccattaaagcattattttagtgatgaagggtggacatacatcccaagtttactacctgttttcttactgtggttttgaccatacagcaaatggtattttatactctgaaatgaaatgcaccatacacattgtccagtatgttttgagttttaattctacattttcagattttggggtcaaatgaaatcaagtactttataaatagttgtttcttctgattctactggccttacatgttagatttttttaaagtatacacattcagtcctttatcagtaccattaatcaaatgttgatttcagcatttcttcattttgttttcttttttcttttctttttttctttttcttttctttttttttttgagacggagtctagctctgtcacccaggctggagtgcagtggcacagtctcagctcactgcaacctccacctcccaggttcaagcagttctcctgccttagcccccccaagtaactgggattacaggcgcttgccaccacatccaactaatttttgtatttttagtagagatggggtttcaccatgttggccaagctggtctcgaactcctgacctcgtaatccgccagcctcagcctctcaaagtgctggaattacaggcatgagccaccacacctggccagcgtttcttctttttctctctaatttatcaaatttggaaacagttggaaaacatttaaaggaaataagtctctgtgtttttaataatagtttaaaagttaaaggaaaacaaatgaataatattctgtttattatagtcagacaaaatgtacatacgaaaatacataaggaaatatagaatggcatcttctgattttaatttaatattatggtaatgatttacttaggcagaattatagctatagacaaccattttatcactttatttatatcgatctactctctatggatgaaaacagttaatactaaagcattaagaaggtatattgcttttcatctgtattaatattcttcttctgatatttgatatttaataatatattttaaaatactctgcatgatttcctgatcttaaagcattccattcctttcaaggaatttggattataatgatttatttatagtatttttgtcattaatattttaggatatggcatcttaaaatattgtattcctaacagttatttaatatataattaaacatctatattagtattattttatataacatattttcaaactcctcagaacatttgtaggtttttgtttaattttatgtaagtttcaccttaagaatattgactaatcggttaatattcttcttaatcatcgcaattttttaaaatgctttctatgtaccaggacctatttaaggtactacagataatcagtgtgtcaaaaaacaaaaccaaaattcctttcctcatggagttttacattctagtagattgattctactgttgattcatactaaattaatttattaattatagtagattattctgtggcatttaacagaattcaaagggctacttttctgttgttaggaaatagcatatgccattatcttggaaatacaaagggaggacagaatttccgctggctctaacccattgctttttaatgagtttagctatgtatatatattttaaaatggaatttataattatgatcatttggcaacctacagtttttctgtattttttcaacttctcaacttcccagtgatgggggtggatgttgaactagtcacttaaggttttgggtctaaggagtaatatttgaaacatgcagtatttagaggagatatttttgtgaatgaagagaatgtgattttaagaatactcatgattttatctaatttctgttctcaaaacttcattttgtaatatagaagataagcttgatcaaaatagtttgatcccagtataatcttttactcttctctcctcccttaggacaaccttaaacttccaccacaagaggaatataaagaggtccctcctgcaccaagaaagatctgcagatctttttcagtgttcttggaggtgtggggtgtgagaacttgatcagtttgtgtcagccaccttgttctctaaaggtaagcactgtgtagtgagtgcacactcgtgggcccaggctcctaacctaagactggttttggaatgctccattgagggtgtgagaccttcagacgttcgcacagaagggaggccctacctgtgggtaggacatcacacattcatcaagaggtgcttttcgttatttagaagtgaagcatgtcctggggatgtatggatatttttgttttgttttactttaaaaaaaatcccagtcatagtaaaaccttccagtttagtctgcatttattcagttaataactgctggagttaatcaaaaatttttcttgtatgtcttgagatatggattaagaattttgaaacaatgacaccatttaggcaatctagtgacataatagcttcagttgatagagccagctgtgaagaattacttttcatgatctttttgaagctgtatcttatctttacttcagggaaagcccctcaaaccattttgtattctgtattacacttcagaaagtgtggaagcaaaggtcatctaatctttaaaaggtatgtaatcataaaattttttatgtcagatcttaattgaaaaatattacttaaaacttgaaaaaattacttaaaattggcaatttctttttcgtcttacaacttcttcctgtcttcaggaaatgaagaataaatatgttggttctatcagggaaaccttatgaaggataagcaaattaatgtctgtgctttacttccaaattctgacatcagaaaaccttattgttaactaatataatctatagatgtctctcaaaatgaccagtcttaaattcaaatgtcatttggatatcattaattgactatggagaagagcagaagcatgctgatttcgaaaatgtcattaatattaggattaggtcagtcttaggcaagaatactttgaataacaagagactaaatgtctagtaaaacattttagattgtaattcccagtattctgtagtattaacaatgagacttaaagtactggtgaagacattaaatttgtccctttcatttatcttttcttaaagctcttaaagtgatcctgaagactttagttctacaaaatgtgaacttcttatggaccattaaagtggggagtaatctgctgatttttgtctagcaaccctacctctgatgcaggataatttttcaaaaccgttgttcttcctatagctgtataatagaagatattaaagaggaaaaatacttgtgtgtttgctgttagaatgaggaaaaaatacaaattggacctttttgaaaaaccttgagaaccaatttactttttttgtatgtaaatggtcgaggagttagaactagtcttggttattataactgcaggtaaacttaaaagatttaaatcttcaaaacagatatcatgtaggttttattagaaaagaaatatagattattgggtgtatagagataatctatatatacgtacagttttttttaatttttatttgcaagagcatgctaaatatcttagcctttataatagcatagaatagaatggacaaatatgttatccctttttgccagttgagaaaacactttgaattaaatctccaacctaatgaaaattataaggtgggttatagaaataactaaacaggttattatttcttaaccaaactaaaggtttattctaactaaaatacttgtaatctaagaagtctccctaaacatacaccttttttaaagtgagttttgttttatgatagtacatattttagcaacatactttagaaaagaaaagtttatttcactatcctagaactcgtgttctaatttcagatcagttttgtaggatgtataaataaaatggggacctatgagatctatgagatcttgccgtctgtatctacagtatcaaaaataagatcatttccttaacaattcttattaataacttatccatctcaattcataggaggtgacaaaatcaactgttgttctatgattttgatcataggtaggagggaaaacccaaaataatggtaccgagggcttcttccattgaaactaatatctgggagaagatttgattttcatgtgtacatatacacatacctatattagtgtttatttcttttttctaatcatgtaagaatttgtcaaagatcaggtttctgatttgtctttcatcggtatctgtatgccacattttgtttttgtttttgaagtgttcctagccagttcatgctagtccctactataaattttgtttccctggcatgatcatgctctttacctactctggtagctggagggaggtgagagaagcagtcttatgtgtttaccgtactgatttttttttagagatgggacaacaaagaaattctagcctttggagacatctagaccagcactatatggtacaaagataattcgagccataaatagaagctacgtatgtaattttaagttcttaatggccatattaagaaaataaaaagaggcaaaattagttttcattacattttatttaacccaatatatacaaaaatattattccaacatataattaatagaatgttttatgagatttttttcatactcagcattcaaaatctgtgtattttatactcacagcacatcttatattggactagccacagttcaagtgctcaatagccgcacgtggctagtaggtaccatattccacagttcagatctagacaatgagtggaattctcattttagcctcatacatgccaaaatccactggatgaccctgcgaactccccttgtttagagtttccaaatttagcagaaggaaaaaacaaaacaaaacaggatgtccagtgtaatttgaatttcaagtaaataacaaataatggtttagtgtaattttgtcccatgctatatttgaggcaaacttttaccaaagaagttactgcttattcgaaattcaaatttgactgggtgtcctatattttatctgacaacccttctctggtttaacttgagaagaggacatcatcaggctgcctggaatcttggaggactagaaaatagagcatctctttctctgcgcaggattttaataatcctccaaaaatcagcctgtaaactagaagatatctctagcccatttcttcctaatgacctagtatgtttaagacagaagaggggctcaaatggcaaggatttagtccatacatatttaaacattttacatctaaattattacattaagatataaggtttacgaaattttacaatttttgaatgattacttgaatttataaaatgtagatcatctaacagcacaacgctgctatcatttctcttgaaaactaattctcctttgacagtaaccacagcagttttcagggtcttggccatttcaaggtattttcctaccattggtttccattgcatctgtcacataaacctctggtagtcaagcatgaacacaaaatacaaggctactgaatgcagggattaggcttacttcgttacaagtatttaagtacttgtaattcttagctctggtgttgaccattggatcctgaccagttcagcaatcagtctcctaagagcttcttttacagaggaacatctttccgttttcattctttaacatttttaatgtattgattttagtacatttttgaagcatacagtcacctccttagtagtgtggatctaccctcaagtgctatagaagagactgtttgtctcgaaagacagtcattgcaccacctctctccagagaatacttttccttcacaaggtgcatgactcaagatgacaggcttacattattatttatgtaggcaggtggatgccaactgccagtgcagggtggcataagttagcgttccaaagttaagctatggtgcattccaaatccattcacacttaggagaatgtacccaagagtgtggggatgttttcaattactgcatttccttcagagaacaagaaccacaggtaagtttgtgtgtgtgtgtgtgtgtgtgtgtgtgtgtgtgtgtgtgtgtgtgagatccaataattatttctaaataagaaatttcagaatttgaaaatattgcccctcccccaaaacagtcacctgaaaggtctcaaatatagctttcggtatatatttttcttcctcactctaagaaggaaggtattggagttggtggtgatggtggagttgggatgagggagacaatttactgtcatttgaaagctgtgaatgtcacacattttcatgtctagaaatatcctgggtttatgtaagaatctgattttgcctaacctctaatgtctcaggtatgaattattttgtcagattaacacatctatataagtaagatgttcagccttgcttagctaatgtcttcaacagcaatgagtaaactaatgagttgtgtctgcatttttcacttttattctcaagactgacttccttttgtttaaaggcttttgccttatttctgaaaccataatttaaagctacaaaagacctgaaatataatctagtaccctttttacctggggatccttggatggatttcagagattctgttgaatcccctaaaattacagtcatattttgtatatatgtgtttttactggggagaatgtccatattttcatcatattctcagaggatttcataacaaaaaatttggtcgacaaccactgtgatctagtctaatgtgatcattttactgataaactgaagttgaaagaatttaacttatcttcatttgaaatttaatacttgtgaaaattaaagtttatttctttaaaattcatactgatttttaaaagaaaaatacatttaacttcaactaattaaacttgaaaataccagcctaaatgggagcagttagtttgctaatgctttcttctgttctgccctttgagtggactctactagttaacattaaaatggccttccaataaagtatgaggctatgtgataagttcttgaagatagattaaaaagaaaaggaattatccattataatttaaatccctttttctctcttcaaattctgtctccaaaactaaaactcaagaaaataggtgaataatgttatttttatatttccagaatattaaaaaagtaggtaattgccttaataaacattacactgggcattattgggacagttttaggttctgaaccctagttaaagaaattcttcagtagcctatatacacttcctgttggttttcagtgataagggcattttaaggtctttttgatcataagatgcttttaatgttatagtaggactttagaaatggtaagtaagcaagttctgtattaattagggaaactaatacctttttctcaaaatgaaggaaatattattttttctttttcttggtactaaccagtaaagtctgcctagtttaagatctagtgcatttataccataaactgaatattagaataaaaagaaatatagaggatgttatataaaagacaattattttctgaaaggagtagaaaacaaggcaacttggaacactacatatatataaatgtaaaatatattaatatacttttatatagatgatattatatatccatatatatatttttttgtttgtttgagacaaggtctcactctgtcacccagcctagagtgcagtggcacaaccacagctcactggagcctcgacctctgaggctcaagccatcctcctgtttcagcctcctgagtagctggaaccacaggtgtgcaccaagatgctgagctaatttttctgtgttttttgttgagacgggggtctcatcatgttgcccaggctggtctcaaacccctgagctcaagcgatcctcccaccttggtctcccaaagagctgggactatcaggcatgagccaccatgcccagctgtactatttatattttttatttaaattaaattgtgcttaaagattctaaaatttatagtataaagctcattatagaaaatggtattgacttctgaaacattatagttttggttttgtttttattccttcggacattttcacttaaggtagttatcactcatgcttttctgctattataaaaagtgaccagattttgcttttttatccaggaagaacagtttgtgaatgccacttgataggccacctgtgttattttccatgggtatttctaacaaataaaaagttatatttttactttgtattcatcaaattattttatgtttaatttagaaaagcttaaattcttcttaggaatatttgcaaatatttgtaaatagtttttttcaaaaaagttgaggtagatagatattaaatatttttgtgacttctcattaaaagaaactgaagcaattagttgacctcactcaattcattaaaacagtgctaggttcctggttttcgtgacattaaaaacaattcaacatctgtgtgtagacaatgactaaaactttatgattttgtttcagagttttattaccatagatattgtttaaaatagaactttcaaatacatttaagaaccattaaaagtgacttctccctgtgcctgaaagatacatgcatggcttatatctttttgtgtataaacaatttaatgtttaacttttatttcctttaagtttgcatatcaaacactcttagcaatctcatcatttatactggagtacttagactttgaaactttgccacagctacctgccacgtccttgtataggatataagtaaatatattcagtcatcaaatctatagagaactgtgagaatagagtggtaaacaaaacacattgcctgccctcacagctaaagaggagtgatggtgggaaagtggaagtgatcagaacccaatctgaggtcagaaaacaaaactacaatctatttcaggttgcacaaatgaaattttaactgaatctgagggacattagatttaatcaaaccaaatgagaaggcaaggtggtgttttgagctaagggcacagcagatgtaagagtcataaaggaagaagaacaaaacacattcaagataaaagacacggagagagggaaagatgacactgtacggtgaaatatcttgcaagtcaatattagatactagcctttgggctttagcttgagaacagtgggaagacattgacgctcagatttttttttctaaagttttttattaatgcctaatacatatagaagcattagcatactgcttcgtgaattttcacagacttagcacacctatgtgatgaacacctagatgaagaaaaacaacaatatcagcatcctaaaagttccccttcattttccttccagtcagtcctgtctcttgcccaccaagggagacctcttgcctgacttctcactgtatatggaggatattgcctacattgtacttaatataaataggggcatacaatgtgtattcacttgggtgaagcattacgattatgagatttatccatattgttgactgtggttgctaattgttctcatagctgtataatgttccgtcatatgcatgtactacagatttgcatttttctgagattgctgaatctgcatcatgaaggatgggagggtgtgaatttagtaagcttcacagtaaatctaggaaagagatactggggcttgagctagtgtggtgacaatgaggatgaagagaggtgggtatatagagagatatttacaagttagaacttaattggatgaggggatgaagaatcatacaccagagataactcctgggtcctgacttgggcaggggttaatggcagtgcccttcattaagtccaaatactggagaggaagtgggttgttgcttgtgctttagtgatacaggggattaacgaattcaatttctgatacagttaaggcatctgtgaaacattgcatagatctgctttatacaactgttttattaactgaattaatgaataaccttaccttcattaacaacagtgtgctaacaaatagttctacatatggaaaactgcaaatcttgtctagtctcactgttcttcacctctgaatctcacgagatactcttttcctaaatgtgttaggagtggttttgttgcatctcatgcttttttttctttttatttatagaatatacttcatctaaactagtgctaactttatgcaagaagagtagcacttcctaggtatatgatatgaaaggcattggtgaaatgccttcatacttaaaggcattgtttttccaacattatggtctttcctttagcacaataaagacaccttaaaatgagtttgtttataggaaataacctacttatttagtaagactttaatggactgaagtaaatattcatgagatttgggcaggggaaagaaaagaaagatagggatgaggtctgacctgagcacaaacctaggcagggtgccacagggggaaccctgaacatcagagagcaggttgaatgcacctgattttaaaggaagattatgccaaaagagtgacgtaggagctgtaaaggagggacttcacctcttttcgatgctgcctgggactagttatacttgtggaaaattttatgtgaagataactaataattctagcactgaatgaaacaaatgcctgagacctactggaacattaaatagacttttatgccagccagttatgattcagtgctatatttagaccacaaaatttgaactaaaatcaaggcagtttattcttatcccatcatgtccatggggtggagaggaacaactaagtaatcatgatcatgcacttcagtttatagcgttttctctagctttgggcattgtcacttaacagacaatacaattttaaaaattaaatgctcaatttcatttcactgaggttttttgttgttgcacaacattgtaagtatacagtaagttgttttttcttttaaatttttgcctctaattcaggtttacattgagcaaccaaatcagtattttcagaaaccattgaagttaattcatttatttaataattacttatgaaatatgtcatgtataatagtgctatagcctaagatgatgatggtgagaagtactcctaccttttgttactggcacgatggtggcgatactcagaacaaacaaaaacagtgtgataacacaaattattatatgactcgctgttttaatagtgtttacaaaagcagtgaatcccaggaaaataaactattggctacaatatcaaaaaagaaatgatggaagtggtagaatttaatttgggtcctgacaaataggcaggatttgaacatgtatggcaagaacactgcaggcaagggtaacatctcatgagaactgatgcagaaaaaaatacagcatatattggcagagtgagaaactggccagactgtagcagaaatcacaagctggtgtgaggagagagagaaaagcttcattaaggaagttttgaattactgaaaaattcaccagtcataaggcatggattattgtcttgctgtttagattacctataaatgtaattttactttactcaccaccatgtgataattatgtagggttttatctttttagaaacctgatgtgaaattacctgaaggaatgaagttagtgtgcttttaagttaagaatatcttcactcagtatccatggataggcttcagggaatctggatctctttgaaattaaagcaaaagtttggatgtatttctttttctggaggaaggatccattgcctttatgagtatgtaacagtccagaagaagttaataaaatagctcgagctctcctaacttaaaacttttttattttttattattattatttttttttttgtagagatggagtctcgctctgtcacccaggctggagtgcagtggcatgatctcggctcactgcaacctccacctcccgggttcaagcaattctgcctcagcctcccgagaagcttcatcttgggttttttattattattattattattattattattattattattattatactttaagttctagggtacatgtgcacaacatcttggggtttttttaatgcagtaaattaaaatggggaaattaaaacacgttaaatactttccctttatttcactatttactgatacggtatttaagagataatcctgaaaagtatatcagttgggttgattatataaccagagatagtggctattttatcaattccgtggctttcagtaaaaggacagctcaattgcctttttagatacagaatgtttctgaatatgctatttcaagtagaaattccttcctatttttggacaggcatatgtctgctttctgcagaatacaaagaattttcaatgtgtccagcttcagtcctgaaatttgacttacctggatcatatttaatcttttgcacaactgtttaaagcaggagtcaacaaattatatatagcccatgggccaaatccagccctcaaacctatttttgtatggcctatgacctaagaattgtttttacattttaaaattgttaaatttaaaaaaggattgtaagggattaggattttaaaaaggagaatatgcaacagagattttatgtggccctcaaagtctatggtatttactaactggccctttttttaaatgccaatccgtggtttaaagtacagtttttaagttctcctagatgcatgtgttattctacaagcagatacaatgcttgtggatagatattatttttgaagttgggagtatatttatataattttagcaaagttgactgaataagataacctgttttctatactgaatattcagctaatagtttcgctttctaaagtctggatttgaaagtgtatgaacaaagtgtggacttagtaatctacttcaaagaactatgtgaatatgaaagtagattttgtttttcatggatatattacacagcaaccacaattcagatcaagaaaaatattaaaatataatctttgttttagaagacaccacttaaggcaaagaaggcaaaagaaaacatttgtacctgttaatgagttgggaagggcagctcttaaaaattatactattcattggtttattcaacatttatacttatttttagaaccattatatatattggcttctttgtattatattttattaatattattgtatgagatactatgattctaaattttggataaatattgaaattatttttaatgggggatatgtcataattagtgagtctcaaaaaattggggcaattctgccttctctctctgcatcattatttttccttcactactggatcttttccaccaacatacaaataatgttgagttttttcccccatcttaaaaaaaatcttactcccagttctcctttagttactaccccatgtctttcatgtaaagcctatatctctgaagtatgtagttgcctgtgctgtctgaattcagttcctataacccctgccatttcaccagaattgtacttcttaatgactgccatgctgccaatcagatggtcatctcagtcttcctcttatttgacctggcaacggtgtttaacactccttgtttggccttttagatactatactacactgtcctgtttttttttctcctacccctctggctgctgctttttcaatctcttgctgatttcttcttgcctccccatctccaaattgggaatgctccaacatttggaattttgaggcctttaaaactgcatgttcactcccttagtgacttcatatagtaccatggctttatatgatcatccatttgctaatgatcagaagtcctttagtctttttttttttttttttgatatggagttttgctctgtctcccaagctggagtgagtgcaatggcatgatctcagctcactgtgacctcctcctccggggttcaagcgattctcctgcctcagcctcccatgtagcggggattacaggcgtgtgccagcacacctggctaatttttgtaattttagtagaaatggggtttcaccatgtcggcccggctggttttgaactcctgacctcaggtgatctgcctgccacggcctcccaaagtgctgggattacagatgtgagcctccgtgcctggcccctgtagtcttcttagaatgtaatatagtaaactgaattcctcatctttcccccaccaaaacctcctccggcagtttttcccatctgagtaacagcacctgctgtcttttaatcagccttggtgtcaccaaggatgcctgtcctcctttcattccacatatgataattcttcacatttctgttaccaaaatattatcttgcttctgtcccaaaaatatttctgagattcagttattgcttaccatctctactcctacaaccctgatccaaatcaccttcatctcttacctgtattgatgcaaaaagcctcctgtaattggtcttcctgttttttcctgttgacttaacttcagtccattcttaatatagcaggtaaagtagttatatttaaatataagccatattatgtcactcttttgatgaaaatcctccattgacttttcatctcaaccagaataaaaactaaagttcttaaaatagcctaccaggctctgtgctctgggctgtcattcccagacagccactgccaaccactcctgcctgctcacacccactttgctctagtcatccacactggcttctttgctgttcttagaacatgccaggcaagttcttgctttagagcctttgcactggttgttctctgtaatactctttccctgtatatctacagggatcaatctctcattacttgagatttgtacttaaatgtcaatttaatgaagctttctttagccacttgatctaaaattgcagatttcccctacttcaccccaattctccttcctgctttatgtttcttttcttgaagacctgttaccatctaccatcccatatattttacctacttttttcatttattttttgccttcctccactagaatataaaggctttttgtttcctttgttcactggtctgtcctcagcacatagaaatatagtgtttggcccacgttatacacttagttaatattgatgaattaataaataagtggaatttaaaaatagccaacacaaaattttaacatagttcagggatttttgagagctcctgggatcattgaataagcattcaaatattccagtaaatgacatgcatggagctaaaggtattagaaatatgactgtatacattggtatcattatatatgtagaactttcttttttgcacagatccttagctttgaccatttattctatttttaaagtgtggaatactaaaaaaaaatattatttgaacttaaatatgattactatttgagtatgctatgatgtgaatactttttaaaagaatcttttatcattaaaagtagtcatttagtacagtaggaatttttttacaaaaaaacttataaaataatttaaatttccagaagagtttcaaaggcagtacagagactgaacttttcaggatccttgttctgtgtcttataagttttcatcttcaaaaagcatggaacaaatactaattcagcctaccaacatagcttttgttaaagtaactgctttttaaaataatttttaaatacataaagctaccaaataattagtttcaaatttcataattattttttcttgactatatgcataactgatttaaatagagtcataatccaaattttctcaattatgacatacatttcttcatgtttcattatagtctttttaaatgactaataatagaccatcttgctgatgtatcattattaataaattgttttcttcctgttggacatcttaaggctgttttgttttactgttattaataatatggtaggtgatatatttgtgcatataacttcttgcatttgcctaaattatttcctttagctaattacccagaattagattgggcaataaaaatcatagggcttatgaggaaaatggggttggagtacagcccacaataattttgtcagtgacacatttttaaaaagacagaaaactaataacaagtgcagcacagttttacatatgttaaatggttaagaaatacataattactattatacaagtgacactttttaccttgaacaaaccctgatgtttgcttgtggaagtaggtatggaattgtgatctccaagttaatgtgaagtggtagaaggaggattatctgaaatcagaaggaaagttgtaacattgcatgtgatgggtgtggctcgtaacagaagcacggtgaactgaagtggctggtaacttgagatgtgtgcaggtgtgctttttgtttattcttatgtgacttagttaagctggcagcaattttctgtgttcacttagtgtttctcgcagataaaatcatgcataagcaaaggtgacattctctttatgctcatgtagttctctaataaaccaactgcactgaaacaaatttgcattttcaaaataagtgttatggcagaagagactccactaatttgttatcccatcaattttactgcaattttaacatcgtgctaggtttttaagcttttatatggtaatttttctgatatatttttaaccagatgcctttagaatacagtttggtgcagtcttacagatataactccaaccataataggcagtggagatgttattttaaaataataataaagcttggttaattgcacagagacaagaaaaaatggaggacaggtttcttccaagaatgactgaagccagaatagaggttagagaaaacagaagaagaaaaaaaaaaccctaaaacctgcaaagggagtttgtacctaggtagagcagtaccttgaataccagattaaagtttcaacttccagaaggcaaccaaaagtcagtattttgttgttgttgttgttgctgttgttgttgttgttgttgttgttgttaacaggaaagatgaaagaccagataaggaagaaaggccaaggaggaggacataggaaaagtgtaggttggagatggtatggttaccatccaataagaacagaaaagaaagtataaatgtaagggttttgttagcagtactatttgccttctgattaaatgataaagaagatgtaaaataaatgtttgtctaagattactccaaagtattatcctgagtggctaaagaatagcgatcctagaaaaaaaaaattgatgatcaggaagaagagctgtatgagtgggaggagaaggtattcctgaaatgatgagtttagtttgaaaggaagcctgactgagtggacacagcccctgattgagcattaagaaaatttttgattaattactggtggggccctggacaatagtatacttctctggctttcagttttctcacctgtaaaataagtattgaactactagtgactgctgaagtttcttccagctttgaaacaattgctgtgtgttttttttttatttgaactttattactgtttcttcatgattgctgtctagtgaccttttatgaagactttggtttataatgaaacaaggataaagtgctcagtcttgagtctgttggagattaaactttcctgactcctgaaatgcttgacttgacaccggaagtgccacaactgccatctcactttatcttttttctgccaaaggaagcttcttgcagatcaaaattgggagcaaggagaattggatgtataaagccaaacttggaaaaagcattctgcaatttttcttaatacaatcttttggggctctatttgttattagctgttagaaatcccaataaattatttggaaagaaattcagtacaaatataataatgttatagaagtatatgtatatagtaaatataatctaggagaggcttaccatagaaaaggtgcaggctttggaattagcttgaattcaaatattagttttattactctactagctgtgtaaccttaggtaaacagaaatgaaaagctttattttggaggatgattttatttctttctgtgtaaaatggaaatagtaatactaagtttcagaattgttgtgaggattagagacaatgtttgtaaagaactgagtatacaacctgatacttaataaagagtaacctttatcagttaccaggtaatagttattgttgcagtatgaggacttggttaaaactttttcaaattcttacctgtattaaacacttaacctacattctcctcttgtaatcagaatctcgtgtgcatgtatgtaatgatgggttctctaatattcagttttctggcagattaaaacatctgacaaaactaaagaattattttaaaaatatttagagtgtcaacatattcaattcttagatggaataatgatctttaaagagatgagactagtatgtaaaaagttcatttttaaaagtaagaatcttcatcctaattatctgctagctaagacaaaataatagaatcaacattcttacagattttcgtttacactgcctcctttaaaagatgcccaatactgtggatattaaagagtgattactagtatattatgtatattatatattcagctttccttttgtaaattgattttaaacatttccaagaaatagtttcaaactaggtacttcttaacatctcttatacttttgccttaaataaaaacacattgataatgctaattatatggtaaaactgttaggtctgcagaagtcatattttatttctgaaataataaaaatacattttaaaacagatgcagaaaatgtgaaaggtagattgctgctggaaattcacatagtctttaaggaataaactatgtacgtgttgactatgaacagactagtctatatttactatattaaattttcaccaagttataaagattcagtatgttatccttttggaaatttaaaaaatagtaaaacacattctttttaagagcaggaacaatgtacttgaagcaacaaatttatgactgaagattatatatcagtataatccttgcttctctgattgctgtgtacccttttctgcagccgttttttttttaactcttaaagtctgtgctctattacagtgattctttttcttgtttctaaaagaataaatgaatagttttttgttaataattaatgtaggcctctgcttacctgctttatacattctttacctgcctgtacgtagcacttgcctatgcaagtattcatttactgaaaaagttaccaactttgtagccttgaaatcatttaaaaaatatgttaactgacttgaatactctggttagaagcaaaatgcataccttctacttgaaggaatttgttttcacctttactgaaaaaaatacatatttagttgtattttaaacactacttattttgacatagtaatcactttatagttttctaggaagttcatctttgtatgcattttatatctcctattcttttcttgtaaagattaggttacaattaaaataattcaaagatcattgggaggtactgcattaaactgtgggttggatcttgccttttgtcttgttcaaactgcacctctccttttatttttttcaatctgaagatagtagcatgcttagagcatgaatgtaagccatgtggtggctaagatagagaaggcagagatggatgacttcagaggaagtaagtgtttgacaggagactggactgggtgatggtgtgaaccaaagtcaaggtcacagggagaaaaagagcaggctggcttcatgggtgtgcaacctgtacagttacacaaggctcagcttttttaatgttctgctactgctatgttgaaattcttaatcaatttcacacaagaggccctgaatttttattttgcactgagtctcacaaattatctagcctgttctgcagatgagaaataacaggaagcagaaatttcttgtctttttagttattaattccttttcccagattagccaaaatgggaattattttttaaatgatgacttacggacatttaaaaaaatgtggaaaattaacctaatttgaaagcagttgtgtgtgtatgtatgttatttagtaatttacccaagtattggagaggggaaaaaggagcttgttaaattttcttatggaagtgtcaaaggtggtcaaacttccaatagactttaccaagtcagtatgtaatatacatagtttgagaagtaaaaacaattggtattacagaattgtatgtctgaattacctactacgtgctgggctttacccagaaaagtgtttctttacccataaagcctgatgctttatattcagtacagtactttattatttagtaattattctttcctagtattatttctaaagtggtaattgtttcttgcctttatagtgcttgtaaactttattttttaaagattttggaaattaaaatttagaaatttataagcccattgtggtttttacacagtcctgtcagtttactagttttatttgatagctatctaatacgcacctgtttaaagtggaacgtgtttctattacacctaggctctttttttttttaaaatttaagttctgggatacatctgcagtttgttacataggtatacatgtgtcatggtggtttgttgcacccatcaacccgtcatctacattaggtatttctcctaatgctatcccccacctagcctcccacacctcaacaggccccagtgtgtgatgttccctccctgtgtccatgtgttctcattgttcaactcccacttatgagtgagaacatgcggtgtttggttttctgttcctgcgttagtttgctgagaatgatggtttccaacttcatccatgtccctgcaaaggacatgaactcatcctttttatggctgcatagtattccatggtgtatatgtgccacattttctttatccagtctatcattgatggacatttgaattggttccaagtttttgctattgtgaacagtgctgcagtaaacatacatatgcgtgtgtctttataagtagaatgatttataatcctttgggtatatactcaataatgggattgctgggtcaaatggtatttctagttgtagatccttgaagaattgccacactgtcttccataatggttgaactaatttacactcccaccaacagtgtaaaagcattcttagttctgcacatcctctccagcatctgttgtttcctgactttttaatgatcgccattctaactagcatgatgatatctcattgtggctttgatttgcatttctctaatgaccagtgatgatgagttttttttttttcatatattttttggccgcataaatgtcttcttttgagaagtgtctgttaatatcctttgcccactttttgatggagttgtttttttcttgtaaatttgtttaagttccttgtagattctggatattagccttctgtcagatggataggttgcaaaaatcttctcccattctctcagttgcctgttcactctgatgatagtttcttttgctgtgcagaagctctttagtttaattacattcatttgtcaattttggcttttgttgccattgcttttggtgttttgttcatgaagtgtttgctcatgtctgtgtcctgaatggtattgcctagtttttcttctagagttttttatggttttaggtcttatgtttaagtgtttaatctatcttgagttaatttttgtatgaggtgtaaggaagggttccagtttcagttttctgcatatggctagccagttttcccaacaccatttattaaatagggaatcctttccccattgcttgttttttgtcaggtttgtcaaagatcagatggttgtagatgtgtggtgttatttctgaggcctctgttctgttccattagtctatatgttttgtttttttgtttatttttaacttcttatttatttatttatttattattattataccttaagttttagggtacatgtgcacaatgtgcaggttagttacatatgtatacatgtgccatgctggtgcactgcacccactaactcgtcatctagcattaggtatatctcccaatgctatccctcccccctccccccaccccaccacagtccccagagtgtgatgttccccttcctgtgtccatgtgttctcattcttcaattcccacctatgagtgagaacatgcggtgtttggttttttgttattgcgatagtttactgagaatgatgatttccaatttcatccatgtccctacaaaggacatgacctcatcattttttatggctgcatagtattccatggtgtatatgtgccacattttcttaatccagtctatcattgtaggacatttgggttggttccaagtctttgctattgtgaataatgccgcaataaacatacgtgtgcatgtgtctttatagcagcatgatttatagtcctttgggtatatacacagtaatgggatggctgggtcaaagacaaaaaccacatgattatctcaatagatgcagaaaaggcctttgacaaaattcaacaacacttcatgctaaaaattctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatatgccaacaacagacaaacagagagccaaatcatgagtgaactcccattcacaattgcttcaaagagaataaaatacctaggaatccaacttacaagggatgtgaaggacctcttcaaggagaactacaaaccactggtcaaggaaataaaagaggatacaaacaaatggaagaacattccatgctcatggctaggaagaatcaatatcgtgaaaatggccatactgcccaaggtaatttacagattcaatgccatccccatcaagctaccaatgactttcttcacagaattggaaaaaactactttaaagttcatatggaaccagaaaagagcctgcatcgccaagtcaatcctgagccaaaagaacaaagctggaggcatcacactacctgacttcaaactatactacaaggctacagtaaccaaaacagcatggtactggtaccaaaacagagatatagatcaatggaactgaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctagacattaccattcaagacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaataaatttacaagaaaaaaacatacaaccccatcaaaaagtgggcaaaggacatgaacagacacttctcaaaagaagacatttatgcagccaacaaacacatgaaaaaatgctcatgatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaatggtctatatgttttgataccagtaccatgctgttttggttactgtagccttgtagtatagtttgaagtcaggtagcatgatgccttcagctttgttcttttggcttaggattgtcttggctatacgggctcttttttggttccgtatgaagtttaaagtggttttttctaattctgtgaagagagtcaatggtagcttgatggggataacattcaatttgtaaattaccttgggcagtatggccattttcacgatactgattcttcctatccatgagcatggaatgtttttccatttgtttgtgtcctctcttatttccttgaacagtggtttttagttctccttgaagaggtccttcacatcccttgtaagttgtattcctaagtactttattctctttgtagcagttgtaaatgggagttcactcatgatttggctctgtttgtttattattagtgtataggaatgcttgtgatttttgcacattgattttgtatcctgagactttgctgaagttgcttatcagcttaaggagatttggggctgagacaatgaggttttctaaatatgcaatcatgtcatctgcaaacagagacaatttgacttcccctcttcctatttgaataccttttatttctttctcttgcgtgattgcccaagccagacttccaatactatgttgaataggagtggtgagagagggcatccttgtcttgtgccggttttcaaagggaatgcttctagcttttgcccattcagcatgatattggctgtgggtttgtcataaatggctgttactgttttgagttacgttccatcaatacctagttcctggagagtttttggcatgaacgggtgttgaattttatcaaaagccttttctgcatctattgagataattatgtcgtttttgtcattggttctgtttatgtgatggattatgttgattgatttgcatgtgttgcagcttcatcccaggtatgaagctgacctaatcgtggtggataagctttttgatacactgccggattcagtttgccaatattttattgaggatttttgccccaatgttcatcagggatattggcctgaaattctctttttttgttgtgtatctaccaggttttggtatcaggatgatgctggcctcataaaatgagttagggaggagtccctctttttctgttgttcgagatagtttcagaaggaatggtagcagctcctttttgtacctctggtagaattcagctgtgaatccatctggtcctgggctttttttggttggtaggctattaattactgcctcagtttcagaacttgttattggtctattcagggatttgacatcttcctggtttagtcttgggagggtatatgtgtccaggaatttattcattttttcctagattttctagtttatttgcatagaggtgtttatagtattctctgatggtagtttgtatttctgtgggatcagtggtgatatcccctttatcattttttattgtgtctgtttgattcttctctattagtctggctagcagtctatctattttgttaatcttttcaaaaaaccagcttctggattcattgattattttaaagggtttttcgtgtctctatctttttcagttgtgctctgatcttagttatttcttgtcgtctgctagcttttgaatttgtttgctcttgcttctctagttcttttaattgtgatgcacttattctaaaatcaaccacatagttggaagtaaaacactcctcagcaaatgcaaaagaacggaaatcataacagtatatcagaccacagtgcaatcaaattagaactcaggattaagaaactcactcacaacctcacaactgcatggaaactgaacaacctgctcctgaatgactactgggtaaataattaaattaaggcagaaaaaaataagttctttgataacaatgagaacaaagacacaccataccagaatctctgggacacagttaaagcagctcacgcctgtaatcccagcactttgggaggccgaggcgagtggatcatgaggtcaggagatcgagaccatcctggctaacaaggtgaaaccccgtctctactaaaaatacaaaaaaattagccgggcgcggtggcgggcgcctgtagtcccagctactcgggaggctgatgcaggagaatggcgtgaacctgggaagcggagcttgcagtgagccgagattgcgccactgcagtccgcagtccggcctgggcgacagagcgagactccgtctcaaaaaaaaaaaaaaaaaagcagcattaggagagaaatttatagcactaaatgctataaatttctctcccacaagagaaagcaggaaagaactaaaatcgacaccctaacctaggctctttttctgggtctctttctttctaaagttttgcttattttgtttactgcacaatccaactaaaaccaaattttttacatcatttcatttgagagttaccttttattctaataaactgtggaataactggggttggggagggaattgcttaagttcataaggattcttgcaaacttgaatgtgtcgatacaagattttttttgaaaatttgtaattccatttcacgatctcaaccagaattcattatgtttaaaccacctgatatagactaaaacattttttcaggagcacaattgtaaaaaggatgcagagaaatatttacaacattacttatttctttgcagatttagtgaaagtatgtcctacttttacaaaatatcttattttcctctcttttttacacatataatagagaactaacttttataaactaaatgagaagggaatactaatttttaaattatgatgtcacttgtagaatttgttttaaaattgataaaatacacctctttttttattattatactttaagttctaggctacgtgtgcacaacatgcaggtttgttacatatgtataaatggccatgttggtgtgctgcacccattaactcatcatttacattaggtatatctcctgatgctatccctccccactccctctaccccatgacaggccctggtgtgtgatgttccccttcctgtgtccaagtgttctcattgttcaattcctacctatgagtgagaacatgcggtgtttggttttctgtccttgtgatagtttgctgagaatgatggtgtccagcttcatccatgtccctacagaggacgtcaattcatccttttttatggctgcatagtattccatggtgtatatgtgccacattttcttaatccagcctatcattgatgggataaagcacacctctttaagactgcttatagaatgctatggactcattggcttggttttttatttccttggtttcagtccaaagtgtaataagcttttcagaaagtttctcctggatgtgtaaagaataccaacagatatcagaaagcatctggctgaaagtttaagcagggagtattgttattcatccagcgaaggtggtaaaactctcctgtatcctcgaagtataactaactgagagagagaggccctatataaagccagctgacttaccctgcaattgcttgtctggcaaacagacaatttttaaagactcatatatttaggaatttttaaatgccatagaatcgatggacaaaatgattttcatttatcttaatccaaaatcacaagattgattatatacttaggttatatggaaaatcagcattagaagcattagttctacacctcatttgcatgacattattacaagatattaactgtaaaaatgaagtaaatataatatctgttcaccagatgcctaaaacatacaacattagtatagacatatagaaggatctgcaagcaactaaacaagtagcgtaaatcaaagaatatactgataaagtggtaagtgccttttgggcttcttaggtaataagcccttgtatctgccagaatagtctagcaaaaaatgcatttttttctttagcctagggaaacttttcacaggagatggagttttaggtattgtgtagatgatgggagaaattgcttttgataagcttcagtgaaaaaggaagggaatgtgtcattgcagatagagagggagagaaacactggtagttggtcgtagactggtagtggtgtagaaatagaaagcaaaacctattggacaaaggaactgaacagatttgttaaaaaggaatgagacaaacagatatgaaagataaggagtaagctgatacaggctggtgagctcactgatagcagagtccaccaagaggcatttagtggttttccttcagggcaaaaagtttgaaagagaaaaatatgatctctaaatagggctactcataaaaaatattgactattaagaatatagatacagtctgtatctttaagactgcaatttagtacaatttaattttgtttataggctaaacatttttataatttcatagcgattaacttgataaaaaagggaaaatttcttggtctttctgccaatctgtgtttctaactgaccctaaacagctctgttggtttcctgctcatgcattagagcttgtccatagccacaagcccctcttttcctgtcagccctgcaaagaccgccccttccaaattgccttctcctcttgatggcacatccaagcactagcaaattcggaatcatttttgacttatcgtttccttttaccctttttaatcataggtacaatcttttgcaagttgctttatctctctgaccttagttttttcatatataacatggagttaataaaacaatattgccattttcagaattcaataagttaatgtgtaaaagcacacaacatagtgcatggcacataatagttgagctttaattgtacatgttacttgttttttctatcttctcaactggtaataataactctactgaataggtagtaatttaatgaaaaaaattaaatgcattgtggtgtttgccaaaatttttggtttgtatgtatacactggattacagttttataaatttgtcctcatgaaattgattgtcaggtgttttctctttagttgttttgttaaaaggttaattggagcataacaaatgcatcactatcttatgtagctcctataaaaacataaatactttaaaataaatttgaaaattagaggggctactacatgcaactgattatagttctaattttagttatgaaatttacttctcaactaaggcacaatctctaattctgtatctgcattgatgactcagtgattttagaggttgtgagttgatattttcacatttctacctatggtaactcattacagaatgtctgatcatgatatcctgttctgtgtagcatcatagtggacacttcatgatatttctgctaaaccctttacctgtcataactgtctcctttctgttttgcaaattccctcagcaaagtcaaattcagtcctcacttggttataaatagcattataaaccatatttttgatttaaataaagcacacaaatctcaaagaatgataaaagcattgttcatactttgtaaaacttaatcattgattatagattaaaactgaaacaacatgaagggatcagactcactcacagaaggttattgagaaccaggaatcatagatttcattcaattcaaattatcagttgtacattgttgcttgttcaaaatcattttacaatccactttgcccacctccatcttcttacgttacaaagaactttcatctgctaggcactgctgatggtagaatgccatgcctttaaggtttccctttggaatataaagtctatgttttcaatagaattaactgttcgacagagagagaacaggatttctgtgcaaagatggtacagtgctagtaaaatatatagcccctttactgtctacattaagcaaggatgataccctaagaattctagctgctgctgttgatgctgctgcaactattactactactacttctactaatcacgagtatagaaaaatatctctttgatcctgtgtgtgtggtggtaaggttttgggagaagccattatctatgggtggtggaatcacatatattttaaagtcttttcgaccatgttcgttttctaatttttctcaagtaaaagattcttctatacttttaaaaaaattataatttaaaaaaaaatcttattggacttgtttaaattatcagatatttttcagttatgtaattggtttctggcatacatagacttttatcatttgctctgctttaacataccttcatcagttttataaatacagttcgaaaggattgttctaaatatatataaagggaaaacttcatttgaaagcaaaatctgtatttgggatatttgttgtcttttttgccttctaaagggcaatctagaaacactaatattgattggttattttgtttcataatactttatagctgattcttggcaaaaatggttgatttctctttcattgtaatacaataataaaaaagttactcagaatttctccagtgttttaagagctgtccaggttgacatccaaaaatttaagagagcgttagaacatgggatatctaattgttaattgagactggaattatttctaataatcttagttgtaaatactaatatcttattagtcttcttatctttgctggtataaaaatggttgaaacatttgaaattattttctcagttacagttttgccctgtgtagaagtgtgattatctaagaagtgattttttttcagatttcaaatatgaagtgttgtttaatactaacatatagttacaaagactatcgtgactatttttggtgttcttgattatgatttaatacttcatactttaggaaagacgatttagttctaaatatatttataagtgagttcctaattttttgtgtgctgtagacttctaagctattgatataattgaatgttaagcattttcattttttatggcttactactttaatgcaaagcagaataaaatactaatttatttcttaccctcagatgatgttgtgctgatgtatattttccagtcttgtcataagctcacaattacctacataatggtcttgaaccaaacgattaaatggaagacaacatttctggtcttccattttaattagtgtggtgcaagactattatgtaggtttttgtgtaaaatgtggaatgtgaatcctcaactctttagtcattcttcctattagatattgaagcaaaatttaaaatatgccatttgactaaagatatcaaagtgctttataaagatattacaatgtacctaagtcctgttttagagcaccagagagaaaaatagaagcgcatagaaggaataaattcagttgcacattttgtatttaatccaatgactcaaaaacatgggcacatatttaccaaattaaacgctttcatcaaacatcttcttgatcataccataaaagcccccaaagtttttattggtagcattgctctgattaatgaaatgagcttcagtgcaaaaacttgggctgttagaatacttacaaaaccattattgtccagttctatagctgctaccctagtccctggctctcatctttttatacctggtttaccacatcagcatccatgctgagaaccatgcctcagtcttgcactgctcaaatacatttagtcatgaacttatttattcagcagacctttgaggacctacaatgtgccaacaatttatttaaacaatatttgtatattttccatccccaggctaggacttatagtccccagttggttatcaaatctaaactaaactcagcctaaaaatttagagttctccaaatctcacttattcttgttctttcatgccagtctccttatggtaacattcattcttagcacaatgtgtgtctgttcccacttcttgtcctagtgcatcatctttcctcttcaaggatgtactccttctcctccttaaaattttaaaaatcatagctaaaactaccctgtgaggtgtgaggtttaggttggtgtagtcatctgacttggatcattctttttattctggatcctgagagtatctagaggaaattgcgtattctggttaatgagtggcttatcacatactgtcttaacaacactaagcactctttattcagtaaaagttcacaccataagaaaatatattgtaatgtatttagtgcttcttcggtgatatataaggtgttctacttagaaatttagatttgtaggaatgctggttaatagaagtttctaatatttactgtcttccatatttcctgatgttttgtttattttaagctattttaaatattttgcatttcatatttttaaccaggcagtatctctgttcctcattctgaacacccaatatggtactttgaacataatagggtttcataaagtgcttgattcagtaaaaaaaaaaattgaacatctactatgttccaggcattttgctggatttctggactacaatcatgaaaagacagtctattctctcagcctgcttatagtctagtgggaaagataggttgacagacatccctaatatagtataagttcttgaatacaggtaaatacaagagtatagagtacctagtctcttctaggagtgtcaagcaaacttttttagtagaagcagcctctgcaccaaggagggaattaggaaattttagtgcctgataatctccttcagtctcctaaattataccaaatgaaacaaagtaacagtgtgtgtttgctatgggaatacacctggaagtcaaatatccagcatgcactccctaaagagtgccaccctaaaccttcccatgtaggaatgccagcgccacctctgagaggaagggatggctaaacagaggcaagcagcagacaagagcaggaggattcctgcaaggggaatatgaacaaatacccagtggcaaaaacaaaacaaaacaccaaggggagttggaagaagtcattttccaaggccagaatgtagatttgtttggacggagtggatggggggatataggcacagtctttgagctgcagaagaatgccaggagccaggtcttaaaggattttaaatcagtgattttttaaaacctttattttcttaacagtagaattcttaagaattttaaaattttaactttagctcaatatttaaaaaataaaaacagaactagtttggttttgatgttgtttaaggtttattttgctgtgcgttttggtggggtggtagaagtgttagtttccttggttgcttgcttctctctgtactctactgaggttaggaattgtgttctagagtcacatcatgttactaactggggctttgtgttctgactggtagtagcaataggtttcaccctttgtgattgagtaggctcctaggaatttactttcatctattcaacaaaaatgtgtatacaggttgagcgtcccaaatctgaaatgctccaaaatctgaaacttgttgagtgccaatatgatgctcaaaggaaatgctcagtggaacatttttagatttcagattttcagactagggatgctgaaccagtaagtataatgtacatattcaaaaaaaaatctgatatccaaacacttcttttctcaaggattttggataaggtatgctcatcctgtattcttagtactagtaatgtttctctgagcaaaatagacacaatccctgacctcatggagtttccagtataatgccagagatggatattagaaagtaatcctgtaactataagctgtgagataaatgctgtacagaagaggtcacttacattgagagatctgtaaagaaatgacatttagatagaaacttaagtggagatctgaacaatgagctggtggtagacagtggtgtaggcagaggctgtaacatgcatgaatgccctggggggataaggtttgtggcagcagtaaagccggagagggaggtagaacccagattatggacagccaagttagggatttcgattttatcctcagtgtaatgaaaaaatcatcaaaaggttttgaatagtggaataatataagatgacttgttttattaaaatattaattatactatggctaatgtgtggagatttgctaagagaacaggtagaatgagtgagtatggggacatcagttacaggagtcatattctcatatccgccacatagtgggcactcattcaccattttgtggttagctgaatgatgactagatcactgcctctgttgtaacatctcaaattatttgcactttaaccatgagttaagttggatatttttgaggaatcatgaagtgttgctgatttgtactaatttttcctcataaaactttagatattttgaactgctgcttcatcttgccaagggtgaaaacaaagcatttattcattcattcgagaagtgcttaagctgtgccaggtactggctgagagctgaggatacagactgaatgaataagttaggcatgatatctgccatcaagtggcttgtagtctgggtaaccagagctgagtagagcaggcggtatgttggcctcatacctccgaagtagtatgtctggaattagcctgtctgtagtcccagcctcagtatctggaatatcctaggtgaagatgagatctcttaacaatttaattacattttctcctacctcctctttgttctaatgtatactactaaatttctacttcgatgacctttgctgaaaatacagccactcttaagtcctataacacatgtgcccaggaccggacaacctaaaaattaaatcctgattcttctttactcttagaaaagctgggaccttccttaatggattaaccttctattgctgcgtaacaaatgacaagaaatttagtgatttaaacaacacgtatttattgtctcgtgcttccatgggtcaggagtccaggcactgcttagctggctcctctgcttaaggcagcaatcaaggtaccagccaggctacattctcatatctagctcagggtcctcttccaagatcattcaggttcttgacagaatttgttcccttgtgcttgtaggaaggttgcttctctccacaggcagttcacaatatggctcttcaccttttcacaagtggcagaatagagagagtttactgctttgcctctctgaattcagggaaggcctaactcctcttttaagggttcacctgattacatcaggctctcccaggataatctcctttgataaacacaaatagctgtttgggtaccttaattacatatgcagaatcacttcacatttgccagataacataatcacaacagtaatattccatcatattctcaggtcctacttatactcaagggaaggggatgatagaagaccatggatcattggaggtcagtcatcttagaattgtggccacctcacttgctttttagtaaaaactctcacatcttttagtttccaacaagtgatgcttgtctcagtctcattatatctttgatgacttcttcaccattctttctcttccttcattccgtagatatcgagatttctcaaaacatctcatcaacagtccagcctgtttcttgaccctgtacctcttatttttcattggctgaggaccaattttcttgttctaaaaataaagctaagagcaggcacttttttctccagtcatttgctgaaaaacataaactcatcagataataaaacaaatgctgtttcttgcctgccttgtaccaatttagggagaagcctaggggagagtgactgattttagctccagccactccaggtagggaaaactgtgcatggatgattgggagaaccttacttagatgggggacaggcagttgtgttagtgagttctagcagatgcaccctccatggcatggaggagtattgtccttttatgccagggtaccttagaagagtatcggtgtgggttgtgacttatgagaggggctacacatgcatgggttgggacaaccatgtggtattaatctaccagtggtttcaagttatattgataaaacaaatacattcttacaatttaagtgtagcctttacacctgaattcaaccatctgctatctagcaaaattcagtatcttgcaaacttaaggctgtcaggcgtctgctgctaatttaaggatagcttggtggaatttgcatggagggagcagttctcttttctctttctgaaatgaccttcatctctctttttatctgattggtttatctgttaaaacccagcttaggaaaaaaaaagcttagacattgcctccctgctaaagcctttccatttctagaaacctatctccagtgtccatccttgagaaagtcaatccttcttttctctttgttctctacctggattgaagttgtttctgtcaattaaaactaccatattttattataatttatttacatgcctgtctcctctactagtgagatccttggggatagaaactgatttattaattttcttaactataaagtgcctgacctgtgacaaaagctcaatacatgttttgagtaaatcaatcactgcaccaactcaaatcacagtattccccccctccccgctgatttcaagtgaccacctctgatccccttagacacaaacattgaccctgattaaacctgtgtttgctttgatccatagatacacatttgaactacaggccatcctttctggacggggttttgttactctggcctacagttctttattctttttctccccactgaccagcatgtattaaagtcacaagaccagtctttcaaatagatgttttgaatggggcaaagccttttcatcttgaagccctgtaagtcactccagagagtgtgggaaaagcaaagtgcttggcatagggtacggtagtagcagaggatcttaattatagttcttcacatttgagtgaagttctgaagctatgaagtagaaagtaggaattatcatctcagttaccttagttttgatgtgtggaccaaagaaaatgttcaggaatcttcatattgtgaaatgtgcagtacatgtttaaggttgtagaatattggctctaaggagaattttatattcattcttaaaagagaactaagttagagacagtatcttcagattattgtttccccaaagacccttacctggttttactgttgaattaaacagtaaaattaaactgttgagttaaacagcattaaagatggtgcagtagcatcattagatgcatggccttggaagaacatagctttcatatcagaaatgtacttttcaaaaaatctatatttccttttaaataattttataatctcagctttcattttagagttgggggtacatgtgtaggtttgctatgtggatatattgtgtgatgctaaggttttgggtgcaaatgatcctgtcactcaaatactgagcatagtgcccaataggtacctttccagcccttactccttttcttttgttcccccctttggttgtccccagtgtctgttccaatctttatgtctatgtgtgcccaatgcttagctcccacttagaagtaaaaacatgtagtatttggttttctgtgccagtgttaatttgcttaggatgacagactccagctgcatccatgctgccgcaaaggacatgatttcattctttttaatggctgcgtagcatttcatggtgtgtgtgtatatatatatacatgtatatatataaatgtatatataaatgtactttttcatgtgagaattcttccaataaaatattgatgactgtggcataggagtgtaaaattagaagtgcttcatatggatacaatgcctacatttcagaaatcttcatgcagctcttctggaatgtgggcaaattagtctcccggttttctctatggtcaaccattttctattatactcaccttgtcagaagatatttaatttaccacaattaactaaaagcttttgtttaaaaagtatgtcttatggaaaacagaacagaggtgactaattttttgtgtgcagtaaatgtttttaagtaagcatttctacaaccaggtgaaggaaatgattaagtagaaattgggacttgcatgtaattttttaaaagattgtgaaacttgttaatattatgcatgtatccaacttcttttctattttcaaattattccagtaacaaaggtttatgcaataggtatactcccaaaaggttgtgttactatataatgcaaatgcatgaggatcagtgtttaagcaattagtcaaaacctctaatttacctcttcccaaacataatgtattatctcttgagttatctataagcggctagttgtaggaaaaaatgagaaaagctggctatatagcaagtttgttcatccagaaaacttcagggtttttagtttgaaaccttcatgagaaatttttaaatagttaaaagcaactgtaattgtagctacttgttatcagttgttcttcaggcctagttcttaaaagagaaattttaggagtatgctactctaatttcagcagataatcatttaagatgctgtcatgatagaaaacgactccagaataataaggatagtttatatgtttcttagagattctgtaatgatcaatttttagaaagtatacttcatacaaagccaaatatttgcttttgtttttttgttgttgttgtttttcttttgtttggttgatttcagccaaccccatttaccccattatactcaattttaatttaattgttttggaaaatgttcttccatttcattacaacattttacgttttctctaatatgtgtttacgtaaattcactttgaagaaatgcatttataccatcagctttatggagttattgcaaaccaatgccatcatcagtgagactataaatttttttttgcagactagtcttttcatcatgactttgcataacattgttccagctagatcaacaaattgattattatattttactatatcatgaataatgcccagaggcttagtaatatgagtgaaacttactggggatgatattttatttaagctgctatatttaaatggtgctgcaatttaggtattccattgaatctacatatagtgcatacttgacatagttaagaaaaggttttgttacttttcttatattgaatatttgagtaatacacagttctgttgtacgttaggatttgagtcccttatgtacaaaaatatttactaccttctttgtttcatttcagaatgaccttatttaaaagtgtatgaggctatttataatcaactctgtggaagtgattaaagaggtgtgaataataggttattggaacttgacagctcatagtttgctaaactagtgttagaacatttatgctgctcagatgtaccttattttccttaagtgagaatttctgttttgacatgtggtttgttgatataatatattgcataggtttttctcttttaagtggtttaccaaatcttgatattttattgccttattttacattttcagcttaatcaacattttatgcttaataagaataaccttggtacaggctataaacaaaacagtcagtatagacagagtacggtccttaagtggagcatcagccttccatttcaagctatcctataaaataaatacaatcaaattttttttaaatgggaaaaaaactcttttcttacagaaaatttgaaaacatttggtaggttaacattcagcagttgttactctgggaggaatgttagaactcctgaagaaatttgggatagccaatatatccataaaaagaagaggtgtgtatttggtatttcattaaatctttactaattttaaatacaaagaccagaaaaccacgaatttgaatcaattgaatttgagttagacagcctttttatttgagaataaaaagaaatctaggaaagcatttttaaaattttgaaaccattacttaatgagtttccactgttctcatggattcagagcattgtcatttggtagtactctcaagtattctcaagatttactaaaatgcattttaataatcgcaattcagttttccctaaccagccaggaggtaatgtttctaaaaagaacgtggttgggaaaactgtggcagagaaaatcaggcctcatagacaacaaaggttagagaaataaaagtaaaaattactgtgtatatattctacaataaacctgagaaattctttataaaaaaatccaaaattaaccacatttctcaacatgaaaaacttcctagactaattcatcactggacccatttactcagttgtgattttagcattagtcacccacaaattttgaattatgtaaattacacccattttaaagtttttgaactatctggcttgaaacctaatttttctcttgatttcctcttgtcttatttttcaagtctgagaaattattgtgcagcagtctatattttggtggaacttaagggtatatttttctagacctgacttcatttattaaaaagttggagtacaagtgtttatgaaaggatggtataattgtttgaaagtatcagttgtatatgcatacatataaatagcccaaatgttttataaaaatgaagtgtgatgatatattcaaagaacgctgcaataatttatttttggagtaccatggtactttggagagaactctagagacctgtttttaatccttttcttctaattactctctgtgtgaatttgaatagtttgcttagctttactaagcttcctatatcttttccttaaaaagtgatgataataccaactctaccaatgttacagtatgttgttctgaggatgttctggttaaagtgctttgtaacttgtgaattgcaagggaattgtaagatttgccaatgttgcacttgttgccaatctgaagattcaagctataagttgaatacaaagtatgtgacctagagaaaacattactctgccccctaccctcatcccacccccatgactcaggttgacagctattcttagttaagagatacttggggaaaagaggacagtttagagaacttcctgtaggtattcattgactcgtagttccttttggccttctcagacacttttcttaaaagacagttttatatcggtaacctcactctaaagtctgtagaataatagcacattctgattatagagtcagtctaactttataacgctagagtagtacagagaactctcatgttgtttaggttttccaactggggacatcctgtgatctgactgttcctagtgcacaagctaatcccacccatatcctgtttgtgagtaattggatggatgcctggaaaatctagtgccagattgtatagtgcctttacaacagaaatctctagtttgaattgatttaccctctacctaaacaaacacctctcataggtgagcctctactctaaaaaggcaagattatataacatagatccctagttcttgtttccatagtcatgctttggatggtactcccattgatctggatcagagacatatgtaaaatacaatttcagggtgttgtttttctgtataactgaagcagtagattttgaattgtatacctcttcccatgaatatagaagacagctttgtaggaaaaaatttcttcttaaatcatcttttttatctaaattattaagaataggaaaataccatttgcatcattgtagtctctcttacttcttgggttctctttacaagatatcaaaatatgtttaaaaaaaaaacccggatgcatataggtgtgtgcaagcttgtcgtaattcaaaaaaaaaatccattgttaaatttcaaagacgtgtaatagtgctagcatttactacagcattgtgataaagggcacaagctctagagtcagtatcctggatataaatgctaaatccaccacttactgaagaattctaccaggcatggcaaaaataaaacctttcttctaattgccatattcttagccataatttgtgaattattcaaaattaataatttgttttggaaccccaactcagtaggtataagccgaaaaagggaaggactgaaaagtatgaaaagtgatagcttcagtgagccctggttgataccagggctcaaattatattatgactcactctctttctctccccccacctcccttgtatttcttcctccctttcctctgtctgagacatagggcttgaactgattgctttaaaaggcaatgaatcttggccaggcgcggtggctcaacgcctgtaatcccagcactttgggaggccaaggcgggtggatcacgaggtcaggagatccagaccatcctggctaacatggtgaaaccccatctctactaaaaatacaaacaaaaaaaattagccgggcgtggtggcgggcgcctgtagtcccagctactcgagaggctgaggcaggagaatggcatgaacccaggaggtggagcttgcagtgagccgagattgcgccactgcactccagcctgggcaactgagcaagactccatctcaaaaaaaaaaaaaaggcaatgaatctctaatggttgattgtatttctgtggggtcagtggtaatatcccccttgttgttgtttctgattgtgtttatttgaatttttggtctttgtctagctagcagtctgtttcattaatttttttcaaaaaaactagctcctggattcgttgatcttttgaatgttttttcttgtctctgtctccttcagttcagctctgattttggttatttcttgtcttttgctagctttgggatttgtgtgctcttgattatctagttattttagttgtgatgtcaggttgttaactcgagatctatcttttcgatgtgggcatttggtgctataaatctccctcttaacactgccttagctgtgtcccagagattctggtacattgtctctttgttcccattagttttaaagaacttttttattatgtccttaatttcattatttacccaaaagtcattcaggagtaggttattcagtttccatgtaattgtatgagtgagtgaatttcttagtcttgattttgaatttgattgcactgtggtccaagagactgttaagatttcagttcttttacagttgctgaggagggttttacttccaattatgtgagcagttttagagagaaagtgccatgtggcaatgaaaagaatgtacattctgttgtttttgggtggagagttctgtaaatatctatcaggtccatttgatccagtgctgagttcaggtcctgaatatctttgttaattttctgtctcagtgatctcatattgtgagtagagtgttaagtttcccactattactgtatgagagtctcagtctctttgaaggtctcttaagaagttactttatgaatctgggtgctcctgtgttgggcacatacatatttaggatagtttgatcttgttgaatgtaaacctttaccattgtataatgcccttctttgccttttttaaaatctttgtttggtttaaagtctgttttgtcagaaactagaattgcaacccctgctttttgttttgttttgttttccgttagcttggtagattttcctcattccctttattttgagcctatgtgtgtcactgcatgtgagatggatctcttgaatacagcataccattggatcttggttttttatccagtttgccatcctgtgtcttttaattggggcattgagcccatttacatttaaggttaatagtgatatgtgtggatttgatgctgtcataatgatgttagctagttactttgcagacttgtttatgtggttgactttatagtgccactggtctgtgtacttcagtatggttttgtaggatctggtaacggtctttcctttccctatttaatgtttcctttaggagctcttgtaaggcagatgtggtggtaacaaattcagcatttgcttgtctgaaaaggatcttgtttttccttcacttatgaagcttagtttggctaactatgaaattctgggttagaatttatttaagaatgttgaatattgactcccaatctcttctggcttgtagggtttcggaggccattatccttagcaaactaacacaggcatactgcatgttctcacatgttaagtaggaactaaatgatgagaacacatgggcacacagaggggaacaacagacactggggcttaccagtggtggagggtggaaggagaggatcagaagaaataactaatgggtactgggcctaatacctgtgtgatgaaataatctgcacaacaaaccctcatgacacaagtttaactatgtaacaaacctgcacttgtacccctgaatttaaaagttaaaaaaaaaaaaaagccagtgaatctgttgtgaatacttacaggcagaactttttttttttttttttttttttttttgagacgaagtctcactcttgtcccccaggctggagtgcaatggcataatctcggctcactgtaacctccacctcctgggttcaagcgattctcctgcctcagcctcctgagtagctgggattacagcctgccaccatgcctggctaatttttgtatttctagcagagacagggtttcaccatgttggacaggctggtctcgaactcctgacgtcaggtgatccacccgccttggcctcccaaagtgctgagattacaggcgtgagccaccacgcccagccataggcagaacttttacttgagggaaggattgatataagattctgacattctgttttttatgttctttgtatataattgcatatgattttgaaatataaatcttttgaatttcttattaaacttgtaaatgatgtttgtaatcgtaggcaatttaagatttcgtactagttaaggtatagactgttagaatgaattcagggtaaactgtgtgtgtttgtgtactggggaaactgtgtagtggtagcttatagggtcatctgttaattagttactgagataggcagtttatataaattgctcattcagtccttaaaaaatcttataagtagttattattctcccattatatgtgaggaaaatacaagaaactgcttccttttgcaaaccaaacactgcctttaaacttagcatcttagactgccactacctgcagacatgactagaacttattaaatattgtcttttttcagtttaatagttacttagtaatatggcctttatctaaatttcctaattttgccatgttaaaatgtaatcctatttgaactatgaactttgaatttactttaataaaaataatttctaccactgctaatacaatgtaaaatttttaagcttagcttaagattaatgttactttggaaataaattgctacacatttacacacataatttatataggaaataaatcagtctatggaaatatatttagattataagcctttttagctacagaaacaaaattgtttagaatgaacttacatagcaagacaaaattgaaaacagaggctttagaagctagtgtaatataaagtttacaatttacaaaaattacttcatttaaatagcagttatttttacttactttcattgaagaaataaaatcctatgattcaacttacagtatacagtctttttgcatggagggatgattttgtaaggcccaaatcagtactgcttaaatcagtacaaagagtgtatttgttttatggatcatgtttctggttttttcacccagaataaaactttaaaaggaaaaattttcttctgtttccaaaaggaactattggggtatgtggaggggttgatccacaaccctaaactggcagagagcttgggtgtatatataagcagctaatctctcacctagttccaggtacatatctttgttgttgaccagaaaagtgcctgaccagaagtccacatacctctcctgttattttccttcctataaatgtggccttgcctgccagggagcattgccttaaactaaactggaaataagaagcagcattcattatactatacacttgatcttagccaaaaggccaagaagcaatcattcattatactataaatctctattgtatgaggagtaatagagggcagatatatcactacaggacatgcctagtatttttacatcccagagtatgttgcagggatcctagtatgtaaaaatctcagaagcataaacaaaatttattttaaattttagttttaataagcttttttaaactccgcatcctacttttagtgggatataagggttattaaatcacacttcaaaaagttagaaaccctacaaaggccatacagaaaataaaatcctctgaacctaggtgctactaattcactcaagataaatttaatcattttattatttatggatataatctaatggaataattttaatactttaatgaaaacattactttcaatcagatgtacagaactcacaggaaaacttgaaaattcttaattataactgtaagacctacgtagtataactaacagataaaaggattgtctttaaatctttatgaaaacgtgaaatgaagcaacataaacattaattcattgacaaaacagtttattttaaacacgtaagaacagaaaaggtggagacttggtggttgtaaatttggacaggaatatattgaaatatcatgtgtatgtggatacagatatcagtattctggttactgccctcaaaaagcatatgttctttttaaggagttaacaaagatatgataaaatactgaaagaataataccagtgatacttagtaagtgctaataactaccttcagaatatagtatagaccaacactgtccggtagaactttcttggatgaaagaaatgttctctattttatctaatagccactggctacctgtggttatttgagcacttgaaatgtatgctgtatgaatgaggaatttaattttatattttatttagaaatttaattaactaatttaaggatagacatggtggctcacacctgtaatcctagcagtttgggaggccaaggcaggtggattgcttaagcccaggagtttgagactagccttggcaatatggcaaaaccctgtctctacagaaaatttaaaaattagccaggtgtggtactgtgtgcctgtggtcccagctactcaggaggctgaggaaggaggatgtcttgagcctggaaggttgaggctgcaatgagctgtgatcatgccactgcactccagcgtgagcaacagagcgcaataccctgtctcaatttttttttaattcagtgtgaatagatacatttgattagtggctaaccttattaaattctacaattctcaaaagatgcttgtctcaggaacccttcatttaaaagtgatttacggccccagagtgcttttgactatgtgggttatatttactgatatttacagcattaaaaatagaaaaattttaaatatttattcattcttaaagttactacatgttaacataaaatatctttgaggaaaagctatttttaaaaaagagtggcattgttttacatgtttacaaatctctttaatgtgtgggttaatagaaggcagttgaattctcatatctgcttctatattctagctgttgcaatgtgttgaactgtattaaaacctaacctcacatagatagttagttggaattagcctttttagataattgtggatattctttgattaccaaaactcaccaagtagcagtttcttaaagtttagttgtgatgtaaaatataaaaccatatcaatgaattttatagttacattaaaaaatcactgctctcttgaactttgagtgggccttttacccacttactaatttgcaacatcatgcattagttatttggaagatattggttcactgaattgtccagatcttccaaatgttgacacattccattttacccaatcaaaaaatcactaatagcagcaccaatctcttcagaagggtcttcaaaattaggaaattgcaaaattcaactcagctgcagttaacatgttttccaaaattctcatttacatctgaaagctcaaattttattggcaacaaatttggccaatttgtcttcctttaaatgacaggcttatttggcttatttttgagaaaatatctgccaaatactcaaacctgaataaccattgtttgtcagttggttattctttcaagttaaatagatgtaccatgaaaaaagcagctacttcggtagcaacttaattccaggagtgattttccataagacatctgttatactttgatgtccagcagaagtgttttgtgtatacatcccattttgttgtacagaacactaaaaagacatacactacagggtcaaaacttattaaagtaatttttactacttcatcaaggatgtacttaagtgaaactggcaaattttttaactggaaatgagtggcagtgagggctacaaggatatagtttgctgctgctgccttggtaagtgctaagatgccaacagtttgacctaccattgtctttgtatcatcagtgcaaatgccaaagaagtgaaaagggcaagtactgccttagtattattataaaaatggttttgaccttgctgaaaagacaataatggaggaaagaaattgcttttagttcaaataagttaaagaagactccatgataaagatcaatgtaatatgcatgccctactttatttttctttacctgcttttttctataaaaataaaagtaggaaagcaattagcatgttaaaaattatttaaccatgttacttttaaaatcattctttgattcagcaattatttattaactattttgcataagttatttttgttgttgataagtgggcaatatgtaatgtttagaataatgatcatgccaataaagcatctgtgcccccactataaagcactgctatgtgctgggcactgtgtttatgtgcttttaaatgcattcacggaatcttcatggtaaccttaggaggtaggttttatagaaagttaactggaattagtgccagctcacaatttttatataactagataaattacttaacttatttggatttcagttttctcaagtataaaatacgaagctgagacatatcttcagatgcttaaccaggcttaaaattcattaaataaacatatatttcacagcaggataaccctttattgacacattatcagaatactctgaattttattaggaagccataaaaacaattaccaaatcattaacataaactttttgaaactttatgtccctttcattttaaaattcgttgagtcaatacatttttcataacacttaatcctttactgacacatgatcagaacactgaacacttgaccaaagacctaatgatagatgtgaacataatgtaaacatgaagggatatagtcactattgtagcggaataaaaaataatacaaaagcgcaaagaacaagagtcaggaaaggtcaagaagagcatcaataaagcagcagtgttttagtttgttcattagttcaacagatgtcttatatgcctttgttatgccctgtaaagcttggaatttagactactggagggaacaaaatgatgtccttgccctcatggagcttacattttagtgggggagtgtggtaggtaggatagtggcctcccaaatatgtccatgtcctaatccctaaaacctgtgaatatgttacattacttaaaaaaagattattaagtagcaaaggaatagggagattacttcgggttatgtggctaggcaaaatgcaatgttaaaagtggaagctggagtttgaagaagggtcagtggcagaatgatgcgacatgagaaagtttcaactggccatttctggctttgaagatggaaggggccatgtgccaaggaatgcagcagcctctacaagctggaaaaggcaggaaagtggattctcccctagagtctccagaaagaacacagttctgccaacatcttgattttagtccagtgagacccatattgggcatctaattgtgaaataataaatgtatgctattttaagcctcttagggatatgtcagtttgttacatcaacaatagaaaactaatacagagtaaaagaaagtaaacaagtaactaaacaagataattacaaactacgatggatgctttgaaggaaataggatgatgtgaaagagtaaaggataaagcatgttggtttaggtgatcatggaagtcttctttggaactatgacactggagtggaaaagaaagacccagctgtgtggagttggaaacagaatctcaggccaagggaaaggcaagtgtaggggcatggagtagagaaggcttgccatttacaaagaacaaaaacaggtcatttagcgagaatgaatagaatagtggaaaaggtgcaggcccaaaaatgtggagccttgcaggaatgatggaacaatggaaagccattgaaaggttttaagaaggagagtgatacattttgctttacatttttgaaagatcaccccggctgctgtgtggtaaatggaaacaagggaccaatgacatggtattgtagtcctgaggaggaagtttacaggcggaagcaaactagtggcattggtgcctggagaggattgttgatgatagacgggatatgagttccaaaagatgagtaggaatttgcccctagagaagaggaagaatacatagcagaagcatgaaagttcaggatgtctgggaaattgaatatactttgcagaacagtagcaagtgaagatgaagagattgtttaagcgataatgtatgcagtcgggagacccttattcgccatgtatgggagtttggaatttatggcatatgcaatggagagccatctgaaatttcgaatcaagagaacaaaacaatctcttgacctgaagttttgtgattattatgtatgtccttcattttcattctgaagtaaaggagaataataagggtgctttaagttttatcatcttagattctgagaagttcagaaagatttgattaagtacttgtcaatgaagtctttaataattcattgggaaccacacttttattctgttttgtttttttgtaaggacttttttttcatttatgggctctactcttctgctgtctttggagagacagcacagtaacctgttcagagcatgtccggagccacatggcctagggtacagtcctggttaccagtactaactggtcaacctttggcaagttatgtaatctaagtcttagtttcattgtctataaaataaggataataaaaattcttcaagtggcttctgtaaggattaatggattcagtgcatataaagcactgaatatgtaataagcactttgtggatcagggttgaagcagggtgcagaagtatacgaggagcattggttgtaagcttttctatatatcagtagtagaaatgtgacaggtcataatttctttaaagtacgtttaaaatacctatttcccacttcatttttatatatggtattaaattttctatttgtttgtgttttccaagaatgtccacttctttcatcacaaagcccacttattctccaaaaagtttatataagaaaatgggtagttagtttgcatgatcttctgctttattggatattatttattttctggaataagttatgtccacagatgattttaattcacactgctactcaggtaacttaggtaaaacaaaacatcaggattttttggtactacagttcaaatttatttaacttcccaacaatatattttaaataacaaagaaacaaaatactcaattttacctctgttgcacattagcaaggcataaaagagagattaatataattaggtaaggattcttatagtatttattttctgcatcacttttaatttagcatttaattatgtactatgacatttctctatataatacttcatgtatattactcatatttgcaaagattacgtatatctcagaggtggagactagatattaaatgtcttcattctcctatcttctgaagcacttaagtcagaggaactaaattattcattctaatttgacaactcaagcttgtaacatattataatgcttagaaaagctcagtaaaactaaactctagttacctataaattgtttgtttttaatacttcatcaggaaataaattccaattaaaatttcattaattatcccccttgttctttcatgtctttccaatgaaggagtagaaagactttctttacaaaactaggctcagggaattagtgtcccatgttgaaatttggctctcaggaaagctcccagaaaggaagtctcctagttggcaaccaataagccttacttagattactatatgttgtcattcccatggaagtaagggaggatccgtcctcaaactacatccttggggttcatgatctttttcttttcacttttcctatgatttctcttcccatggtcaggagttttaaattacacatacagcattactagtttgaaggaatcttggagaaccaaataaaatgaattagaatgtaattcttgtcctcttccttcatcttatttttcacaaccagttctgctactaatcgataagcctcaaagccaatcaaaggagaattaccttctgggattagtaaatgtcaaaatatttcttaaaattttttcataagatgagaaaagctgaaaatcatgccaactcctgtggttgaaactatttaaataattgactgtgtgtttgggtgtatgtgagatactataacctgtactttggggatgctcattgcccttgacaagtgaaagcgtgcgctctccacgaggcctccctcctggcgtctgtgcagtaagagagcagcttccctcagcactagctggaaggagaagtcacttgtgctggtgttcagcaagtattaccttccttttcattttatataatgttatgtagccatgaataggaaaggtaaatgtttttcatactttaaatagactactatctttcaaaaataagaaaatagatcttattattgtctcataaaaccataaaataaaaattgttttatttcaaaatccacagatatttatttacaacatagtattcatcaactaataaatgtcctttttacctttcattattctttagattttatttcagtatcctgattagtgtttttaattatacctcctattcaccgtgataacaaattcaaataacataaaaatgttaaggaagagagctgggtgcagtggcacataccagtaatcctaacactttggaaggccaagccggaggattgcttgaggccaggggctcaagaccaccataggcaacatagtgagaccctgtctctataaaaaaaaaattttctttaaattacctgggtgtggtggcacaggcctttagtcccagctacttgacagactaaggcacagaggatcgcttgagcctagcagtacacaggtgcagtgagctacgatcatgccactgcgctccagcctgggtgacagagtgagacctcgtgtctaaaatatacatacatctatagaaatatacacatatacatacgtacatacatgcatacatagagagccagcaaatattttgcccaatcccagttcagttttctaaagtttgccactagcaacattatgctgaaaattatttggctttttctttgcacatttaaaatatatctttaaaatttttttaaagtaatataaacattaaaataatatcaaaggaataagccagaaaaacaagtcactcctttggtacctgatttcctcatttgtatgtcctagacatcatgaattgatgttaaggcacatgtatagtatggatactatactgcatctactgtattttctggaaggatggaatcaaactattttggaagactttctatatcagtaccaaacaatatatcttagatgactattaaggtttttttgtaattaaaaacaagttttcagataaacatatgtatgcatatttgcatacatgtgttaatttgcacggtgccaagaaattgttagatcaacaggtcggcattttaaattttgataaatattgccaaagtaacacagcatataagagtgtactcttttatttaaaccttgcatatgtcaggcgttactgggacttttttgccgatttactaaacatcatttatctagggattagtatctacagccagtgttctagatgaggggaacagtggtgatcgaaacagaaaaaattcctgtctgaatggaacttgcattgtagtgtagtagataatcaatcaataagatattatagtgacaagtatttttaaaagaaataaattgagggagaatagggagtgcaatgggggtgggggtggtatttaaatagagcagtcataggagacctccctgaggaggtggaattgggcagttcataaagaatattacaggtagagtgatatgaagcaagaggccagtatacctggaatgcagtgagccggggtaaagtagaagacaaagtctgagagagacaggtgaggagagtcagcccatggagggccttggattacagtgaataggatgggaagtcattagatggtttgacaagattccactgatgctttagaaggttttgtctgctgtgttgagaactgactacaggaagacaaaggtggcagcacggagaccagataggaaccagtgacagtactcgaagtgagagatgatggtaccatcaggtagttagtggcagggaattggtagtgggtggtcagatcttgaatatatttttataggtatttccttccagagtagatgcatgggatatgagagaaaaagaggagtcaaaactatcactgagacttttggcctgaacaactggaggaatggaattgccgtttactgaaatagagaagactgagagaccaggaattgtatttggctatggtaaaaaatttcccattagaaatccaagtggtgatatcaccaaagacaaaagccacatgattatctcaatagatgcagaaaaggcctttgacaaaattcaacagcccttcatgctaaaaactctcaataaattaggtattgatgggacgtatctcaaaataataagagctatttatgacaaatccacaaccaatatcatactgaatgggcaaaaattgggagcattccctttgaaaactggcgcaagacaggggtgccctttctcaccactcctattcaacatattgttggaaattctggccaggacaatcaggcaggagaaggaaataaagtgtattcagttaggaaaagagggagtcaaattgtccctgtttgcagatgacatgattgtatatttagaaaaccccattgtctcagcccaaaatctccttaagctgataagcaacttcagcaaagtctcaggatacaaaatctatgggcaaaatcacaagcattcttatacaccaataacagacaaacagaaagccaaatcatgagtgaacccccattcacaattgcttcaaagagaataaaatacctagaaatccaacttacaagggacgtgaaggacctcttcaaggagaactacaaaccactggtcaaggaaataaaagaggatacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacattgccaagacaatcctaagccaaaagaacaaagctggaggcatcacactacctgacttcaaactatactacaaggcaacagtaaccaaaacagcatggtactggtaccaaaacagagatatagaccaatggaacagaacagaggcctcagaaataatgccacacatctacaaccatctgatgtttgacaaacctgacaaaaagaagaaatggggaaagaatttcctgtttaataaatggtgctgggaaaactgactagccatatgtggaaagctgaaactggatcctttccttacacctgatacaaaaattaattcaagatggattaaagattgaaatgttagacctgaaaccataaaaaccctagaagaaaacctaggcaataccattcaggacataggcacgggcaaggacttcatgtctaaaacagcaaaagcaatggcaacaaaagccaaaattgacaaatgggatctaattaaactaaagagcttctgcacagcaaaagaaactaccatcagagtgaacaggcaacctacagaatgggaaaaaatttttgcaatctacacatttgacaaagggctaatatccagaatctacaatgaactcaaacaaatttacaagaaaaaaacaaccccatcaaaaagtaggtgaaggatatgaacagacacttctcaaaagaagacatttatttatgcaaccaaaagacacatgaaaaaatgctcattatcactggccatcagagaaatgcaaatcaaaaccacaatgagataccatttcacaccagttagaatggcaatcattaaaaagtcaggaaacaacaggtactggagaggatgtggagaaataggaacacttttacactgttggtgggactgtaaactagttcaaccattgtggaagacagtgtggcgattcctcaaggatctagaactagaaataccatttgacccagccatcccattactgggtatatacccaaaggattataaatcatgctgctataaagacacatgcacatgtatgttgattgcggcactattcacgatagcaaagacttggaaccaacccaaatgtccatcagtgatagactggtttaagaaaaggtggcacatatacaccatggaatactatgcagccataagaaatgatgagttcatgtcctttgtagggacatggatgaagctggaaaccatcattctcagcaaactatcgcaaggacaaaaaaccaaacactgtacgttctcactcttaggtgggaattgaacaatgagaacacttggacacagggtggggaacatcacacaccggggtctgtcgtggcatgggggtaggggggagggatagcgttaggagatacacctaatgtaaatgacaagttaatgggtgcagcataccaacatggcacatgtatacatatgtaacaaagttgcacgttgtgcacatgtaccctagaacttaaaagtataataataataataaaaaaaaaagaaatccaagtggagctatcaagtagataatttgggattcataggagaagtcacctgggatataaaactgggagtcaacaaatggcatttagagccatgaaacagattgaggaagtggaggaaagaaacgaaaaagaagcagttggtgagttaagaggaaactgatagagtcaagagaagagattgttttgaaaaggagagagtaatgaattatgtcaaatgctgctaaaagatcaagtcaaatgaggactgataattgtcattgcatttagcagtgctcacagtcatgacaagaacagtgttggtggagtgttgtaattggagtaatttaagataaaataggaagaaacaaattagagacacatgtaggcaacttttccaaaaagctttgaagtatagagggactgagatatagaattaggagtgctggagtttaatcaaggtaagagattagccagcatagagattttgaagccagagagagcaagaaagttgagagtgtacgtgagaagtgattataaaaatataagattaaaatggatatttcttctgttactgaggttgagcatctttttacatgtttattgggcattcatttttgtgtgtgcgaattgcttgtgcatattcttactgggtggttcatcttatgagtgtttaagaattctctgtaaaataaagatgtcagcctttagtcatatgtgttgcacatatttttcacaatttgtcgtttgtcttttgacttgatttttttctgtgtatagttatgggtttcatttcatgcttataatggccttcttattccaggtttgtaaaaggatttgcctatattttcttcttttttttttttattatactttaagttttagggtacatgtgcacattgtgcaggttagttacatacgtatacatgtgccatgctggtgcgctgcacccactaactcgtcatctagcattaggtatatctcccaatgctatccctcccccctccccccaccccacaacagtccccagagtgtgatattccccttcctgtgtccatgtgctctcattgttcaattcccacctatgagtgagaatatgcggtgtttggttttttgttcttgcgatagtttactgagaatgatgatttccaatttcatccatgtccttacaaaggacatgaactcatcattttttatcgctgcatagtattccatggtgtatatgtgccaccttttcttaatccagtctatcattgttggacatttgggttggctccaagtctttgctatcgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgactgccattctaactggtgtgagatggtatctcatagtggttttgatttgcatttctctgatggctagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaatgagatcccatttgtcaattttgtcttctgttgccattgcttttggtgttttagacatgaagtccttgcccatgcctatgtcctgaatggtaatgcctaggttttcttctagggtttttatggttttaggtctaaagtttaaatctttaatccatcttgaattgatttttgtataaggtgtaaggaagggatccagtttcagctttctacatatggctagccagttttcccagcaccatttgttaaatagggaatcctttccccattgcttgtttttctcaggtttgtcaaagatcagatagtcgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggttcttttttggttccatatgaactttaaagtagtttttttccaattctgtgaagaaagtcattggtagcttgatggggatggcattgaatctgtaaattaccttgggcagtatggccattttcgcgatattgattcttcctatccatgagcatggaatgttcttccatttgtttgtatcctcttttatttccttgaccagtggtttgtagttctccttgaagaggtccttcacgtcccttgtaagttggattcctaggtattttattctctttgaagcaattgtgaatgggagttcactcatgatttggctttctgtttgtctgttgttggtgtataagaatgcttgtgatttttgtacattgattttgtatcctgagactttgctgaagttgcttatcagcttaaggagattttgggctgagacaatggggttttctagatatacaatcatgttgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtctgtcatagatagctcttattattttgaagtacgtcccattaatacctaatttattgagagtttttagcatgaagtgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcgaggaatgtatccatctctcctagattttctagtttatttgcatagagctgtttgtagtattctctgatggtagtttgtatttctgtgggatcggtggtgatatcccctttatcattttttattgcgtctatttgattcttctctctttttttattagtcttgctagtggtctatcaattttgttgatcctttcaaaaaaccagctcctggattcattgattttttgaagggttttttgtctctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaatatctttatttctgccttcatttcgttaggtacccagtagtcattcaggagcaggttgttcagtttccatgtagttgagcagctttgagtgagattcttaatcctgagttctagtttgattgcactgtggtctgagagatagtttgttacaatttctgttcttttacatttgctgaggagagctttacttccaagtatgtggtcaattttggaataggtgtggtgtggtgctgaaaaaaatgtatattcttttgatttggggtggagagttctgtagatgtctattaggtctgcttggttcagagctgagttcaattccctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttattggtttaaaggctgttttatcagagactaggattgcaacccctgccttttttaattttccatttgcttggtagatcttcctccatccttttattttgagcctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagcaggtgattttgctcgttagttcatgcagtttcttcctagtctcgatggtctttacattttggcatgattttgcagcggctggtaccggttgttcctttccatgtttagtgcttccttcaggagctcttttagggcaggcctgctggtgacaaaatctctcagcatttgcttgtgtgtaaaggattttatttctccttcacttatgaagcttagtttggctggatatgaaattctgggttgaaaattcttttctttaagaatgttgaatattggcccccactcttctggcttgtagggtttctgccgagagatcagctgttagtctgatgggcttccctttgagggtaacccgacctttctctctggctgcccttaacatttcttccttcatttcaactttggtgaatctgacaattatgtgtcttggagttgctcttcttgaggagtatctttttggcgttctctgtatttcctgaatctgaatgttggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcgcttcatttcattcatttcatcttccatcgctgataccctttcttccagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcactctgcgttttagagtttccactttttctgttctgttttttccccatctttgtggttttatctacttttggtctttgatgatggtgatgtacagatgggttttcggtgtggatgtcctttctgtttgttagttttccttcttacagacaggaccctcagctgcaggtctgttggaataccctgccgtgtgaggtgtcagtgtgcccctgctggggggtgcctcccagttaggctgctaaggggtcaggggtcagggacccacttgaggaggcagtctgcccattctcagatctccagctgcgtactgggagaaccactgctctcttcaaagctgtcagacagggacatttaagtctgcagaggttactgctgtctttttgtttgtctgtgccctgtccccagaggtggagcctacagaggcaggcaggcctccttgagctgtggtgggctccacccagttggagcttcctggctgctttgtttacctaatcaagcctgggcaatggcgggcgcccctcccccagcctcgctgccgccttgcagtttgatctcagactgctgtgctagcaaccagcgagactccgtgggcgtaggaccctctgagccaggtgtgggatatagtctcatggtgcgccattttttaagccagtctgaaaagcgcaatattcgggtgggagtgacccgattttccaggtgcgtctgtcacccctttctttgactcggaaagggaactccctgaccccttgcgcttcccaggtgaggcaatgcctcgccctgcttcggcttgcgcacagtgcgcgcacccactggcctgcgcctactgtctggcactccctagtgagatgaacctggtacctcagatggaaatgcagaaatcacccgtcttctgcgtcgctcacgctgggagctgtagactggagctgttcctattcggccatcttggctcctctctgcctatattttcttctaatacttttatggtttcagttttttttctaagttaaagtctttgatttcgtgtgggtttcattttggtgaaagtcttggggtggggatctgatttttttccaaatgatttttattaaataatgcattttccccccactaatttgcaagactcctatttgtttagggtctattttgtattatattcaagtccattgattgcccatccctgtaatagtacaaatctatttccatttctgtagcttcaagataaagtttactctctggtatatctagtttatgttctcctaccaccaccattactattatttttctgaattttcctgagtattttaatgtgtttgttttctcagataataataccaacagtatgtatcaagaatatatgtgcagtattaccaagtgttttgcatatatacctattttcatcattgtgataaccatgtcaggggtatactattaatatttcaatcttggcaatgaggaaactgagacattagaagaatatataacatgctcaaggtgacaaggctagtaagcagtgaagctgtgatttgagccaggcagttaggttccagagaccatgctcctacttctctatataaactgtagacgtgttgatctaagtcatttagatttagaatccaagataccatgtgtagcatttggatcaaaattgcattgaatttatagaaaaatttaggtagaattgacatatttatgacacaaaatcattctattcaaaaccaagatatagcttttcatttattcaaatatttgatgacttttacatagaatgctagttttcttcatgtaggtcctccatgttttattttaagctttttccttcatgtgtttcatttgtgttgctagtaatagaattttttcctctttcgtgtttttagctggttattgttgattattggaaagctgttgatttttttctgttggaaagatattgatttttttcttttaaatttgtaattaaccatttaccaaatgtccttactgctaatagtttttttattgatttttcctgaattttctataaatgttattctgcaaataattttgcttctcctttctaatatttatactttctcttttattctttttaaaaattggtttattcttgtaaatcattgttaactaatgatgaaactaagcatctttatcttacaaatgcctgtcattcataatcatttattatgatactaacttcagttttcttttcatgcaaaagtatcagcaagggaatggtgaatttttttcaaatgcctttctgtatctatagatgtcgtttgtcctttatgttaatatagtaaaagcacatatattttctaatattaagtaatgtttgcttcattcttttaatttaatattttatttaggaccattgcatattttatttaggactgagcgtgtgtgtgtgtgtgtgcgtgcgtgcgcatgtgtgcctgtgtgtgtgtgtgtgcacatgcatgtatatccttcctcagattttaattattatgttgacttcctagaattcagacttttcattttcctctctctttaaaaagttacaaaattatcagtcctttacagatctgaagaaatttacctgtgaaaacacctggcagttttgggtggttaactactatcttcctaaatttattctatgatgtgtctgtctatgtctcttaaataattttccaagttctataatacagtgataattatttacattttcctagaaagggttttcatctaggttttcaaatttatttgcttaggtttggacaaaatatttaaaaagtaagtttcctaaatttctttatagttgtagttaactccatttgcattttaatattgaacattcgtgctgcttaatttttttctctaggattaagtaggctggtaatttatcttttttcttgattctttaaagtttgggcttttggactgatatatcaattacatggcttctctattttttgactaagtactttccgcatttgtatttttgattttgtcttcacacttagatttcgtcatactacctatcttccataagtaacagtttctatgaattaaaaagcatccttttataaatgcagactttacttatgaaggaaatattagttataggtaatttagtgtgaattattttactccaaatactttcctcaacacaaaaaggaatcatcttttttgggactgaatttaatttaatctcttgaggactttgctttttcactgtttcatctatctgtgagttgtacgaacactggctgaaattagctcattgagtggatgggagtttagataaaaggggaaaaggggaaggtaatttgggaggatggctcttgttgggggcagatagatacaggatctgtggaggaagagagaaaggccagaacaagaactgagagagtaacaaagaaatcctacgaatccttagtaactttcatgtaatgagagacaggagaaaataagaactagcattctgtgagcaatgacaaccctttccctgcgtttgcctatcagttttcattctattaatagcatgtatctgaagatattaaaaaccaccaccccttttgcaggggtaaaatttagaatgattgacttttattggagttatgttttaaaatatattttgaaaatataaaaagagtttatgaagattttacctagagaaggatttaaaaatttcacccaaaatttactgaatcattagaattactaaaatctaacatgttcatggtacttggggtactctaaaaccattatgatacctatttttagattatttaaattaaaattagataatatacacattgttcattattatataacattacatttgtatattacattatatccttcattatacagtaaaatatatatagacagtaagctaacattatcagttcggtcaaaagtcagattaacaaaaatttacagtaaatgcttagtatttatagacaagctcctctttcctggagtaatattatatgcagaagttttctctgatcctatgaattaccacatgacctctccattccattttgtgtacctgtttgcctggtctggttatgactgcagttttgttttcattttcctgaattgttgctaacacttaagtatattgacttgtttcttcactgagaaaagaaaaaagtgtggtcccatattcagttcagcaaataattctatacctactatgtagaaggcagtatgccagtgactgtatttaggataaaatgtgtgtgtgtgtgtgtgtgtgtgtgtgtgtgtgtgtgtgtgagagagagagagagagagagagagagagagagatgttattgtagtcccaattgatgttaaagaataatggatggaaacacttggtcagtgtttccaccgatctttgcatcactcagcattcatgcctaaatttgtggtgttctcagaattgtgctaatgtgtaaaatattcttatacttaatatgagtacagtctgttggctctgtagaacacaactcaaagtgtatgtatttttctagttatttcttaaattatgacaatatgcttatctgatatatgtggaaccagtttgttaaaagtagtctgttagtttttaaggattagtcttctaagaaagattttctctttcttttctaacatgcaaatgagtgcatgcttaggggcttgatggcaatgagtgggatatagttaagcacatattaaaggcataacataataagggtgtcctctggaaagaaaagcctttacacaacccaaaataggtaaaaatgtggccttcgcctgtggctttaatcaatacatgccacagttatcgtcggacaagaattgaagccctcaaagttaatcttttccatctttcttccccacttccctaagtttcttcctctacatggccctatcctgctattccaagtcacaataaatgatgatagtgagattctttatgaagcatttaggtgatcttgctttcataccaatgaataaaaaattgagaatgtattggttttggaaccatactcatataagttatctaatgcttttttatgattgtacattacttaagaaacagatatttacatgagactttaattactatagttgatacagtgctgcatgcaatcatgtgctaaaaataatatgtgaaagttcttgtaaagatttattgacctcgcaaataaactagaaaatctggaagaaatggataaattcctggacacatacaccctcccaagtctaaacccagaagaagtcgaatccctgaatagaccaataacaagttctgaaattgaggcagtaattaatagcctcccaataaaaaaaaatgtccaggaccagacggattcacagccgaattctaccagaggtacaaagaggagctggtaccattccttctgaaactattccaaataatagaaaaagagggaatcctcccgaactcattttatgaggccagcatcatcctgataccaaaacctggcagagacacaacaaaaaaggaaaatttcaggccagtatccctgatgaacatcgatgtgaaaatcctcaataaaatactggcaaactaaatctagcaggacatcaaaaagcttatccaccacgatcaaatcagcttcatacctgggatgcaaggctggctgaacatacacaaatcaacaaacgtaatccattgtataaatggaacaaatcacaaaaaccacattattatctcaatagatgcagaaaaagcctttgataaaattcaacaccccttcatgctagaaactctccacgagctctaggtattgatggaatgtatctcaaaataataaaagctatttatgacaaacccacagccaatatcttactgaatgggtgaaaactgcaagcattccctttgaaaactagcacaagacaaagatgccctctctcaccactcctattcaacatagtgttggaatttctggccagggcagagacttggcatgcaagagaaagaaataaagggtattcaaataggaagagaggaagtcagattgtctctgtttgcagatgacatgattgtatatttagaaaacccctttgtctcagccccaaatctccttaagctgataaacaacttcagcaaagtctcaggatacaaaatcaatgtgcaaaaatcacaagcattcctatacaccaataacagagaaccaaatcatgagtgaactcccattcacaattactattaaaagaataaagtacctaggaatacagcttacaagggatgtgaaggacctcttcaaggagaactacaaaccacttctcaaggaaataagagaggacacaacaaatggaaaaacattccatgctcatggataagaagaatcacaatatagtgaaaatggccatactgccgaaagtaatttatagattcaatactgtccccatcaagctaccactgactttcttcacagaattggaaaaatctactttaaacatcatgtggaaccaaaaaagagcccacatagccaagacaatcctgggcaagaagaacaaagctggaggcatcacactacctgacttcaaactatactacctggctacagtaaccaaaacagcatggtactggtatcaaaatagatatatagaccaatggaacagaacagaggcctcagaaataacaccacacatctacaaccatctgatctttgacaaacctgacacaaacaagaaatggggaaaagattccctgtttaataaatggtgttgggaaaactggctagccatatgcagaaaactgaaactggaccccttccttacactttatacaaaaatcaactcaagacggatcaaagactgaaacgtaagacctaaaaccatgaaaaccctagaagaaaacctgagtaatccattcaggtcataggcatgggcaaagacttcatatctaaaacaccaaaagcaatggcaacagaagccaaaattgacaaatgggatctaattaaactaaagagcttctgcacagcaaaagaaactatcatcagagtgaataggcaacctacagaatgggagaaaatttttgcaatctatccatctgacaaagggctaatatccagaatctacaaagaacttcaacaaatttacaagaaaaaaacaaccccatcaaaaagtgggcaaggatatgaacagacacttctcaaaagaagacatttatgcagccagcagacatatgaaaaaatgctcatcatcactggtcattagagaaatgcaaatcaaaaccacaatgagataccatctcacaccagttagaatggtggtcattaaaaagtcaggaaacaacaggtgctggagaggatgtggagaaataggaacacttttacactgttgtgggtgtgtaaattagttcaaccattgtggaagacaatgtggcgattcctcaaggatctagaactacaaataccatttgacccagccatcccattactcggtatatacccaaaggattataaatcatgctgctataaagacacatgcacacgtatgtttattgcagcactatttacaatagcaaagacttggaaccaacccaaatgtccatcaataatagactggataaagaaaatgtggcacatatgcaccatgaaatactatgcagccctaaaacaggatgagttcctctcctttgcagggacatggatgaagccagaaaccatcattctcagcaaactatcacaagaacagaaaaccaaacaccgcatgttctcactcatgggtgggagttgaacaataagaacacatggacataggaagggcagcatcacacaccagggcctgttggcggggtgggggtctaggggagaatagcattagaagaaatacctaatgtaggtgatgggttgatggagcagcacatcaccaaggcatgtgtatacctatgtaacctgcacgttctgcgatgtaccccagaacttaaagtataataataaaaagatttgactataaggatgatattatgctataatacactgttcaaatattatgagattctaatggttaaaattgtttagtcattagaaaatatctgcagtggtaaattgttaagtatggaatttcagtaccccaaaataagtatacacacaaaagtttaagaatatttttcatcagtgtaacgattttcagtcaggagcctttgcacataatgaagtatgtaggctgtggaatctagccaacctggctttcactcttcaacttagtagctacataacctcagacaggctacttaggtactctgtttttctttgtctgtcagagggatatataataatacctacttcttaggagctgctgtaaagatttaccaagctaatagtagtagcagaaaacacttctctagtccttactgtgtaccagacactgatctaagcacaatacatttaaaaatcattatatcttcacaaccactgtatgcagtggttactgctgtgtctggcattaaatattagcaaataataccaacaactaccaccatcaagaagtcaacatgtctttacattctgatgacaataagtatgcattgaaaatgttaccatcttctattgaagtttaaattcatattatctaaagtcatgtttaaagatttttaaaactgtttaccatattttttacccttgctttcttcatattttaattaaaatcagaatcaagatgtgatgatcacctatgattgttattttcagataaactatactatattttcagccacaggttaaacagttcaggggtatagagatcattggacagaacatttagataactgaagccctcattggctactagaatttatcaagggcctgcattactctgtatgcttttggtggtgggccattttttaaataagctgtgtagatccacaaacaaaatgatagattcagaaatacaagtaagcttgactattaatttaagtttcagtcattaatatcagcagttttcactgttttttttctctcagctaagtgacagaagcaaaagacagtaaaaatcttggaaaatagttatcggtctttttttccatctcagcagataaaatacattgattttttggatttttcccattttatgacacatatcaaacatgctctgggaaaattcacaagatagttataaaatatatacaatctctgtgttttggatttatgacataatctatcttacaatggcagcttatacaggggacaggaaggagttctgctagagtcccagaaagtgataggcagtctttaagagtgctttgagctatggttgacttgggcagaatagaacacccagtatctctggttaaaaagaactcagtaaaaaaatatgaaccatgcaagcaagcatttgaaccagaatgcatatatgtcttaaagcctaatttgggggaagttttcaagcccaaaatactctagatataaatgtgttaaatgtgcaatccaaggtcaaccagagaacctacagctaacaaaattgataatataatgctaggctgcaatattgcatcattaaaaggtaagaatggcatcagcataaaaccatggccaactcaagataccaaagatgtccagaagcctcccttcgcaaaacagcaggaatgtcagctatctaggcatgcagtttcactggtcaagcatatttgagagccttgcagtgagccagaccttacatgatagccagatcttagtggagtatagaattgattaatcctcagcaaatacttaccatgttctaattttagcttgtcatatataaatgccaacttaaaatgactttatcaagtaggttgctaataagtactgaaagtaaaaatgaaagttaatagcattgtgcatcatttgccagtaagcatctccattccgtgtgtgtgtgtgtgtgtgtgtgttgtgtgtgtgtgtgtgtgtgtgtgtgtgtatttgcctcttactatgagttaaaggcccatcaggaaactcttacagtcaggaaacttaagcttatagtcagctgtgaaacagccttttaaaaatcattccccttacccacacacggacttcactctgcttgtagtgtggctgctcatagtgtggctgtttttccatcttgacacgtattttctcattactatattaaagtgacttttttctttattgtattgatatactgaatagacctcctcagataatatttatggaaacataaaaccattctggaaggcagtttaacagtatctacttcataagtcttcccttttactctaaagtttcacccctactaatctgataagtatatataaggaatggccaaaattatacatatttacaagaaaaattatggcattgttgctagtgcttaacacaggcaaaaaaattatcaatagatcataggttgaagtatatctgtatgatagaatgctgtgtagctatccagagggaaataagaaagctttatgtatatagatgccccttgacttatgaattatgatggtgttatgtcctgataaattcatcgtaagttgaaaatactgtgaaatcgaaaatgcatttaatatacttaacctatcaaacatcatagctgagcttagcctgccttaaatatgcctgcaacacttatagcttacagttgggcaaatcataacatgaagcctatgttttaatatgatgttgaatatctcttgtcatttattgaatactgtaccaagggtgaaaaacagaatggtgttgcaccatcataaagtcaaaacattgtaaatcaagccataattagtcagggactgtctgtactgacatagaaaggcttccaagacatgttataaagtggcataatataagtggcaaagcagtatgatgtgatcatgtgtattttgaattatatatacacacatttgtatataggtgatgctggatttatattaaatataagataaggtgaggtttgtgttacaactaagtaagaaaagtatataaaatgagttacatcatgcctacttagtgcattgaaataattaataaaatttgccattatttttatctttatggagtggattgaggaaggaaaaatagggctgcctttactaactttacatgttttgcattgactgattttacatgcattacttttataataaaataagagagaaaaccatttactcttgggaaaagatctggaaaagcatattcatactaaaatattaatggcataacaaaacttgacgtttttcttctgacacaagatattgaagaactcctaatatgtgagcacagtggtgacctctggtactcttttggacaagagtcttcctaaagtctataaaagctgttttggagttttggttatttgttttcacctttaaatatctacccatattttcaattgtatttcttccttcgtgttctcaggagtgtgtgtgtgtgtgtgtgtgtgtgtgtgtgtgtgtgtgtgtgtgtgtgtgtagagggatatgtatacatattatttaagcatttaggtgattatttttcaagaattgttggaaaatttaaggaagcagtggaaagaataactgatagtaattactgcctagttatctaaataaagtgaagcttctttttctcccttcttccgaatcttttcttagcaaataagaatcaccctgaaagtagtttaaaagagatattctagtgaccatacccaatgaagtactaaatattcatcctgttagagtgattattgcaaggactctaaaggaaaacattgattatactagattatttattttatagaattttattctcagcttatactcctggttctatgaactatagaaatcactcagaataataaaatgctgatgttatattttattgaaattcattaaaaattatagaaaaaggtgctcatttgaaaacttccaaatgtcagttattcagaatgacaaacttaattatatagaaattgactaatttggttgattctttctaaagtcagtgttggattaataatgtaatgcatggatcattaacagcttaaaaatacttgtggtaaacttgatgatgtaatgctattttgttaggaaagatggcctcttttcttaagttgcaatcctttaaggattcaaagccctaattgtacataagcaatatcgtatgctgtaggctcgttatcattggaggggaggtttaatatagagtttaagagcacaaaatatggaatcagactgttgctgttaaaatcctggctctgccacttcctagctgtgatcttagacaagttactctctctctgccttgattttcttacatataaaacaaggatataagtagtaagtggtagaactcttatttcataaggctgttataagattgttgtaagaatttaatgggttagtatttataaagcaggtctatatatagtaagtattcaataagggtagctactatttgtcattttggtcatgtaatatctagtgttacatatgtgtgttgtcaaataaattagttgttaacattatttaaaagaaaacattgaattacaatctgttttaagcatcttttttatttttctgagatgtaaaaactgattgttttactagttggttttgattatttgtttcttgtttgtattacagttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagtaagtctgatttttttttgtaatattgtattctcatgattcgttttttaaaatatatattaactgaaaagataaattggatgaaaagtttgaaatcaatagtaaatttggctatcaataaatattaggtgtcctacttactaaaaagtggattatgaagcagaataagcaagttattttgaccatatttacaatgcatataatgtattgaaatttagtagaatttattaaccaggatcaagctttccaaatattgttgatataattgaacctacctttaattttttattgtaaccccgaatgaatactctacttagaaaccaataaatatcatatagatatagtgaaattataattcaatatgcaaaaatcccaaacacatataaatcatggaggtatttttagtgcttgtaaacctctctatacatacatcagaatcctttaagtaaggtggttttttcactttaaatttttacttttactcaaagtatggctgagtggaaggagcggtgaaagtaaggagaccctctacttgctgcactttcagtgagtaaacactgaaagtttaatcttcttcctcatctgtcaaatggagaaattggacctagtcttttattctagctctaaaatttcttctttctacttttcctaataaactaattaaattatttagcctgtcttgccaggttaagcaccaatgatataaaaatgggatatggaagtggcatagtattaattagagaggttggggatcaggaacaagggcatcagaaaaggtaaacaagtacacgcaataaatcgaatccaagaccagtcaaaggagaagcttcccagcaagaattcaagttcaaagaggtcgtctagacaagatatcaaaactaaaatctggaaaagtgggtcaggcatgcaggtcaggatattatctggataatgaaatatggaagtgtagataaaagctcagataataggcacagattggcagaagttaagatttctacaatatgacaaatctaatggttaacaagggacttttgaaataatgtaatcagccctctcattttatagtgttgttcatttgtccattcagcaacctctgtagaaattggttgcaactgtggataagactctctgcatgaatgatgtttatatggcttaatggagaagagagataaataagtcacaaatacattatagttttatttaggtatacattatatggcagcatcaaggaggagcatccgaattagagaaggaaggagaagtcgtagaagagttctgagtgaaacagagtggtctttagttcttaaggaccgatggaggttaattagacaaagtacagtgaatataaggttttcaggcaaaagaggcaacatacatgaagccacagaggcttgagcaaagtgttcacagaaaatgagatcagagaagtaaacaagggaaaaaatatgaagtgatttgtgtactatgtcaaggaatttgaaccttatcatggaagctatgagaagaacatcattaaaataatttataaataagtctggtgtaatatggaaaaagaattttagagggagggaggctgaggtagtgtcttcaacgagacggctgtaataatcaggcagtgttaagggtttttgagttaaagtagttgcccatgggatgggaatagaagggagataattgaaagacagaaaggagatagaatatataagaattggaaagggctgtttttagatacagtcccaggtttctagaaagtgagactcagagaagttgacttgctcacttatggcagctggttaattgtagagctatgaacctgttaatgttaatactaagctcaaacatttttggagcaagggtttcttatgtatttcttatctgtggcctgaattacgtagttgatccagagtcttaataggtaatcaagaaggaaatgatctgtctggggaaaaaagggggcaataagaataaggtagatgaagggagaaaggaaggtgaaaaaatcagtgaacaggttctgcttctgagaatatgttgggttcgattatttgaactaaccctttttactgaaaacaactaatggtgctagattaaaaacaaaaacaaaaaacttcttagcacttctaaagagctaagtaagacactaccttgtcaaaatctaagtgaaaaaaggaacccatagaagtaaacagagcagatcatagaagacactttggtcctgaatacatttgcctagccagtgaaatgtaaggtgattttcaggcttctgagaggaaacaaagcccaagaccaccaaagatagtttaatagcagtatggattatgtctcgactgtgaggatgaactaaaagcaaaccattttccatctctaccatccttgagagtgaacaagcaaagtttccctggttaggtattcagggaatggaggattgtctttgagaagtagtaaccacaagctgtctcgcactgatttgaagtccaagtttacattgctgtgtagcctgaaaaatctcaagccatatttgagtttaaagtggaactgctacaaatatctattggcaccaggcagaagtaaacacaagtcttttggagaaatataccttcatcctagtactatagaagtctcccaaataatttagcaagaaggtagaaacatgagtgagaattaccagaaacaaaaggaagcagaaactgacccataaaggctaattactagagttacgtcatacagatttataaaatgactactgtcttgtttaaagaaaaatcagatggttatctgctatgatatgataaaataaaaccagtgtgttttaagaataatctaatagaactaaaaataaaaaattgaatagtaggaatttgaaattcagaggatacatttaacaacaaattaaacagggttaaagaaaaattaataatttggaagatagagaaaaattacactaaatggaactcagagagacacatagaaaaaatatgaaaaacaggtgcctgtagtcccagctactcgggaggctgaggcaggagaatggcgtgaacccgggaggcagagcttgcagtgagccgagatgatgccactgcactccagcctgggcgacagagtaagactctatctcagaaaaaaaagaaaaaagaaaagatatgaaaaacaggttaagatacatgaagattcaatacatcttatgccaggagaaaagatactagggcagcagccatacttgaagaaataatggctgaggtttttatttataatcagtgaaaaacaccatactacagattcaaaaagcccaaatggacattcagatctgtaaagatcaaagaagtccaatagattgaacataaaaagatcttcactaaggcacattacaatcaaattatgaaaagtcaacgacagttttgaaagcagcaaaagaaaagttgcagactccataagactgtaggcagatttctgtgcagaaacctgtcaagcaaggagaaagtgggatgatatattcaaagtgccaaaagaaaaacactgctgaccaagcatactatacccagcaaagttatacttcagaaatgaagaagaaatactttcccaaaaacaaaagctgagggattttgtcactgttaaacctgcttcgtaagaaaaactgaaggcagtttttcaagttgaaacaaaagaacactaattagcaacatgaaaacatgaaagaataaaactcactagtaaagaagttccaaactataaatactattctatatagtgagaaagaatgaataagacctactatttgatagcacaatagggtgactgcagtcaataataacttaattttacattttaaaataaaagagtataattggattgtttgtaactcaaaggataaatacctgaggggacagttaaaaaagaaataaattcagaatgctgtgatactataatgatgttgtgtaaatgtcttgtaactctaatataaaaataaaaaacaaggtattaaaatatagctacaataatttttaatagatatacaatatacaagtatgtaaattgtggtataaattaacacagaatgtgggaggggagaggtaaaagtgtagtttttatatgtgatggaaattaagttcttatcagtttaaaatagattgttatgactataaaatggtttttgtaagccttttggataattaaaagaaaaaaactgtgttagatacacaaaagataaaccatgcgattgcaaaaaatatatatatatatataaaatatcaatggaagcagcaaagaaacaaaggcacttaaaacttttcagaaaacaataaaatggcagtagtttttacttatcaataattactttaaatgcaaatggattaaactcagtaatcaaaatacattgttactatgcatgtttttaatacagagatagggccttgctgtgtcaccagggtagagtgcagtgatgcagtcacagcccactgtaacttcaacctcctggactcaagcagtcttcttgctttagtctcctaagtagctaggactacaggcatatgccaccacatgtggctaatttaaaaaaaaaaaaaactttcatggaaagatggggtcttgctatgttgctcaggctttaaatgcattttttaaaactgacccaactacaagctgcctacaggagacttattttacctttaaagatacagataagatgaaagaggaaggttggaaaaatatgttccatgtaagtggaaccaaaagagagcagtggtggccatttttacaccaggcaaaataaattttaagtaaaaaattgtcacaagaggcaatgaaggtcattgtataatgataaagaggtcaatttatcaagatgatacaattctaaatatatttgccaccaattttggagcacataaatatgtaaagaaaaaatataactgaagggagaaatagatagcagtacagtaatcataggggtcttcagtgctttcaataatggagaaatcatctagacagaaaatcaataaagaaacagtggatttgaacaacactagacaaaatggacctgatatacagaacattccattcaacagtagcagaatatgcacatttttctcactcaaacatgtaacattctccaggacagattatttgttaggccacaagataagttttaacaaatttaaaattaaaattatatcaagtatgttttctgtcaacagtggcatgaaaccataaatccgtaacaggaggaaaattggaaaattcacaaatatgtggaaattaagcaacacactcctgaacaaccaaaggtcaaagaagaaatgaaaggggaagtaaaaaatatcttgaaacaaacaaaaatggaaacataacataccaaaacatggaatgcagcaaaagcagttctaaaagagaattttatagcaataaatgcctacattaagaataaggaatgatcttaaataaacaacttaatattggacctcatggaactagaaaaataagaacaaagtaaaaccaaagttagaagaaggaatgaaataataaagattagagcacaaataaatgaaataaagagtagaaaaacaatacaaaagatcaacaaaactgagttagttttttgagaagataaaatcaacaaacatttagctagaatttaaaaaaggagggaatatccaaatagaataataaatgaaaaatgaggagagggattaaagatggccaactagctggatctgggatgcacctcttctacagagaggaaccaaaatattgagtaaaccctcacactttcaacagatcttttgagagaaaacactgaaatttaatatataggccatgacagacatgattgaagaagtaggaagcaacactgctggctcagtattgccagacaccttaggaccagaatggacccaaggaaggtgtgagtgaagaaacccgggaacaccactttcccactgtcaacctctgaaattctagaggagttcccacaacccctgaatacgtttggattggtaggaggagctgcctggagaccatacagaggcactacttgaagccacaaggagcccaaaagccttcagtgtgctaggcagctgcagcaaaacgtgactctgggcacccacccccgagtgccctgcatccgagcggctacatctgctgtctgccacaccaggatagagtggggcccatgcatgttcacatgaccaattcaggatccaccaccattcctgcaggactgaggtgaatctaaaccacacacgaccatgcctgccagtccctcctaagattgcctgcctggccattgctgtggagtgggacccacagcatagcctccattgccccacctgagtggtttattggctacctgggaacactttactcctcctatcactgccagtggttgatcctaaggagccagaggacaaatccactggcctggtctcagtttgccaggactcaagcataccacccaggaatatggggatgagatctgtggcctgatctcaagcaggggaggaacccccactgtcagaacacagggaagagtgtggtgtgggtttttcaggtggtacagaagctgggcacccctcccttcatgagaatagactaggaagggtatagcctcatagccttgctttctgctgcagggagtcttgcattctggaatgcctgggatggcatggcagtctgggcacaggtggtttgggatttgcataactaattgggccggctgccagggtggacactggagggagacccaccagtcaggggtgtagaagctgagtgggcctcatggccatctgctggaatgaaatcccagggctagccctcttaccctgaaccagctcttgtggcacagaagaggtgcctgcacccctccctagagtgttgttccagctgcctgagaactgcccctacagccctaccaaggtcacgtctgcctcagagagcctgatcacgggctcaccagacccagtcccacccagctttgccccctctagccagccttgggagcagagcatgggatgggaccactgagagctccacaccccccacccatcaccaagaacactcttgtattccttatcaacaaaggccaagtaaaaatcccactgtcatcactgcagctgcctctcacctgccagcatcacctactggccaggaggtcaaaactgcatgtcctgtcgcagcaactgttgatatcattgcacagcactcagacagctcttacctgcaggcatcacctgctggcctgtagggtgaactgcacaacccaatataattcctgctgacaagtacacagctctaaggaatgaggtaagtttcccccaaaagacctccaactttgcatctctataggagacagtgagccttaccacatatacagcataccactactacaaactacaaacaattaacatttgagaaaacaactacactaaggctatctgtaaccaaggaatttatacagagccttggccccctaaaagcacgtagaagcaaagccaaaggacacaacccaacatatgcaagagtcacaccctcaaggggcaacgaaaaataatcccacccaaatgaagataaatccaaaaataataagtgccagcttctacacatgagaaggaaccagcacaagagctccaacaccaggaagaaatagaatgttgtgacacccctaaaggaccacattagctctctagcaatgaatcttaatgaaaatgaaaactttgaaatgacagataaagaatttaagatatggactgttaagaagcctagtgagatacaagagaaagttgaaaaccaaagcaactagagaaacaatctaagagatgaaagacaacatagatatattttttaaaaaacaaatggaatatctgaaaatgataaatttgctgaaggaacttcaaaacactgttgaaagccttaacaatagactagacaaaccagaagaaagatttcagagcttgacgactagtctttcaaattaacccaatcagaaaatggccgaataggaacagctccggtctacagctcccagcgtgagcgacgcagaagacgggtgatttctgcatttccatctgaggtaccgggttcatctcactagggagtgccagacagtgggcacaggtcagtgggtgcgcgcaccatgcgtgagccgaagcagggtgaggcattgcctcactcgggaagcgcaaggggtcagggagttccctttcctagtcaaagaaaggggtgacagacggcacctggaaaatcgggtcactcccacccgaatattgcgcttttctgacgggcttaaaaaacggcacaccacgagattatatcccgcacctggctcagagggtcctacgcccacggagtctcgctgattgctagcacagcagtctgagatcaaactgcaaggcagcagcgaggctgggggaggggcgcccgccattgcccaggcttccttaggtaaacaaagcagcccagaagctggaactgggtgaagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagtacgcagctggagatctgagaacgggtagactgcctcctcaagtgggtccctgacccctaacccccgagcagcctaactgggaggcaccccccagcaggggcacactgacacctcacacggcagggtactccaacagacctacagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaagtggaaactctaaaaagcagagcgcctctcctcctccaaaggaacgcaattcctcaccagcaatggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcgatggaagatgaaatgaatgaaatgaagcgagaaggaaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaacgtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatcctttacacacaagcaaatgctgagagattttgtcaccagcaggcctgccctaaaagagctcctgaaggaagcactaaacatggaaaggaacaaccggtaccagccgctgcaaaatcatgccaaaatgtaaagaccatcgagactaggaagaaactgcatgaactaacgagcaaaatcacctgctaacatcataatgacaggatcaaattcacacataacaatattaactttaaatgtaaatggactaaattctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaattaaaaaaggcaggggttgcaatcctagtctctgataaaacagaccttaaaccaataaagatcaaaagagacgaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaggtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattgtaacaaactatctctcagaccacagtgcaatcaaactagaactcaggattaagaatctcactcaaaaccactcaactacatggaaactgaacaacctgctcctgaatgactactgggtacctaacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagacccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaattaatcccagagctggttttttgaaagggtcaagaaaatagatagaccactagcaagactaataaaaaaagagagaagaatcaaatagatgcaataaaaaatgataaaggggatatcaccaccgatcccacagaaatacaaactaccatcagagaatactacaaatacctctatgcaaataaagtagaaaatctagaagaaatggatacattcctcgacacatacactctcccaagactaaaccaggaagaagttgaatctctgaatagaccaataacaggatctgaaattgtggcaataatcaatagtttaccaaccaaaaagagtccaggaccagatggattcacagccgaattctaacagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcagtaaaatactggcaaaccgaatccagcagcacatcaaaaagcttatccaccatgatcaagtgggcttcatccctgggatgcaaggctggttcaatatacccaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatttcaaaataataagagctatctatgacagacccacagccaatatcatactgaatgggcaaaaactggaagcattccctttgaaaactggcacaagacagggatgccctctctcaccactcctattcaacatagtgttggaatttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccagtaacagacaaacagagagccaaatcatgagtgaactcccattcacaattgcttcaaacagaataaaatacctaggaatccaacttacaagggacgtgaaggacctcttcaaggagaactacaaaccactggtcaaggaaataaaagaggatacaaacaaatggaagaacattccatgctcatggctaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaactgaacagagccctcagaaataacgccgcatatctacaactatctgatctttgacaaacctgagaaaaacaagcaatggggaaaggattccctatttaataaatggttctgggaaaaccggctagccatatgtacaaagctgaaactggatcccttccttacaccttatacaaaaatcaattcaagatggattaaagatttaaatgttaaacctaaaaccgtaaaaaccctagaagaaaacctaggcaataacattcaggacataggcacgggcaaggacttcatgtctaaaacaccaaaagcaatggcaacaaaagccaaaattgacaaatgggatctaattaaactaaagagcttctgtacagcaaaggaaactaccatcagagtgaacaggcaacctacaaaatgggagaaaatttttgcaacctactcatctgacaaagggctaatatccagaatctacaatgaactccaacaaatttacaagaaaaaaacaaacagccccatcaaaaagtgggcaaaggacatgaacagacacttctcgaaagaagacatttatgcagccaaaaaacacatgaaaaaatgctcatcatcactggccatcagagaaaggcaaatcaaaaccacaatgagataccatctcacaccagttagaatggcaatcattaaaaagtcaggaaacaacaggtactggagaggatgtggagaaataggaacacttttacactgttggtgggactgtaaactagttcaaccattgtggaagtcagtgcggcgattcctcagggatctagaactagaaataccatttgacccagctatcccattactgggtatatacccaaaggactataaatcatgctgctataaagacacatgcacacgtatgtttattgaggcactattcacaatagcaaagacttggaaccaacccaaatgtccaacaatgatagactggattaagaaaaggtggcacatatacaccatggaatactatgcagccataaaaaaggatgagttcatgtcctttgtagggacatggatgaaattggaaatcatcattctcagtaaactatcgcaagaacaaaaaatcaaacaccgcatattctcactcataggtgggaattgaacaatgagatcacatggacacaggaaggggaacatcacactctggggactgttgtggggtggggcgggggggagggatagcattgggagatatacctaatgctagatgacgagttagtgggtgcagtgcaccagcgtggcacatgtatacatatgtaactaacctgcacaatgtgcacatgtaccctaaaacttaaagtataataataaaagaaaaaaaaaaacaaattaacccaatcagacaaaaaataagttttgtaaatgaacaaagtcttcaagaaatacaggattatgtaaagctaccaaaactgtgacttacaggcattcttgatggagaagaggaaaaagtagaaagcttggaaaaatatttgaggggataatttaggaaaatcacccaatcttctagagatgtagacatcaagatacaagaaattcagagagcacctgaaaaatactgtacaacattaacatgaccaaggcatatagtcattaggctattcaaagtcaatatgaaagaaaaatcttaaaggcagctagagacaagtgtcaaatcacctatgaaggaagctcatcaacctaatggtagacatctcagcagcaaccttgtaaaacataagagattagaggcctatttttaaccaccttgaaaaaatgtcagacatgaattttatatcctgccaaactaagcttcataattgaaggagaaatagtctttcccagataagcacacatagagagaattcatcaccactacaccatcttacaagaaatgctcaaaggagttctgaacatggcaatgaaaggataatactcaccatcatataaagcacaggtaagtagaaacctcaaagatccaataaagcagttacacaactgagactccaaggcacctagctaacaaaactatgatgggaaaaaaacacacatattaatattaaccttgaacataaaaggcctaaatattccatttaaaaaataaacactagcaaattggataaaagaagcaggacttaaccatctgctgcctaccagagacccacctaatggcaaaagacaactacagactcaaagtaaagggactagcagaagaagagaaataacaaagagcagaaccaaatgagattgagaccaaaaaaaaatgatgaaaaggatcaacataatgaagagtttgttctttgaatggataaacaaaattggtagaccactaactagtttaatgaagaaaaaagagagaaaattcaagtaagcacaatcagaaatgataaaggtgacagtattgctgatacaacagaaatacaaaagctcatcaggggttactatgagcatctctatgtgcacaaactagataacctagaagaaatatgtgaattcctggaacacacaacttcctgagattgaatcaggaagaaatagaaatcctgaacagacaaattatgagtaaggaaattgaatcaatagtaaaaaaaaaccttccaacaacaaaaaagcccaggaccagagagatttacaggacagttttgccttatctacaaaggagagcaggtaccagtcttacagaaactattccaaaataccaaggcaggaaggatacctccctaactctttctgtgatacttgttatctccctgatgaatataaatgtaacaatcctcaacaaaattctagcaaaccagatttatcgcacatcaaaaacaaaatgtatcacaatcaagtgtgttttatttcagggatgcaaagatggttcaacatttgcaagtcagtaaatgtgattcaccatatatgcagaattaaaaagaaaaacgatatgatcatgtcaatcaatagatgcagaagaggctgttggtaaaattcaatgtcacttcatgttaaaaaccctcaaaaactaggcattgaaggaacgtacctaaaaatagtaagaatcatatatgacaaagtcacagccaacatcatattgaatggggaaacgttgaaagcattcaccctaagaactggaacaagacaaggatgcctactcacaccacttctattcaacatagtactggaagtcctagacagaacagttgggcaagagaaagaaacaaaaggcatccagattggaaaagaggaaatcaaattatctctggtcactgatgacatgcccccatacctagaaaatcctaaagactcctagacttgataaacaacttcagtaaagttttaggatatagaatgaatgtacataaaccagtagcatttctgtatactgttactgaatctgagaaccaaatcacgaactctatcccatttacagtagtcacacacaaaaataaaataactaggaatacattgaaccaaagaggtgaaagttctctacaggaagattacacaaatggaaaaatatctcgtgctcatggattggaagactcaatattgttaaaaatgaccacaatgcccaaaggaatctgcagattcaaagcaatccctaattaccaatgtcattcttcacagaattagaaaaaacaatcctgaagttcatatggaccaaaaaaagagcctgaatagccaaagcaatcttaagcaaaaagaacaaagccagagacatcagattacctaacttcagattatactacaaggctgaacagcatgttactgatatcgtgataccatgataaagatggacacatagatcagaggaatagaacaaagaactcataaataaagtgacatacctacaaccaactgactttcagcagattcaacaaaaataaacaatggggaaaggacatcctattcagtaagtggtgctgggaaattggccaaccacatgcagaaaaatgaaactggacctctgtgtctcatcatattaaaaaattaactcaagatggattaaagacccataaatgtaagatgtgaaacttaaaatcctgaaagaaaacctaggaaaaactattctggacattggcttaggcaaagaatttatgactaagaccccaaaagaaaataaaacaagaacaaaagtacacaggtgggacttaattaaaccaaaaagcctgttcacagcaaaagaaataacagagtaagcagacaacctacagaatgagagaaaacatttgcaagtcatacctccgacaaagaactaatatccagaatctacaatgaacccaaataactcagcaagagaaaaacaaccccattaaatattggtcaaaggacatggacagacatttcttaaaagaagacataaagttgccaacaaacattttaaaaatgcttaatatcactaatcatcagagaagtgcaaattgaagccacaatgagatattatcttataccagtcagaatggctatgattaaaagtcagaaaacaacagatgttggcatggatgcagagagaagggtattcttatacactgttggtgggaatgcaaattagtacaaccgctatggaaaacagtttggagattcctgaaaaaactaaaaatggaattaccattcaattcagcaatgccactactgggcttctacccaaaggaaaagaaatcattatataagaaagacacctttatgtatgtttatcgcagaactactcacaatagcagagtcatggaatcaacctaagtgtatatcagtggataattggataaagaaaatgtggtccatatataccatgaaatactatgcagtcataaaaacaaatgaaattatgtcctttttagaagtttctacatggatggagctggaggccattatactaagtgaaataactcagtaacagaaaagcgaatactgcacattctcacttgtaagtgggagctaaacagtggttacatatagatgcaaagatgtaaatatcagacgttggagactccaaaaagggggaaggtaaaaggggaattcggatttttataattcgaatttacaattttacaattgggtacagcttgttcactgtttggattatgggtacattagaagcccaaacctcactattatgtaatatatctatgtgataaacctgcacatgtgccccccaaatctaaaatcttaaaaaaagaaatttataaggaaaagggtacactacaactgatactaaacaaagacagaggatgataggagactgttatgaacagttatacactaacagattggataatcctgaagaaatggataaatgaatagaaacgtacaacctaccaagatataccatgaagaaacagaagatataacagaccaaggaaggagattgaagctgtaatcaaaaatctcccaacaaagacaagtcaagatgagatggcttcattggttaattgtactaatcatttaaggaagaattaatgacaagtggtcaacttgtagaatcagttcttctcaaattcttctagaaatttgaagataaaggaatactgccaaagtcattctgtaagaccagcattgttatgatatcaaattcaaataagaacacaagaaaattataggccagcatctctggtgaaggtaaatgcaaaaatcctcaacaagataatagcaaattgaattcagtaggaaatttaaaatatcatacaccatgatcaactgggacttactcctgggatgcaagaatggtttaacctatgcagataaaaaatgtgacataagacattaatattctgatattcacagatctgtaacataatgtcaaagatctaaattatattgggaaatataatatgctattgaaattgttaagtatgtagtaagtacctttaaaaagctattatctgtgaatgaaactccaaattaggattaagttcttaaaagaatcatatggaaaaaggagtattttattgtaaatattaaactaggacatgtttgttattaaaaataaaatttatacagtaagtgctattgacttaaaatactatcaactttattctctgtagagaagaaagtataagttggcaatgttccaacatgtctgtattaatcttacaagatcttgtggttcagccaaaaactctcatgcttgtgtcagttaaactttttaagtataacttttgaaacacctgtcttaaaggcatccttatgctttcagtttttaaaacatatataaaactgatctgataatgtgaaatattgttcaacatgttagctatttcttaatgttttgcaattggtgagttttaaaactgtcccaagttaacagcgatttaaaaacatttttctcacatgtagtttttaaagctctctagaaattgacatgtttaaaaactgccaagacaattaaactttttatgttaaaaatgtttaaaactctgatcatatagcacatagtaataacgctttcttgggcataaattataataaaatactataagtaatacatgtaaagaatgtatcagtcactatctaagccttgaagcaaattgtattcatccttcaagattcagttgaacctactctttggaatcattttcaaccagaggtggtgtatgatttagaaaagattgagcacatggcttctagtcttcgctgtaccatctcttgagttccacttgtacatatgtaaaatgaaagcaatgggccagatgacccctgagtgttgttttattttttagctctacttataagggaacacttccatttgcactaaatatactgtatgaatgtttaagtatttctgggtatcttgagtattcagaggtggcactaatgaaggagtgtaggctttccctgcaatgttgaaccttggtgtacattttgtcctctttaaaaaaccaatcaaacaaatttgctacctagaatacagtgtgtataggtcttttggtcattagccttataataggtagtcatttaaaatattttccaaagttacttaggtaatttcttgttttccatacctcattcataatagttttattactgttggtattgtatttttcattctccctatctgctggatgatttaaattatttattttttgagggaataggaaacattgccatagttatataaataagctctacaaaagggtgtactcagggaagtatcaatcctccccctatgcctactaccctgtttccattctccttccagttattaaatttgtcatagagatttgggttgttctgaaactacttaagtgtatactgggatataacaagtaagtaaatatgtttcagataataagacccagatttctcaccgtaagataaaaggctagtgtgttcagggctatggtgttcagttggaattggaagtatcagtatgaacttatggttctgaatatatataaaaacagataaatatgaaaatatagatggggtatgttagtgtacatacatatatttccaagccctgcctactaacaagacatgaaagcagtgacacccagtagtagtgaacatagataatacccagatctaggatttaaataccattctccagtagaaggtactatgccgccttggagaaatggctgattctatatctagggcagggaaaatggaagatgagcctagaatagtaagtacacataaataagtaaaaataaatttcaggtgcagcggcatgcacctgcaatccctgctactcaggaggctttgtaatcccaactactcgggaggctgaggcaggaggatcgcttgagaccaagagtttgagaccaacctgggcaacttagcaagactccatctcaaaaaatgaatgactaaatgaatgaatgatgagagcatgtcaaaaaaacacaggagccaacttgaaggagttcccaatagccaattctggagcaattttagcagcaaaataaataatgatagcattattataatccagaaaataaaagaaatatccatccatctgtattgatataaatacttaaacacctgggagggaaaggacaggtcttccttacagtagaaatccaattataaattaataagtaaatatggaaatggagactcaccattaggcaaatatcatggtaataattgtttaaaagaactatcaatggatattaaaataagtgggtgaaagtgtcatgagaaaaaagattttttgcataattttgaagtattttcccagaagataattaataattgctaagagaaacatcacaactggtgtggaaaaataaacctggcaggcaccaccttaaccagatgatcaattacagatgataatatcaccagtaataagacatagtgacataccatgtgccactagtgtggtatattgacaagggcacctattgctttagttctgtttttgctcaaaatacatcacctcaatctaataattagaaaacatcagagaaatccaagttgaggggcatatgacaaaatcagtgcccagtacgcttcaaaagtgtcaatgtcaaggtcataaaatacaaataaagacagaagcaacttgtcaaagacaaacagattggattatcaaattttggtagaggttacaggaggttatggacacatgatacagtgtagcatactaaattggctcctgggccagaaaaaaaaaaaaaggattattagtggggaaactggaaaagggcaaataaggtccctagataagttaatagcattgtataatgttaattttatatctttcataacactgctgtgattatgtcatgttctctttaggggatactggttaaagggtatacaagaatgttgattttttacagcttttctgtaagtctgaaatttttcaaattgagatactttgaaaatttctgatcaaaatgaagcaaaatcctttccttgggctttgttagtatgtattacctgaaaaaagttggaattttcaaaaatattttaataagcagtaataaaacaaaaggaaaaatattggaatataataataattcagtttacaaagtgcatagtaggtcagaggatcattcctagatctctgactcttgtcccattctgttagcctaaaagaatgtcagatatcttgccccaaaggaaagttttttgtacttttcctgatctgcctccatgttgcagagtgccagcttacttccgcacatttcagacctggtcgcgataccttgaacttcaggggcaaggataaatcaggctaattctgctttcattaggcttttctgttcaggcctggttggggtttgagagaatatgcctcttctctaaaacactggaggactgggaaggctggacacaataaattaacaatcagtggcaatcccacatttcatatattgggtaagaaaaataatactgagtgtacctgtacagacctaatgctaattgctttcccaaatattatttattttcatacttagaatagctctgtgagatagatgttggctcctttctaaaaataaggaaaatgaggctcagacaggttaaatatcttgccaagatggtacattaagtaatggaaagccaagattcaaacccaggtctatttgattccaaagcatgctattctttttttcttataggtccaacagaaaaatacatatacattaaatatgatatccatacatataatagagcagtgcagaggtaattctgtcagtatcaatgcccatccatatagaaacatcttaagagaagttaccatatcatatattctttttaatttcccatggcctccaataaggtagaatccggtaattactacattactggtgattttcagattcatagtatctgatgaaagtaaaacagcaaaaagaaaaaaatattgacctctgcagggcaatcttatctgtagctagctggcagattgctgttatcttcattcttctctctgttctataaatatttaaccacctgtattggttttctgttgctgccataacaaatgacaacacacttacgatttaaacaacacaaatttactttcttttggctctgtgggttgtgagtccatcccaggtctcactgggctaaaatctaagtgttgtattcctttctgtaagttcatggggaagattcattttcttcctcagatggtggcatagtcagatccttttgatcatacaaggaccccatttccttgctggctgaaggccattcccagcttctagagggtacctgcattccttggcttgtgacttcttttctctaaagccaggaaaacaggtcaagtttgtttcatatcgtatctccactcctgcctcactctctttcacttttaagagctcgtgattaactggcccacccaaataatccaggataatctccccaccttgaggtccataattttaatcacatctgcaaagtccatttcaccatttaaagtaatatagtcacagggtcagagtactaggatgtggacatcttcatggatgccttattctgcagaccacaatgtaaaaaaaatcacacaagttcataaaccactggctaatattaataatcataactatactgagcagtttgtgtcaagtaatgttctaaattgtgttttatatattaatctaatccttgcaatactgtaatgaagcaggttacttagccctattttatggatgagaaaaaataagtacaaaagacattaggtaatttaccagagtcactgatagtaattattatctgtaatttcaaccaggcggtctgagtctgtaaactatgccattaacttccgtactatcataagtcactcagatgattcaggacttcggatattttacttaactgattagggtcaaaatgtttagcaagcctatactgtatgtgggctggttattcttagtttttacggtaaatgaatatttttttcttgctggctgacagaaaaggaatgataatgagggtacacagatgactgaaattgaatgttatttccttagattattttactcattatcactattgtataagaatatgtcactgtttgttatataagttccttcagaacaacttagagaaaaaatatggtaattaggttatcatgtaatccaatgacatacatctctgttgcagcacttttgcaatgatgttgtaattctctgtctctctctcccccaacctttgttctttgatgttagtggtctttccaattttgtatttcaacatctatagagtttctggctgatggatcctcaaatagtgaattggatgaatggattagttaattaattaaatcattcctataattgtcaatccatttataccctgctcttaaaatttaatgaattaatttgaggtgaaaatgtttcagacaagatgatcttcaaattctacatgtaataaagataattttaagagtctcaaaacaatttgtatatttatagaatccctaataatggccatttgcagtgtgctaagcattgggctaaacgagagctcagtattcacaacaatcctgtgatgtaatgctctagtcgtatacatgtggaaactaaggactaactgagttgtatcactccccaaagtctactcacggacccagtagagccaatgtcttcacctaggaataattgactctaaagcgtttgcccttatccactgcctcatttctttttattcctaaagtaaaactactcataagatttctggatctgatttctgtactacttgtggattgattaaatacaaaaacattattgtgtattattatcagttggtctttcaaataactgagaccaaaacattaaaatagttttaaaaatctgtaaacactcctattcttctggatttctacttacagaattagcacctagaactagaaaagtaagtttcttttttttttctgagtgttaagacctcaggaaatatttttttaattaacatactataaaattgacttgatattcatttatttgagctttaatacacacacacacaaacagacacacacataagtgtattcatgtagcaaccatgacgatcagggcacagaacagttccatcatcagagcactatcgtgctacccgtttttagtcacattttcattctaccacaaatcctggcaaccgtgatcttttgctatcattttctcttcttgagaatgttataaaaatgaaatcatacaacatgaaacataatctgtgtcactcagcatacaatatgaaacatttctatttcactcagatgtattcaagttgttgcgtgtatcaatagtttgatcctttttattaatgagtagtatttcattgtatgggtgtgccacagtttatccattcattagtggaaggacatttgggttgtttccaatttacggagattatgagtaaagttgctgtaaacattagtatacaggttttggggggtgaagttaagttttcatttctctagggtaaatatttagaagtgtgattgctgcataatatgttgtatatatttaatgtttcaagaaactgccaaacttttccagagtggttgtaccatcccaccagtaataaataagagatgatccactttctctacatggccacaggcattttgttttatcagatattttttactttaaccattctaataggtgtgttttcataacaggtttggttttcatttgcattcccctaatggctaatgaagttaaacattttatcatgtgtttattatgtcctcttcagtgaagtgtctgcttaacaccttttgtgtattttcttttcttttttttctgtagtgttttttttttctttttttaattatactttaagttctagggtacatgttcacaatgtgcaggtttgttacatatgtatacatgtattttctagttgagttacttattttattaaattttgagagttctttagagttgtagtaaagactactgtagcttgtcttttcattctcttatcctagtctttcacagaacaaaagttttaattgagatttagtttatcactttttctttttatggatcatgattttcatcatgcttggtgtcatgtgcaggaactctgcttaactccagatcatcaggtttttctctttgttttcttcacctttttattagggcttgttgtattttgacctaatttttttataagatgttagattgaggtgaagtttcatttcttcaatatggatgtccaattgtgccaatactgcttgttgaaaagactattctttctctattgaatatatttgcatttttgtcagaaattaattgtctatatttatgtgggtcagtttctggactttgttccattctgttgatctgtacatccatccttttgccaataccacgtaatcctgattactgtagcttgatagtaagtcttaaaattggaggatgttatttctctaattttatttttcaaaatcattttggctattatagttcctttgccttttcatataaattttagataatctatttatattaaaaataatcatgctgaaattttgatttgatttgtgttaaatatgcagatcaatttggagagaactgacttcttccttaaagtgttgaggagtcttccaattaatgaacatggtgtgtgtttacatttatttaggttttctttttcttacatcagtgtttcataatttcagaatacagatcatgtacatagtttgttaaatttacacctatatatttcttctttggagataagaactgtgaatggcttgaagtttttttcttttaatttggtttccagttcattgcctatgtagacagtcttgttttctgcaaatagggacatttttatttcttcctttctaatgtgtatgcctgtaattcttttattgacttattgcaagacatcaagagaggtgataacggacattcttggctttttcttaatcttgagaagaaagcatagtctttctcctttaagtgtaatgttaactgtaggtttcttgtagatacgctttatcaaattgagtaacttcccttctattcctggttcgctgcaagttttcatcatgaataaatgttgctttttttcaaatgctttttctgcatcaattgaaatgatcatatggttttactttaatctgtgaatatggaggaatgcactaatcaatttcaaatattgaatcaggctttattctctgaaaagcctcactttatcattttctttttgtatattgctaatattttgttgaagatttttgtgtcgatgttcataaggtatgttagtctataattttttttctttttctttttcttttattttcttcgtactattgtcctatggttttggtattagaataatcctggccttaaaaaaaatatttaaattggtgttatttcttctttaaatatctgataaaatttgcaagtgaaagttggtcctggagttttgttttgcttaggaggaagattttctaattcaatttaaaaatatttacaggaatattcaggttttgtattcatcttggatgtgtttagtgtctgattttcaaggaatttacttatttcacttctttaggtttatgtttacacaattgttcagagcattcctttatatccttctaatatctgctggttctacagtggtattctcttttcattcctgatagtagcaatttgtggcttctttttttgcttaccgatcctactacagttttgtccattgcattgatctttacaaagaaccagctttttgtctcactgtttttttttttaattttattgctttttgatttttattacttctttctgcttgctttgggtttattttgctccttgtttactgttgttttaatacacaattcagaattttgatctgagaccttcttttctagcacaagcatttaatgctataaattcccctctatacagtgttttagggacactccacagattttgatgttttttatttccctttttgatccatagattctctctaaatcagtttattaatttccagtgttttggagattttcttatctttttcctattgacatctggtcattatgatcatagaacatactttatagaatttaaatcctttaaaatttgttttgttttatgatcttggaagtggtgtgtctacatgaatattttgtgtacatttgaaaagaatgtgaatttcgtcattggggtgtgttctataaatctataaatgttatttggatctagttgttaatgttgcctggttcttctatatccttgctaattttttgtctacttgttctgtcagttaatgcaagaggagtattagaagcctgcaagaatattgtagatttgtctctactttttgttctgttcatttttgctttgcttattttaaagctctgttgttaaaggcatacacatttaagatctctctgttttcttggcaaattgaccctcttatcattatgcaatgtttttcttgatctctgataattttcttatcactgaagtctactttgtctgatattactataatcacgctagctttcttctggttaatgatataatttttcatgatagaattttttatccttttacttttaaactatgtaattataattgaagaaatttttgtagataggatattaatggggattttttttattatttttggtctattctgatcatctctgcccttaattggtttgtttaggccatttatatttcataaaatgttttatgtttggatttgggtttatcattttattatttgttttttgtttttctctctgtattttcactcttctggtcctctttttctgccttgttttggatcatttgaatattttttagtattccattttaatttagttttgactatgtatctttgtatagatttcttttagtggttgctctatggattagaatgtacatcctaacttttcacagtctatttagaatcaatcttttaccctgccaagtggattgtataaatctttcatgtaagtcttgttattctccctcctttattttatagtttttatatgtactacatcatttctcttcttcttttattcccgacattccaagtgtccctcatttcaccttctttatgacagtcttcctttagtaattcttttagaacagatctgccagcaatgaactatactttttatctgagaatgtctttattttaccttcgttttttaaaggatattcttattgaatttagaattttgagctgacagatattttttgttttaaacatgttccactttcttatggaatctatgatttctgattataactctgtagtccattgatcccctataattatatattatttcctctggctctttttagtatttttttaaactagtttgattgatggatttgagcctagtgtttgattgatgggttcgagcctagatttggggggttaggaggttactatttgaggttcagttcttaaatctgttggtttatgtctttcactaaatttgggaaatttttaaacattattcagttttttttctgcactacagctcttttccttctgggactccagtgacatgaaagttagatattttattattgtcctgcattatcctgagactctttattttttaataaatatttttactctgtcttattcaaagtggatagtttccattgatgtactgtcaagttcaccagtctttgctctcttatctccattttactattaagcccatccagtgatttttaaactttggttactgtatgtttagttctaaaattttcttttagtttttatttaaatatcttccatttgctgagacattctatctttccattcttttcaacagtgtttacccttacttcttggagcatttttataatagttgtcttaatgtcttagtttaataattctaacatctttttttcccaatgttgccattttttgatcatcttttcctatgtgacttgagactttttctgattcttcacatgccaagtaatttgagattatattctggatatttcaagtattatgttgtgagattaataagttaaataagactaatacttcgtcttatttaaatcctatcgagaattttgatattttttgcttaacaggcaatttatccagttgtattcgggatgcagtctccagccagtatataggttttgattccacaactggttcacttttcaaagcctttgaaatgctgttcagatctgtccttcatgtaccacccagggtccaatctagaacatgggtaattgtctgtctatacttagtttctcacagtctgtgatcagattcacacatgagaagtttgagcataaacccaagagttcataaacagccttatgaggtcactttcctgagcctctctctttcatgatctcagtactttgagttcctggagactctgcttttcagtcctctagccaaaactctgggactttatttaccctactttgccacatgcttcctgcatctatgcctgtagaagagctgaaagaagacagggagagaaagagctcagtggagtttatattgtactcttagggccacagctcctcctactggagaggaagttttccctccctcaaagttttaaattcttgcagttatcattatctctgctactaccttgaaggctaggatgcaagagaatgaaggagaaaagggcaatttttctcttctttgagacttttcctgctccttgagcctaaactataaggattctcctagagccttcactgccatgccccagggcccactttcaggttttaagctcccttgaatccaggccaggggtaccttttaaaaaaagaagaagaaagaaaaaggtaaggggaatcaccctgtgctactctgaattcttgtcatgtcatcttctccagtccacctgctgtgacttaccctttagagtctttaaataaccgtttccttcattctcaagttttattatctagattcagtagcagacataaacagtttgtggattctccatattaactggatctgacctcaggtatatatttttaatcattatctaagttaatgggtgttcatggaggttgtgagttgcatttgttttaactttgctatacagttacaccccaaatattcacatacatattataaattggaagatacaggagcaggaaaatgaaactatctggaaaagtatacagtgaaacatttcatctctaaagtttgaacacattcaggtctgaatttaggaatctgttggcattcgcttttttgatagttttcccttagcagggaatagggtaggaatagcagaaagctggctcagcgatgacttacagaatgagagagatgtgaattggccttttaaaaatctgtggaagttactcatttggactgggtaacggctttctaggcagagggagcaacttcaggaaaggtatagagaaggtccccaacttacaacattgacttaagacttttcaactttacagtggtgtgaaagaaatatgtattcaatagaaaccacactccaaggacccatgtaatcgtttctcattttcaatatagtgttcaataaattatatgagattttaatactttattataaaatgggcttcatgttagatgattttgcccaattgtaggatactgtaattgtcctgagcattaaggtagactaggctgaactgtgttgttcagtaggaccggcgtattaaatgcattttgacatgatattttccatttataacggggtttatcaatatttaacctcatcataagtcaaggagtatctatacaggtataaatgtgcatggcatgtgtgaatgtgtgtcaaagaggagtagacaaaccaggaaagggaaatatgattcagttaggcatttactgtgccttcttagaggttgcagtaagatattcccatgaacatatttgaaatggttagaaacacatgggtgtgaatttcaaaaaatacaagtttttgaatttaacacatatgctaaataatcagtccttcagcttaaactatgttatcctgcaaatgatagtaagtcttctggatttttattagaatgaatcacattttccatccttgtttttatttactaggaatttcatcttatgactaaaaagaacaagccataagctcttttggtctaaatttgagatatttgcctttgacttatttttaaattaaactttttattttgacataataatagattcacaaataatacagagaaatcctgtgtaccctttacccagtttcctccaatggtaacataatataatgtcacaacaagcatattgacattgatacagtcaagatacagagcagttctgtcactaacaggctctcgtttcccattacatgttcacccctgtccctctaccttgccgcattccttacccctggcaaccactaatctccatctttacaattgtgttatttgaagaaagttacataaatgaaatcatacagtatgtaaccttttagactgactttttcattctctataaattcttggaaattcatctgagctgttgcttgtatcaatagtttgttcttttttattgctgagtaatatttcatgacttattttttagcccacctttttccattatgtttcattttgaaaaaacaaagtcttactactcaggcatttttctcacttacatatttgctttagaatttatactataaacaaaaaccttaggagcattctagtgttctttttaaaattgcatttaggttaaccagttaatctgttgacattattacgtcttacaggaaaaaaatatgtacaagtagattttattactttactccccttttaattcctaaatccagaagtaagatcagaacacatgagagatactgctgcttgaaaaatacttagcacagcctgtttgcagacacactcatgctagtccacggctgatgcagaaaggagcctatcccaaggcagcatttttttgcagtgctaaaggccaacattaggatgttgtctgttttcattaggcaccatggtcttagttgctcaaccaaaactccagcctcaataatgagggaaaaaaatatacttctagtttttaaattgtgggaaataggtctgggagtagattctgaagtatgttaaatactcatctaaagagcctagaatttatcccaaggggggatgaagaaatgaagaaacaaataaattaatcaaattgcagttcctaaaatagttataagtagaaaaattagcagtgtccaaaaatgtcattttacctttaatatcaatgtcatattccatcttacgaggtagtaactctggctgttttgattttcattttagaagaataaggaacataggtttacaataatcagtaactatattaccatcatataattacccagttggcatactgtttattattttagtttaaggagacacattgaagcgagaaaaagggggtgctagaggtttgcagacacttagcaaacactagtgtttatcctacagctttgtaaacactttaccaagaatttttaaactgtcattttgctgatggaaagtgtaaaatgagacttcagcagaagttaatctcatcatctacttaaaacagtgttttttacattgatctaaagaggtttgtgcatattttaactgtttttcctatatgatcatcttcatgtactagtatgaaagttaatgagtaaagaaaatctgctgaataaatccacgtgataatccaaggcacttaaaagaaatacatgctataatgggatgcaaagattttacttgattagtgctctatttctcaatttaacaatcaaacctaagagaaatctcaatcaagacttttgactaacatagtgcaatttgattagggtgcagataagtacactatttcggtgtgactgtataagtattctgatcataattatgacatatactctgctactagttagaaaaagaacagtttttaacttcttcatgcctttcatttatgcacatgttcttaatacactattataataaataaaatgtacctgaaaatataaaacatactttttgcttgtccaaaaagtatgcatttatttataatacaaaatatttattctgaacctatgctgtatgatagcccactataaatgtagaggtagcaagggaagatgacagatatctaaaaatatttgttagtagcactatattgttgattactacatatcagtaattagaataacgaataaagtgaaagaaaaagcataatgccttaggtgtttactttgggcacagtaacatttggtccagtcatctttctagttttctggtacccaagttaaatgagcaagagtgtgatggaaagtgggctttggagccaatcagacctgcatttatatttcatttctaccacctaataacggcatgtctttgggcaagttatttaacttctccaagcctcaagttttttaacttataaaatatgttgttacaaagcttaaaagaagtaagttactagcacagtgcctggaacatagaaatttgtgctttagagaagaaataaaaatatataattctaccgtctataggtagagctcttttcccaaaatagtactaaaattccagtttgcttataatcctaaaatatttataattccagaatatctaaatctgtactgcttttacttctctaagatatcttcgtgagtttggtaagactgtccacttaatttctttaaacagctttacttttcaaggacacattaccatattcataaaaggaaaaaatccaaattaaatataatctgtactgaaagtttccttttcagatttcgggaagttaaaatgtttgtgacaactggatttgtttttttaatcttttattgatatataatagctgtatatatttggggagtacatgtgatattttgatacatgtatacaatgtgtaatgatcagatcagagtaattgggatatccaaaactttaaacatttgtctttcgtttgtattaggaacactatagatctattttaatttcttctttgatttcagcaggaaaggaagggcaagaaatcctggggcctgaagctcaggcagatgaagcaggatgtacaggtactctgctgcgactttctttcataccatagcctttaaaagaaggtctttgtgtcactgatttcgcatttgtgagtcctgaatttagtccgtttccttctcttttatcttaccttccttaaatgtttaagtacttaggcatatggtgcactacataaaaagaagtaaatattccttaaatacagagtaacttacagattcatattatgtagcagatttctccattctataagaatgacaagtataacctacagataatccaaaaaataagtgtttgaatgatgatttgaacttctatcaagtttttgaccaaagttagagaaatgcagatctaacttttgagtttcgttattagttacctgggtctgctttgaattgcccacaagacaaaaagcagaagaaaatagaaaaagcatggatttatctataaatccgatgagaatcatgaatattaatgagttgagtgaacatgtcacagcaaacgagaatcaaaaatttttcttaaattttctgtgattgaaaaagagtaaaatgaagttgaattataataaacaaggaaatttgcttttaggtgactaaaaagtacatattccctgaaacttaaggctattcctctgtaatggattcagatcagatttaagaagcaaaagagtaggtggaaaaattaaatcagatcttatgtatagtaataccagtcactttttattgtgttccctaagagagccagaactgttagaatgtaaacttcaaaaatgcattccagatttttaaaacatttcctcaaaatattatacttaaacgtagtgtaattgtactttgtatattcaaccataaattagatatttctgtcatatagttttaattacattttctttttccttctcttctatgagttatcatttatagatttgtttttttactttgctgtgcattttaggaatattccataaaggcttacaaattatctttcattaggtaagatgaggtatggttcatggctaataagtgtcaagattagatttttatctgtaatataaacaatagcactcctatactcgtcagtcatttctgtaaaacagagtaaatctttgtgctgttattaaaagtgaattccaaaataattaaataataatggagtatgtgataatttgtggtgcgtatagcctgcgattttatgttttgcccctaacttcgttctgtgtaacttgcatgaataatgtattcagatatgcttgttatcaaatatttgccatgctaagctatagaatatgtaaaatatttaagctggacatttgttagtagtaatacagtagtgttaataaacataagagtacactatttacttttacctagaatcgttaaactttgatgacttatattaccagaattacagaagacaacttgcccttctaggtaaaatgctatccaaaaagatgctcacaggtttacagtattttatctgtcatgctgttcttcactataaaaataaatgaattctttcagtttgaagtactgaatagtatgtaaatttcctcaaaaaagttgcatctggaaggcagggtaaccttctcaaatttgtgtttaacaaaagttgctgctgaaatgtaaaatctcccccacgtacacaatgatgatccctgctgcattattcgcctggaacatggggagttaggagtaagcaaacttccattaaagctccagtgagtgtagctttaaaaggaaatttagcttttgagacttttgagcagttaaactgtaaaatgatgtcctgcctttgcttttgttacttccttgacttctagggaataatatgctgacaaaatgagcaaaagcattgtacagcagtcgccatcattagttcagaatgttgtcagatcttttttatagcagacttccttctgcagctcgtgaagttaaggaactatagtctgaactcagtaatcagagtaaaaaattcattgaaaacatcctttgttccttctgagcgtccctttttttgtttatatagttgataattttagaaagtttcaaacatggaggataaagataagaggaagcctgaggatactttattcaggatggaaaaatagatagatagatagatagatagatagatagatagatagatagatagatttaaaaatattcagtgtttatattaaatatttgctctctcaaatacatgtatatagtcatttaattctatactttgtcaattttgagttttatcatatttaaagaaaacccaattaccttttatgctgtgtatatttgctcatctccctaatatttaaatatataagtttatcatctaaagaccaggacatttgctttataattgaccttttcaagatgtgcatttcccaacactttaaattttaaaaaactgcagaaattctggtctcagtttgaaattgggcctggtaaatgtgggttcatggatatagagtgtagtttaatggaaagagctcagattttatacctgacacctaataccaatttgtctgctctaatagtaatacattttctctctgtgatctcagaagagcttttctgaccctaatttttctattgaggaaaaattttaattgtaaaattatgatgttcaccttgcaggacttctttaaggtgtaaatagctaacaattacatagtacttactacataccaggtaccctactaataagtacattactatattaattaatctaattcttacaacaaccctaagaggtactgttatataaattttataggatgtaaacattatatactgtctcacaaatttcttaatggacatataaaatttttcattttaaatgtcagtagttacaatttaatttctggcagagtaaaacattgacattttaacatcactattacatatgaaatccatagtatattaatacctattatcttttttaaaaatatgaaaatgctctttaagaaatgttgtgtcataatatttactttttgagctcatatttccattctatatgcactatagaattttatgcaaacgtatattaattacttcataaacagtaattaattgtaatagcttaatattacttctagaaggaaaagtgttcatcattcagtttcttttttttagcattgaggtacctttattctcaaataaaaagatgaaataaaattttatgttataactgagttgctcagtttttatgcatcttcagctataatgtcaaaagttatttgtcaatgaaaatattttaatgtcctgtcagtatttcttcaattttgttgaaaacaaaatttaaagccatctaatttgcaaaaagatttgtttcccagtcattacaatcatctattccctcattttctgggacgtataccagaaagactttaccaatagttatttatcaaaggactaatgatacctgttttgggctttaaaatgttttttctcacagtcactttgtttaatgtattcagaaatgattaaggaaactgaaatatgttaatttcagtatcttttatcagtatatttttcatgaaaaacacttttattacatgaactgtattttgagcaataccttattggttcacccaatttctggaaaatttccaataacctacccagcaaagccagttatcaacatcacaccagccagccaagtcagacttactttctgtcaggaaaaaaagcattttttcgttttttgaactcagtgtgtcaatacatattttgaggaattctataaaatctcatcaataaggaagtgtatgaaggatatatttaaaatacaaaagttaaccaggcatggtgatgcacgcttgtaatcccagctactcgggaggctgaggcgggagaatcgcttggacccaggaggtggaggttgcagtgagccaagatcgcgccattgcactccaacctgggcgacaagagcgaaactcattctcaaaaaaaaaatagaaattatcaataatgaagaaaacataaagtataagtaaatacatcttataataatactaagtagtaaagtcaagattaagattatgtagatcgaatctaatttgtatgttaaaaaaatctttatctctaaatgtgtatatttagacctaatcaatgtataggaaagctagaatttattgaagtagcaaaattcatatataaaatacagatcatgcagttctgaaaagtgtatactatttaaaaactcattattccaacagctagcacacttataatttttattaggatgtagaaaatataagatggagattgcttaattgaaataaatattttataatataatttgataaaaataattttaactatcttagcaactctacatggaatctgtaagaaatcacataaaatattaatttcattttttacttttatctagtttaaattgaaaaattgaagttgctttgaaaagaatgccactgatttgttctgctttagctcttcagaaatgctttttgttctacctaatgacaaatcctaggaatgatgtttgagaatgttatttgctttgctcttatcagtctcctgaaaagcaatgaatttttaaataatagggaggtcattaagggaaaattaccctcacttcctctggccatattatatagttaattgcagcttcccaaccaggaccagcatacccccatttcagttgtgctttatgcctaatagaaattcatgtaaacaggaaagaccagaaaacctatagtgattctctgttgccttgatttgtcagtaaagaaggctttccctaatcggtattttgaactttactcctttggcaccctggaggactttacactccaagcagtgtaccataatcatgtcatggatggatagaggaatacgccttttctctttttttcttttaagaaagtgagaacaaggtatactgtataaaggagagcagggagaagaattttcaaggatgctaggaaagagtttacatggaagctgaggatccgggagttgattcctttaaacccaacagtccagcttacattttaaaagtcttcgcttacctctggatccaataatcccaatttggtaactactgacatgaactaaataatgcagttcttggtatatagcaaatgctaaataattgatagctattgaaaagtggggaaaaaaattaggatcaccatttgttactgtcattggttctcaggttttaaacagcagtcaccctgatgagtttggttaccgctacagtgcaggagatgtagcaagattgttttaataaccatcgaacaaacagatgcccatacatccccattttaatttggccaaacttcagcctgctggggagtgctgttttacaaatttagacctgacagttcagtcagagtctataaagaagtcatccctgaggcatttgggagccatactaaggcattgcagttgccagcatggagtagagaccctcttctggagccagtggaggaaatggaggaaaaccatagtgcagcaataatgctttagaaacttggcagcacgctgggctaccttctcaaagcataagcctttctaattcaagaaaagttgccactgccttaatcccacagttaaacatttactgaggcagaaatagagaaagaataggcttgttttatatgaatactagcgtagctaagaaagagttttcatagatttgataccctttgatgcttattagaaatccttcttactatagataattattaaaaactattttctaagaaatcatataactgaactgaacgtcagagtggtttatatgagaattattcagatttaaagtagagctcccccccccattatctgtgggagataaattccaagagtcccccattgagtgtcttaaataaatacttatatatactatactgtttcctatacatacatacatatgataaagtttaatttataaattttatacagagttgcaacaagaactataataaaatacggttataacaatatgctttaataaatttatgtgaatgtggtctccctcgctcgctctcaaattattcttcttgtactgtattcacctgatttcatattgcagttgaccacaggtaactgaaaccatggaaaatgaagccacagataaggggctgtctattgtccaactttaaataagtattatgatatgataggttgctaagaaggtgacctttgagaactaaagtttttttcttgctttatcattaattgagaaagaattcagtcaactatattgccttctctgtgttttattagtaaaatgcaatagaagtatgactttaacatttgaaagggatactgtgagaatttcacacattcatagcattttaaacttataaagcaaagatatatcttaatacattacaacaaaatgagtggaattcatttttaattttcaagaaatattttctgcagattcaagaacaatcatatgttctctcaagataaataatttcttatttagaaaacctttgtaataacttagtggtgagattgctgtcttaaaagtatgcattttttttagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggtaaatggatcttaacagttgtgtttctttccctctttaaaggattcttgtttctaccattctactatgggaacctgctctactatagggaacattcttgaagaccaaactttattacaggtgcctatagagagtaatctgttttattaatggaacactatgatgaccatgcagtaataaattattagctgctcatgtattgtggtagtaatgccactgcacgtgaaatgcttagaacagtgtctggacatcaaattccatttacttacatggtagcaggcagtagaagtgagaactatacctttactgccctttggattctttcccaccattcttttaacaaataaaaatatggttgtctgctttataccagaacatactaatttggaaacagtggttttcctgaatctgccttagtccactctgatatgaatagtcagcgtacagagtgtggaaaatgcaataaaaatgtgttcagactctcctgagaagaaataggctgtgatacagtttgggaggaaaagactatgttattgtttcaccagaagaaactaggttatcaaagaaatgaaagggaaatacaaaatttaaaaatatatgtatatttacgtaaaatttttatgtgacaaaaggctttcaaaaagcctcactgaaaggaaacaatgaaacctaaagaaatgatccattatgtagttctaataaaggttaaaccttttaaagtttgtcaggtccatacagtacgatctaaaaattgaggaactaccattctgaattagtttgaattatagaataagttgttgattttgttattcattactttcagatatttaatgtaatttaattaaatgctaataaagcattttgaagtattctgtcatatcagcgacatttgtttacatatttatccctttttataaccaaatagtattcattcgtgtgtatatgccacatttgcttcatccattgatgtacactgaggttgattccatatctttgctattgtgaatagtactgtaataagcatgaagatccaggcatctctttgatataccaacttcctttggataaatacccagtagtggaattgctggatcatataatagttctatttttagttttttttgagaaatctccgtagtattttcacagtggctgtcctaattttcattcccaccaagaatgtatgagagttcccttttctccacatcttcaccagcattcattagtttttgtctttaatagcaatactaactgggatgaaatgatatattattgtggttttgatttgcatttctctaatgattagtgatggtgagcatttttttgtatatctgtggctatttgtatgtcttcttttaagaaatgtttattcatatcctttgcccacttttcaataggattatttgggttttttaaatctgttgaatagtttgtgtattcttcatattagtcccttgtcagatgagtaatttgcagatattcactctgttgtttcctttgctgagtcttagcaataaagtctttgcctacccaaatgtcctgagtgttttctgtatgttttcttctagttttatggtgttgtgtcttatgtttaagtctttcattgatcttgagttgatttttgtatgtggtgagaaataggagtccagtttcattcttcacatgttaatattcagttttcccagcaccatttattggagagtgtgtccttttcctggtgtatgtttttggtgccttgtcgaaatcaaatggctgttaataatgtggattttattctgggttctctgttctcttccactggtctgtgtgtctgttttttactaatgccatgctgttttccttactgtaccttgtattatattttgaagtcaggtagtgcgatgtctccagctttgttctttttgctcaggattgctttggctatattggtcttttgtggttccgtaaaagttttaggattgttttttctgcttctgtgaaaaatgacatagatattttgatagggattggattgaatctgtagatcgctctgggcaatatgatcattttaatgatgttaattcttctgatccatgagcatgggatgtctttccatttacttgtgtcttcttcaatttctttcatcaatattttgtagttttccttggagaggtctttcaccttcttgggtaaatttatccctaggtattttacttttttgtagctactataaatgagatggtcttcttgatttatttctcgtctagttcattattggtgtacagaaacactgctgatttttatgttgagttttgtatcctgcaactttcagtttatttagcagattgcagttttttggttgtgtctttaggtttttctagatattagatcatatagtctgcaaagagagactatttgacttcttttccaaattggatggcttttatttctttctcttgcccaattgctctggctaggactttccaatactgtgttgaataggagtggtgaaggagtggaaatccttttctgattacacttcttagagggacgtctgtcagcttgttccatgcagtatgctgtggttctgtcatatatgtcctttattatatggaggtgaaccatctttgcatccctgggataaatcccacttgatcatattgcattatctttttgacgtgctgttagatttagtttgtgaatatttttttgaggattttgtatctgttgtcatcagggatattgacctggatagttttcctttttttgtttcatctttctctggttttggtatcaagatagtgatggacttatagaatgaagtagggagaattccctcctcttcagttttttggaatagtttgaggagaactagtgttagctcttctttgacagtttggtagaattcagcagtgaaccctttcagtcccggacttgaaatattcattatggattcaatctcattactcattattggtctgttcaggttttctatttctttctaatttaatcttggtaggctgtgtccaggaatttatccatatcctctaggtttttcagttttttcatgtatagttgttcataattgtctcttttgtatttctgtggtatcatttgttagtcttctttttcattttttatttgcatcttctctgttcttttcttagtctagctagtggtttatcagttttgttaccttttcaaaaaaaccaactttttgttttgttatttgtgttgttttttagtcttcatttcattgattttgttctgattgttattatttctttccttcttaaatcctaatttagggtttgctttgttcttgcttttctaagttcttgaggcacattgttagattatttgaaatgtttctattttttgttttaggtatttattgctatatacttcctcttagtgcttttgctatatttcataggttttgatatgttctgttttgattttcatttaaagaaattttaattttaatttcatttaaagaaattttaaattttcctccttatttcttccttgaccccgtggttattcaaaagcatgttgtttaattttcatgtgtgtgtagagtttccaaagttcctcttattattaaaatctatagttgtattactttgtggtctaaaagctacttgatatgattttgatttttaaaaatttgtttgagacttgtcatgggtcccaacatacagtctatcctagagtatgttctgtgtgttgatgacaagaatatgtatcctttagtagttggttaaaatgttctgtaagtgtctcacatccattcggtataaaatgcagtttaaattcagtgtttctttgttaagtgtctttctacatgatctgtctaatgctgataggggtgttgaagtccctaactattattgtattagaatctgtctctccctttagatctaataatatttcctttatatagccaggtactccagtcttgggtacatatatgttaagaattgttatatcctcttactgaattgattcctttgtcattctttaatgaccttctttgtccccttatactgttttgtttactggatttaagagtttatctcattatagctactcctgctcactatggtttccatttgcatggacatctttttctgtccctttactttcagtctatatggatctttacaggtgagatgaatttcttctaggcagcacatagctgggtcacagtttttatccattcagccaatctgtaccttttaagtggaaagtttaatccgtttatgttattattattgatatgttagagcctatttctgtcattttgatttctggttgttttgtgtatcatttgttcctttctttcttactgattattattgtggtttgatagttttctatagtggtaacatttgagttctttctctttcttatttgtacttgttctaccagtggattttatattttcatgtgttttcattatggtagatatcttcctgtcacttccatggataagactcccttaaacatttcttgtagggccagtctagtggtcatgaattctctcagcttttacttgtttaggaaagactttatttctctttcatttatgaaggataattttgctgggtatgatattcttggctggcagggtttttttctttcaatactttgaataaatatatcatttctttctctccttgcctataaagtttctgctgataaactgctattagtcgtatggaggttcccttacaagtgattggacacttttctcgtgttgtttttagaatatctctttgtcttttacttttgacagtgaatataatgtgccatggagaagatctttttgaattgtatctatttgggggtgcgctgagctttctgtatctggatgtctaaatcctttgctagacttgggaaatttttggatattatttcattaaataggttttctatcccttttgtttcctctttgccttataacacatcaaaaattcgaatatttggttactttatagtttcttatatgtcacacaggctttgttcattgttcttttattcttttttctcttactaggttattttaaaagacctgtcttcaagttctaaaattcttcttctgcttgacctaatctattgctgaagctttcagttgtcttttgtctttcattcggtgaattcttcaattccagaatttgtttagttcttttttatgatacttacctctttggtaaatttctcattcatatcctgatttgtttttctggttcctttgtgttgcttttctgttttcttctatctcacttagcttttataagatcattatttttaatcattttccaggatttcataaatttattttgattggaatctgttgctggataattattgtattttttggaggtgtcatatttccttcctttttcatgtttcttgtattcttaccttgataccacacatctggtataatagtcaattattctggttttttggatttgctttcattggttgagtagggcactttggctttgattctgggtacatgtggtagtgtaatttctgtatgatatctttcgttataaatagtgtgagtagggtccgtgatttcctcgttggcttaggtgcaattgttagtggaggctgaggtgaagtttggctgggacagggatgccaggtggaccattccttgggccctagcagtggtagtaacgggcttacagtacctgtccttagaccacagggtggcacattgacaccttgtgttagcaggtccagttgggctgatccttggaactccaggtggcttgcttgggtgctggtagtggcagtggtaagctgggcaggtgggcaggttctcaggctcctgggcagtggatgtcacttgggcaatggcagtagcagtggcaggacaccctctggttccctagtgattcacgctggtgttggcagtgactgcaatgggctgggtgagtcagtccccaggcctaccggtggtgcatgcaggagggtgccagctgtagtgatagtagcaggttgggtggacccaacctcaggcctccaggaggagtgttcaggtgacaacagtgttggactgggctgggtcatccccacgtccctgaatagcatgctcggaaactggggaggaggtaagctgggccagatggacctgtcctcaggccccttggtggtgtgtgtaggcattggctatcatggcaggggcaggatgatcccaggccaccagcagagtgctcaggtaaggacatcagtggttgcactgtggccttcttactggggagggcaaggttgctcttggtggcagcagccatagggagggagctgggaaatgtgcgctttagccccagacagcggctgtggatggggtagcctgtcctcaggtcccttataaatgcttagcagctcagctgctgaggaaattagggtcgctgccagtggctagcactttgtccccagcggtggaagcccacagtggcagcagtctgttggggagtctgtccttggggcatgtaaaaatgtgtgcagctcctctgctgggaggaggtatggtcactgccaatggcttgcacttcagccttagcagccgcaaccagcattagtgatgactgggaagggaggtatgtcagtggggctcaacaggatgtagtctgttgggggttgggctctcaaaatagtgctgtgctgtagctacttagaactcagggggtgtacagattcagcataagctccctctccggagcagcattgtcatgtggtctccacatacctccctgtgttagtctcagagcccacgatggtccaggggttctcccatggctaggattgcaggagtccatggtgggaatgtggacccctgggggtctctcacttactctttccctgcattggagagcctttgcaggttgctttacttccttcttccttacttgaggtgtttcctgtcacttttctgttgaattccagtgttctctcttagatgatctatgtgaagtgtgattattacctcattattttggtttttccttgtagaggaggtgagtaccagatgcctctattcagccatcttgaagcccctctctcaacatatttgaccaactatttaacattcaggtgctcagtctattatttgcagtctggtccttgagcaagacatttgatttatatggacttgaataaaggaatatatgttcagaaagcacttggagattttatgaaattatctgtggtggtttgtttttctatagtgaattcaaaatgaaaatagagatgatgtttacaaaaagatatcacttaatttatttcattgaagaaatgtcaaatatggaaaactactcttagttaaataatattaattggcaaaatattacattttaggattgtcaggcttagacagctccaagtgtaaaaataaagttcattcagtaaactaatttattcagaatgcctttgttttctaaaagctatatatattcatacatatacagttatatagcagatttgccagtgtatttcaataggggaaattacaagcagggtcatgcatgggatgtgtttatgtagcaggcctagatctggcccccatcagtctttccttccccaccttacacactatttttttggtctgaactcagtcctatggccacacctacctgcaagggactcttggaaacatagtgtgtgtgtactgtttactctttgatgatgatgacttggtagtttcattttcaaaatcagaggaataaacattaaataaataatgatacataccattgttaccaatagactctgttgtagagcacaaaattcccctttaatctgtatacacttacaaagacaacctacattctaattttacttttgttttcttttctagctaatcacatgacaaaagggaagaattatggtttagggaaaaagaatgggacttgaaggtcagacagcccgtatttgaaccctgacttcatcattttctggctctgtgacttttcttttaagttatttaaccttcctggaaaccactgttctctctcttataaaatagagatgagtatcattgcattgttttgaggatcaaatataaagtgggtagcacaatatctggaacatagcatagggactcagtggaaactttggtaatattttctgaatgttttaaatttaaaatatatgatctttcttttacaggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaagtaagtgcaatgactgagagttcactaactttccagattttgacaactcagccctcaatggaaggcaaggattttaatatatttgaaagttaaaagaatgtactaaacagtgctatatctgcagccttataaaagtgaaaatgattatttatttgagttatctggtcattcctgagattaaaaaccacatatgaacgttactttagaggtaactcagtattttgttcaggtaagaccctttccatcttgacttaattattttgcttatgccataacagttaattcttcaagtttagaagatgttaaattgcattctattaaaatgttcagtgtaggaaaaataagtactgactatataaaccacattatactaaccaaattgacaagaaagtcaaattaaaaagtttaagtttctttgaaccagttactatttattctcagtataagctacgtggtttttttcccccgtagtaaagggagttgcctcctctaaaaatctaaagtttagatttttttattctgaagactcaatttttatatggtttattctacttctgtgtcactgtgccccagttttcagaagtataaaccaagactgttttgtaactataagttacatttaaattgctggttctatatttaggattaaagtcaaaaaagcttttatcagttgttcctcttttacaaggtcctcatagttatcagccatcaacaatgaaattaatattgccttaattctaactttaaaaattaaataaattttcagccacacagggtttgtgagggtacatgttggggttaggccacatttccagtttcttacatcaaagaatgatgtatatctacatacctgaactctgccctatggatgtacctaatatgtgtcacatatcccatagagaacaagttagaccatttgctaaggtgatggctaggccaaacaaacaacaaaaaagaattgtaacagaaaaagaatgactgagcagagtcaacctatttccttagtactttggcaacagtactcatgaaataacaagataataagaagagggtggcaatcagggagaatagaaccaagattttataggtttatggtccataagcccatgaaggagcacttgaaacaggtgagagctccaagagaaggacgaaattaatacagagaagggacgactgaaggcaaactccgtctccttcctagtgcccctattaatgagtcttatcagagagaccagcagaagagtatgttttataccttagcgctgtgatgtggccacagtgtagacaaggcttgggaaagagcctactcacgtgacattcaggaagcagacccatcctgcagctgctgccaccatattccctctactccaagggccatcgtgaaaggagaggacagattgaactggtggcgaaagcagaagatgccattataaaaacaaactccaaaatctttgatgagcatgaaaaccaattctatgatgatttttccagtgggtgcaaatgtagtaggatttacatataaaccgtgggtcagactaaggtcaggaaggagctgtgataaatatggggaccagtaatgtgaggaaatataactgggaggtcttggaaacaatttagtttgcaaggcagcaaactaaaaggtagaatgtatattttgctggcccttgagaatcatactgtgactaacaagcattttcaagtcttattaacttgtttattcaacaaacatttgtgtttcttttatatgtgaggccctcttctgggtgttaaaggcacagtagtcaaaaaggaagtccctgatattagggaccatacattagtagattatataaaacagaaataaaataatacatactgtgaagaaaaatacagcaggataagaggatagaaagtgatgaaagctgctaggtttcacagagaagggagacttctctgagaatgggatatctgaatacagtgaaggagccagtcatggaatattggagaagggcattccagtcagaggaaacagtgaaacataagaaagccttgaggccagaacctgctgggcacacactgagaacagcagaggccagtgtgaaagggagaaaggtaaggccagagaggtgttgggggctacatattataggccaagataaagacgttggattgtattctaaagtgcagtggggatgcctgtcaaggatccaggaatttttaatttttatttttaggggaacactgactgttggatgatagataagagagacaagaacggaagcagggagatcatttagaggcttttgctgtaatctaggccagaggttttggtggcagacagataaataagattgttggcttcagaatatgttcatatgcttgctgatggattgggtgagggtacatgagtaagagggtaatcaagaataactccaaagtttaaggcctaagctataaccaaataaatgatagtgctattcacagagataggaaatactaaagacggagctggcttgcaggagggaaattaagagtttggtgttaatcatgttaagtttcagatctctatcaccttccaactggcaatatcaaataagcagttggttgtaaaagtctggagttaaggggagaggtttagagatacaaatgtgggagtcgccaccatatatttggtattttaagtcatgggttttagtgaagtaggacctgattcagagtaagtactaattctctttccttcctgtataaaaggcaaaggaagggagattccagctggaagagcatgaagcagtagttgagttaagccgttaaaggctgggtagaatcttagtagtcaaaattatgggaaaacacagtgaaggagtaagaaattatgtaaaccaaagccaaaagataaagaggagcaatatgtgtgcagaaaaccatggctcgctaaatgactgaggcatagacttgtcataaaaaactggtgaagaatcatcttggaaactcagggactataatcttggaatctgtagacttggaatctttattgaggggttaatggggatccttcagaagtttatgaggaggagttgatagaatgcaattcaagcagtgcttttgtaagattaatctaagtatgaagaatacatttgaaatatgtgaaaatgggaatttgataaaccagacagaaagctattataataatccacatttggctgaaaaaactggaagtatttttttaatcatcagattaaagtacattttggaaatatcaaatagaagagacaggataaagtacaggaaaaatcctgtcttctattcaggaccttgttctgttgagtgagctttagacaggttattcagtatttgtggatgcggtttctatatctataaattggaaagcaaacaagttaacctctagttcctagcaaagtatatattactttatttttactaattttgaatattgtttaataaaggatgaactctgatactttagaaagttggtatttttctgtatcaaattctgtccccactatcactatcctttttggtaataatttcaggagttacatttttgtgactgctacaactgctaataatttcaagagttagatttttgtgactgctgcaatttgaggtctttaagaaacaaaacaaaacaaccatcaggctcacaaaaatgtcactcttagtagattggatgttctttagtctaaagatcttttgcttttcaaataaaataccagttcttttcttacagagacatgtgacgcagtctgggtgtaatcgtaaattcaaatgcactgagtgtggaaaagctttcaaatacaaacatcacctaaaagagcacttaagaattcacagtggtaaatattttttttctttctataccctgaatatcatagcatatgtggtaataaataaatatcataacatgtaatctacgtacatgatcagaaactccttgcatttcttttggcatacactaattgggagaaattttatgtttattttatgttttattagagtcttaacctttgactaaagtatatcaaattaatatagtatgacatactccagatttcctaatcagaagataatatagcatgttttagtaagtacaacctgaaaacatattagctttctgatgaatgtaaatgtcattgcctcctttgcacaattagcaggggaatggaaaagagtatagagatacgatttgcacaagagaatagggaagtgaagacatcctttatttgagaaaagttgaaatggaactcaagattagaaaatattggagagctgatatagaggcaatgagagggagtgaaaggattacagcattaatgagaatctgaaagaaaaatgtgctcacccaccatcttcacctgtctattccatgtcattctgtaaattattacttacaaggttaatactattatgcgatgaaagtgttgtgtctattttaggaactcagagtaaacagagagctatatttgcatttctttggagacactacttgaacaaaagcgcaaaaggaaaacttgctggtatcccacaatgccctatgaaatctgttcatctcctgataaattttgatatgttattttagatttaaatcattttaatgaaaaaattattaaccatgaatgggaaattatgggttttcacacattgcttattttgtgaaaattatgtattgacatttacattttacaaacatcttcctacaaaaaaagtatagttggatagctttgtgaagcatagttgatgatatttatgttttattttggaactgcatttctaaaagttttactgtattgctcattaaggctaaccctcaatgttaaacgtgctgaagttaccacttgaaaatgctcaaaccaagatccttaccaaaacatttattttcacacattgattattgtttctaaaaagtagaggttgtcttttgcagcctgccacaatattctgtttcttagcttctatgctattgaacaatttttatcaataataatatattttaacaacctaccttcttaccagagatgatttaaagttgttaataaagatatagctaattcaagagggatttttaaatgttgaaatcagggcagaggaaggaaaataaagctaacagtaagattcatgtatataatgagtcatattcattttgtcatattgcagtcatggaagatttatcagatctataaataatacaaagttggaaagtataaatcagaacaaggattgaaatactggtctagaaataagaagttgaaagttaagcattggtatttaaaaatcagtctcaatcaagtagtaaatttgaatggcccagagcttaatatgagctgactgtatgctgatactgctcaaaagctaatgcaaatttaggccagatcatggaacacaaagctcccactgtactctgcactgtccactcattatgtatgtacttatttctgtcttgtttttaaaacatctaatgtgaggcttgtatacctttaacatagcaagtaattttaatttaaaaatatgtaggaaaaattaagaaacactaacatggagtaaattgttggggggacaaaatgaatgctgtgaaatgccatacatatgctggaagtggaccacaaattaagctctaaggtttaggaagaaaatgacaatcagtaaccaagacccagggtgtctgtaagtaaaaaaaaaaaaaaaaaaaaaaaaaaaaaaaaaaaaaaatcagttgctagaaaaaggactattcttccttcctgataccaagtccatagaaaacgttattccttggaacaacataaagagaaaagaacaaaacagaagttatataatcctcagaaatatccttaaaataacacagcagagaatttgatagggtttcttttttaaatcagattattcaatagaagccagtcatagttcaccaaagtgctatttaggaaaagcattgctccagggtggccacgtagatacagtttaagtacacagctctctgatggtctggttgattccaagagaagatttttgagcaaaggctacccaaagtgacatctcaggactggtaccagtctgcaaaccctgtgttactcattcttgagataagtacagaaattgagagtaagcatttagcatttattataccaagactttgtgacattttactatattttataaaatattggtccacagtagattggaaacttaaaaaagaaccaaacaaagccaactggtcattcaccacaaatagtttgaaaagctctgcctagggtatctaataatggaagagctgaatatcttttaggaaacctccataactttcttttcacatgacttttgaaaagatgttgagaatcaggatccaaaattatactctctaaaattacctatattgttgctaaatactggtacccaaaaaattttgatcatgaccctatgcagaaccgtgtgtgttaataattagttgattctacctgtaggaattgagctatcatgaggaaaaggctaccagacctccactcagattagagacaaaagaacacctgcatatggctgtggtccacccccaaaaataattttccatggtcttagtaatttttgcctggaaaatttttgtatcagatgcagccaaacacccaccttagccattaaaaaaaaaaaaaagtcagtatacatagtataccgaactttgagtagtgaaacttcctgatgtaaccttcaggctaaaatacttgtaaaccctaacctccatagataaattagtgatatgcctaactaataaactgtaaagctatgaagctagaaacaaggagttttaaattaacaaatatagtgactttggctttagaataattgttgtgtaaactttctttctggcaatgataaaatatcaagataatttttaacaataataatgataactagcacttattggatccttagctatgtatagccacatgttagttatttgtatgcattaattcatatagtcctcaggataaccctatggagtaggttttattattttctactttttactgatgagaaaattgaggctcagagggcttaattaacttgtccaaggtcactcaggtagtacatggcaaagctagggctgtgatgtagtcatcctgacccaaagtcattcccttacgtaccatttctgtccccctgttttaaaaaatagtctgtatttatagatgtttatctttctagcgtctctagaaggaaaataagcatgtagttcatgtaaaaatgttatcaagtaattaaaagtgttaaaatagagatgtactagagtatattccttgttttacccccactggaaacttttgtctgttgtattttgagaattgaatcctattccaggcatcgcattggaaaaatattgataaattggagaatccccagaggtgggttaacaagcaggtaagggttctaaaacccacatcctgtgcagaatgtttgaaggacctaggtatatttaacctatataagagaagtttaagaatacatatagcagctcttgatccatttgaaggtttgacttgagaagaaaagttacacttgttctgtgtggcatcaggacaaactaggatagggaaataggcatcatagctatttttttggctcaaactcagcctgtctcttagtagaattgcctttttaaaaagtgactagcatttgttgagagcatactaagagttttgctatataatctcatatgacccctataacagtccaatgagaatgtatctgcatttgcacattgaaaaactaaggcttggacaggttaagaaaatactatgtgatggagccaggatttgaacccaaatccatggacctcaacagaaccagacaggaccatcttgtgcagggctgtccagcaggtcctaactccccttttattaaagaagctcaagcagagattagctggtgtcaagaatgatatgaaatgaactcttcattgaaaaggaggctgtactacaagggtttcttaaatctcttccaattcttatatatgattcttcaaataatcatatttattagaaaatataactcacatgtttaaactatagcattgaagttactattaagcaatttttagtagggcttaaattgattcctcactgctttcattttaattcttaaaaagagcaggagatggagagttttattttgatactaagtagacaaatcagtgtcatcacatctcatcattcaacaattagccattcactcatccaaaaaaggtttaatgagcatctttgcaacctgtactttgatgggtgcaagggataaatggcaaacaagcctcagaggctcctgccttactgaagcttatagtctgtaacctttaaattataaattagtgaactataacttaaaactcaaaggaaacattaggtttgtaggaaaatattccatttagctcggtgctttcaaaattttctaccaaagtatccctaacagccaaggagaataaatgccttttaccccacagagtctagggaagcagcttgagggaagcctctgcaagccaaaggctactttgacagtgcgtggcttttcctagcaagtcacacaaatgtgtttttctctgttttaatataaaaataatgttttatcatatccactgtcactaaaattgaaactccaaggtgctttgatacccactacagtgtttatcctgggagtatatacatttcagtttaataagccaatgcttatagaatatcttatataagttttcctcccattagggaaaaactattttcaagaaagccctatgggtacaggaattattattaatcaaagatagatattcatacttgttaagtcatatgggacattttacttatttttcttttctttaatatttctcctacagatggttgagtagagtaaaatatagaaaattatataggtcggtgaaatgggataagaaaaaacatacttgaaagagtagaatgtaattacttttgatacttgagaattatttgaagttataaagattggtggaaatattatacacatatgctgagaagattccatgattggttagcagaacatgtacctcagacttagttactagcgttcatcacatctatgtaggttttgaagctaaaaagtttattctaaatacagttctgtcacaagcatgcatggcagtcttctttttaaaattgataccgcttgttttagggaaatgaggatacataaaaatttatatgtaataattcagtgaatataatttgtttgtttgtttgtttaggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggtaaaaaataacctccatcctgaacctggctagtaatatgctatttgactaatttcaattaactttgtctaataaatatcagtcccgtagagccaactagattattacaaactgtcatttttaaaaggatcaatgtttgctttaacttttctggcatgatgtcttcagttggttgtttgctaatccagggtattgttaccagcttaaagtttgaaatgctattctactgaaagatgatttttaagtcccagctaaaaacctgtttgaagttagaaatcaaaaaacaaaattgaaatactcgctaattgggtttctgtttttatagctaaattcctaaaattagtaatagtttctgccttgattatggtcattaattaatgaaaatatgttcccattcacaggttcataccaggcaaacttatctatcacttttatatactaatacatctgtttataaaaggttttaattaaataaacaggaatgaagtatacaaagaacgcatcttgtgaatttactgatcattttatgaactgtgcataaacagtgttcagtcataatgtatatgaggaagtgtggctgtgaacctaaaaatacatatgcattttcctccttaactatcacagtgtttaccacaacagtgtttattctgtccaggaagaacccttgaactggtcttaccccaaaatccacaatagttttggatagagctattgtatgcctcattgtccagactttttccatgtcactgatgttgatgttttcccattttttccatcaatttctgatggaatcaaatgaatactagagacaaatttgatattttatgcaaatattttctataagtataataatttcaatatcctgctcaaacttgtatttgctgcttttgttttcccttaaatattgctattgattgggtttcctgtaattgtgataactcttgaaaaaaagttcttacgtgatcattgaattcctctaaatttttagtgtacagaacactttgcatgcctttgaatagaaaaagagccatccttagcatttcatagactcacgtgtcacgtgactagatcaagtagcagtgaaagtagaatcaagttacttcagcaccagggccactcacaaatgacagggacaaatggctgcacctctcttgcctcatagagccataagaaatgttgtgaaaaaccttcaacttttagaaaatgtgtgggtttgaggcaatggcgtggaacactctagataaggtaggaagatcttaggggacccagttccacaacaggctccctgcagggttatttggcttacataagaacgtgctgcccaaaattatctccatgagactgcctggagtttctaaaggttcattttgattagcaattatttctgttaaaaagatagaccctcctgcattgtttttccatcttgctccttagacaagtggtagagcacacctctctcttttcaaggagaccgtggaggttaaagaaccctgaagttctggaggatacaattgaaagaccaggttttaaaaatagaatgttagcttttgcttagtgaaacccagaatgagaaaaatgaaggcaaaagatgcagttagtaatgagcgattaattagcaaactaataagttaaaaccttctgcaaatttctcgtaaagtaatgattcacatgaaactaggtaaactctgttactatatattttacatgctttcttttcggtgtccttgctttctttccagtaccagttgagtatatgtctttgctatggttttgactgtgttatccccaacctcactcttgtctttgtcatctccacctgtgatctggccccacccttggggcacatgtgcagtgaagatcagtgtgcttgctttggtcaagtccttgaaagtataaaagtataagttaaagtagttctttatctcatgcttttatgtatatctcttgtttatcttttaatgttaaattacattttctcacacctttctccctctaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtatgtcagtgaacacaaacataaagtgtccatgatatgatatactggaagatgcaaaattaaaaactaaagttttagaattttctttctttttttttttttttattttgttttgagacaaggtctggctctagtcacccaggctggagtgcagtggcacgcaatctcaatctcggctcactgcaacctccgcctcccgggctcaagccatcctttcatctcagcctcctgagtagctgggactataggcacataccaccacacctggccaattttgatatagacgggttttgccatgttgcccaggctggtcttgaactaatgagctcgagccatctacccacctcggcctcccaaagtgctggtattacaggcatgagccaccacgcttgacccagaattaattttcttattttttacttatctgatctggccattttcacctgtttgcccacttctacctagtacttaaggtctgtgcctttcttttggttttttgcttcatctgtttttttgtttttttcatgacttatttcctttaagctgacacagcatttattctgtccgcattcatttaatgcaagcttatgctatattaataaaaacatagtacatagtacccattaataaaaaatatgagaccagtgggctaaagtcatagggagacaggatctggcttcataaaagaaaaagctgcttcataagcatgcggcaagctgtcctggcaagtcaagatcttttgttttaagtaagaagttctgcctaagaggttggactagaagattctaagatcctgtaattctgagatcctgtaattctgccacaaaatatgcctccttaggttgactcagggatggcaaactatagctcacaggccaaatgtgagcatacgcatgtttttctatgaggtaagaatggtagtttttgattttgtttttacatttttaaatgattggaaaagatgaaaagaatatttatgactgatgaaaattatgtgaaagtcaaatatcagcatccgtaaataaaattagttggaagacagcatcgcctattcatttacattttgtctatgtcagctttcatgctgttctacaatggcaggattgagaagctactacagagaccatttggcctgcaaagcctttaatactcactaccctttacagaaaatagttgccaactcctggcctatttcattccttccatcagtgaagtactgataaattttaacacctggttctctgaagggtggggaagccctgatttgtagtgtttgcagctttttgtggcataaatactcccatcatggtggatttcgagcttgaatgtgatgtcagcttgcagaattcctgaaaatttagcagtagactctctccagccagtacaaactggctccagcacactcctgtgtctctctctaacatgggttgctgtagaaggggctgggtttatcctgagctctttaatcccctacctgctcttccctgcccccactaccagccattatgactacagtatccatatttatctttcatattcttaactgtttcagtgtattttttactcttgtgagaaaagatagaattgtttttccttcttcaatctgtggattcatacagtgacacttggaaggttcttggagctaaaaactggttacataagagaaagtcacacctctcaaaatcagccccttgtaactcagtcctctggttttcagagatctaagaagagttagaaaatccccttcctcttcaggcaaagttaaatattagcaaatatcaaagtgaaaaatatatatgaaaaactacactatttctaaaattaaaaatcatttctgcatttgttagtgttaactgcttgatagctctgaaattggacattatcgatcctgactatgatcagttgttgccagtccttttcatgtctgggcagcaacactcctgtagcccatgcgttctcaggaggggcaatattgccctcacgggccaaaacttgtttcttagggggcaaaaaagtctgagatactacaatggctgtggttttctaaagaagctcagtatatatactgtatatttatgagttttatcgtatataaaaagtgtatagtaaacattaaaatttcactgggagcagagcttgtgactaggaaaacaaaatgactaaaaagggaccttgtagtgataatgaacacaaggtgagcagcaagtctgtccctgtctgccctcactgtgctcgttcactaccagacatctcctcccagctgcacttggcccattttccacctcgctgtcatgatgcttgtatttttggcatttcaatgtcatgtagctcccattgacctaatcatctgcacagcagagtgtagagcactacgttttttaatgtaaagaacaaaccaaattgcaatattatattacaaagagtttgggacctggaaatgttttaaaaatgaaactaataaccctcccctttctacaacatgaagtaccccaaaaaccgtataaggattttatttgctgaataccaccattttatttaacagaattcttattttgcaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcct

SEQ ID NO: 37784 - DNA, 210704 bp, Homo sapiens; identical to SEQ ID NO: 37783

SEQ ID NO: 37785 - DNA, 121144 bp, Homo sapiens
acggggcggacctcgcgcggacggacggacggagacggcgccgccacattcctatgcccgggagcggcggcggcggcggcggcggctcccgcgggaggcggcaggcgcgcggcgcggacagctgagcttctcctccgtcggcgcccgggcggacatcgcccgggccccgatggtttgagcttgcttctccctccctcccgacccccgtggtggcgaggccacgccatgtgaaggttagggccgggacatcccgaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacaggttagtggtgtcaccctttccctcccctcttcctcctgatgtggtccacatctcggtttttgttcccgattctcgaatccctccctccccgtgcctgtcttctcgtacaggttaagggagatgatgggaggctaggaagagaaagaaaggagaaataaggaaagcaggtttggtcttcaatgaagggcacgtgaatggtcaggtgggatttggccagattccttttattggatggcaaaatgtcccccccatcccccagtgagcaattttatgtttttacatagagtggttttgatttgtggtattttcttcattgtgttgcgtacatttctgcctcagtcataattgtgattacaccaccaagaaatctgagttggtttctttattattgcaagaaggtggatggtgcatagtactatattgattttgacatttgtaatgatggctgctattcaggctccgttggatgtaaggtggcctgtgtcgagtgcagtattaatttttgttgtcattctttaaggctgtatcagccttctgcacgcatgttaagttcttattaaatcagttatttaaaaccagcgttcagtttgctgactgtagggtgcagttttcatttcatattatcagtgaggcatattcttttttccaaatgtattttggcttcataaattaaaagaaacaaaaactccctactttgggaagttttttaatagatgagtttttcgaaggcgtgtgctgttgacacagaaattgtatagtacagtagcagttaaacactccctccataacccagtctttgcaaaataacaggaaaagggcctcccgttatgattctttagtgttgctttaggagcccatgttgtgaaatgttaaaaaaattagagagctgcttttcattggaagatgcttctgtaatttggtaacttttaagagtaattttacaagatttctgttccctagttaatgaagtttagatatatgaaatatttgttgaaaagttccctagtactcacaaatttccacatgttaaatatagggtttttcagggggagggtgactaatttccaattttaggactatgtaatgttttggtaaatggtttagttcagttttactgcttaaacttacacagctgagtattttcaggacttacacatcctacttaaatagcagattaatctcagtgtttggaaaatgatttgaatttgtttttggggaaacttgacattgatgtgattttatgtttatggcagccttaattttacttgaatttttatgctttgatattaagctggcatcaggaataaatatagtaaatccttttcaaattatttaaattttaaacatctctttgaaattgaatgtctagcgtaactcataggaagaaacacaaagtgttactgcctttatataaaaacattctggcaccactgatataagcagtgagaataatagatgtattttggttttaacttaagcagcacactgaagccggtatctatttggatggcaaatcaaggctatttaagtgcttagaaaacatggaaagagggaaatttacatagtcacctatgtggaaaagtagtatgtataaagtggaaggcaaagggaataagagaaatattttctttccatctggaactgagaggatacttataggatacagatatcaaaattttgccatgcatacacaaaagcttccagctagaaaatggcctactttctgggtatgtgtcaggcaggttcgtagattctagaccacttgaacatattgaacacacctgaagaagaaaggaaatgaagggaatctagtatcagtggaatctgatgtctgccaggcactctgctggatgctttgcagtaagttgtacgttagagattgataacaagtctctgatgtaggtagtgtgttccccatttaaaaaataggaggaaatcagtgcatagagaggttaactttcctactatcacagtgttagtaagtggcagaagtgagttttgatttgaggtctgactcaaaagggtaaaggtattggtggaggtggaacactgctgttagatacccagcactctgaatacattacttcatttattcctgcagcaaccctgtagatactgttctcattttgcagataaggtaactggctcacagattaatttgcacaagattaaacatctggcaagtgatgtgttctgcatgtctgactctgaagcctttgcttattactctataccgttctgcagagtaaccgttttatctgcaggtgtgaaaaatgtgcacatagtacatattgaagtctaattttttctttaaaaattgtacaaatcttaattcattttcagatagatgatattgttggctattacatttgccttggcagcagttggaatggatgaaaagaccatattcaaatgggatgaaaaacaagtttagaagaccttgagtgacttagtaacaatatattaatacattattaagaatgttatgtttgtacattttgtttattctttatcaacagtctttcaaaacaaatttatatggagtgaatagaaaaaaattaggaatttttttgatgtaaatattctttatttgctgcagatacacttatgcaggaaaggttaatagatagcatatttcaaaggtattacctaattatatttagttgttcaaaaaatcagcccagctttcaatatgatttactaaaatcactcctttaacaatgacttacagggtcttcaggcactgatttggtgttttctattagaaactttctaacttttgatgtactgaaaaagtagtcaattttataaccatatgttgtaaaagtcatttaaaatgatagctagaaatgtgagcatagaatgaagtaattgaacttaaaaaaaaaacactgatgttgtaatacctagaaagcaaatatggaatatttacttaatttgaagtcttaggagccttgaatcattttcttctctttacagtagtattacaaaagtattacaaatagcccaaattttaatagtttattttgtggaagatgcagatacaggtttgattaaatgaagaatacatttttatagatgaatttgaaacactaaatcgataatccaaattccaaaggaggaagtagttcaactatctgtgccttttctatatttgaagagcttaacccatttaagcaaagattttacagaattttctttaaatgttctgttctcttaaatcctttgggggaaatggtagatgcaaaacctcttgtgacactcttactaaactcttgaatttggaattcaaggcccacttcctagtgtcagtttatcacttcaatcttctcaactattattctcctttttatcccatttagtttagtgatataaaatatttcctatcataaatataccttgttacatttctttgtctgtcttaacaaatcttgctgtcaaagtcctgtataaggtctgactcttgtgcatatatgaagatagttgagagcagtgggtagcattgtggttaagagagacccgtagcagaggggccagtttgggacattattgcaagagtctgggcaaaagataaggtcctgtgtctttgactttgtagtcaacagaaaatttaccaataagaaaaaaaaaaaagaagttcatgaggtcttgaagtggtagggggcgggtatgataataaagctgctaatataggctgggcatggtggctcatgcctgtaatcccagcactttgggagaccaaggcgggtggatcacctgaggtcagaagttcaagaccagcgtgaccaacatggtgaaaccccgtctctactaaaaatagaaaaattagctgggcatggtggcgagtgcctgtaatcccaactactcaggaggctgaggcaggataatcgcttgaacccaggaagtggaggttgcagtgagccgagatggtgccattgcattccagcctgggcaacagagcaagactctgtctcaataaataaataaataaataaataaataaataaataaataaagctgctaatacttattgagctcctacactgtgtgtcaagcactttacacatactgtatcatttaaatcctcatgacagccttttgaggtggaaaggttacttattccaattttactgatgaggaaagtgtccggggacttaggaactcttccagagttacccaactaatggagctgggatctgaacccagggaatttgacttcagcctgtacttgtaactactgttctctatgggtagaagtcaaaaaatggaaaggaggcaaatgatagaaaaaatgttgcagagatttaatctctagtatttctaagtgggtacatgggaaatggtttgaatgaaaagggaatgtgtaagagggtgaggtcgcctgaggttttaagaaggatgaggttacctgagattttgagatttggtgactgacaggctgaattgagatgccattgacagagaagaaagtatagtaacactgaagccctggaaggagaaaatttcaaggagaatggtctgattcaacagtgtcaaatcctatgtgtttaagctatgcctttcttttaagagtttatgctttgctaggggaggtatgataaatgtataaccacagtagagttcagaaataagctaagagtcatataattggaaatatgacattcagagggagactggtggcgttaggatgcggtggggtggcaggggagaggccatttccagcctcatcagtggtctgtgaaggaagacctctctagtggaggtggtatttaagctataggctgaattgaaagtaggcatggtagatggaggaaatggtttgtgtgtagacatggagttgtgaaacccaggtagtgctaatgaaacaacatagaccagattgatgggatgaggtttatgtaatgaagcagtgagagagccagcttgaaagacaaacggacagaattatgtgaagggtgaggtgaaggaatttggtatttatttagtagttaaattatcctaagcacattggattaaaaaaaaaagaaaaaatactattaagtatattaaacatgtaatttgtgctcattattcttgtaagcgttttatatgcattatttattttaattctgagaatgagcctattaagtagatattattttattctaagactctaaaacagggtttctcaactgcagaactattggccagataattctttgttgttgggggctgtcctgtgcattctaggattttagcggcatctgtggcctctacccacctgatgccagtagtgttccctaccactacccctactcctaccccagttgtgacaacccaaaatgtccccagacatctccagatgtctcctggggaacaaaaggagcccaggttgagaatcactgctataaatattataagacacactattgtgatctaaaaaggtttttttttttgtatgttgaagtacaaattaattataagacatactgatttcacaaatattcaatttgaaaataagaatttaggaaatattatatgatagttcaccctttttaaaataaacaatgagacagatttagaggagttaactaacttgcccttgatcatacaacttgtaagaggtggaaacaaaattagagtctaagcctttgtgatactgaaatttgtatcttaacctctgagttacagtcttcctggatttttagtagagattggggttttgccatgttggcctggctggtctcaaactttggggtcaagtgatccgcctgcctcggcctcccaaagtgctgggattacaggcatgagcctttgtgcctggttgatgatgatgttaaaatagattgttgaccatgtgaacttattttctaatttacgttttatagaattttgtctcgtaacagattttgaaacagcagaaatattttctattatctaccctttaaaaaatagatgctagaggtctttatttatataggttcttgaaaatttattgacagttaaaaagtttttaaaaataggtatacaggtacagattcaaaactcaaaggtataaaagagtagatcttgtgagaagtcttcttcccacgtggaccctgagctagtcagtttctgttttaagcgagatgaaatcatcagaagatttgtttttagaaaatctcttggaatacacttaaaaatggttaaaatagtaaagtttatgtaatgtatattttaccacaatttttaaaaagatgtcttggaaacagtagaaaatgaattggaggagggccaagagttatgaaggaggaaaccacagggaagttattatgtttcaggtgagagatgatggcatcttgaatgtggatggtagtggtgggtatggaaagaagtggatgaatgtaaaggataaggcttggtgattgattggatatgtggaagaaaagatgagatcttgggaagtgttaagattgattctattttgtgagaaagggaacaatggaagagggccagtgtatgtgtttaagagcgggttggggggaaagaaccatgttgagtttgaggaatataaaatggtggtgtgtgcattaggcctgtggaaattcatgtatggagcttagaagacttcagggatgagagctataagtggtaattaaaatttaaaaagtaggtgactaccagtcactagtcacattttttttttttttttgagacggagtcttgccctgtcgcccaggctggagtgcagtggcgtgatctcggctcactgcaagctccgcctcccgggttctcgccattctcctgcctcagcctcccgagtagctgggactacaggagcccaccaccacgcccagctaattttttgtatttttagtagagacggggtttcaccgtgttagccaggatggtcttgatctcccgacctcgtgatctgcccccctcggcctcccaaaatgctgggattacaggcgtgagtcaactgcgcccggcctagtcacattttttttaaggtctcactgtcacccaggctgagtgcagtcatgtgatcaaagctcattgcagcttcaaatttctgggctcaggtgatcctcctgcctcagccttttgagtagctgggactacatgcctggctaatttttttgaaaatgttttgtagagatagggtctcactgtgttgcccaagctggtcttgaactcctgtattcaagcacttttcctgcctcggcttcccaaagtgttgggattacctgcgtgagccaccccacccagctgactgccagtcactttgagggagcgtatggagaaagaaaggacccaagacaggcgagccagcaaaggagctaggcatagggtaattagaaagaaaaccaagggaatgtggaggctcagaagactagggaagagaacattgaggatgaaggaatatgaggtgtagctgagaaagattaatcgaggactctcaaaaagatccattagatttagctacaaggaagttattgatgattttgctgagaacattttgaggggaatgtagagacagaagcatgactaggttgaaagtaaatgggagattgtatcaattatgccgtcctcacttgtagtaacaaaaagtccacctcaaattggctaatagtaaagaggatttattgtttctgaaaaagtcctcaagtgggatgggctttggttttgatttgatcagggctgtagcgtcatttctctgtgattcttttagctgtgcccttgttgatgtgtggatttcattctcaggctgtctagtctcatggtagaaaatggctgtagcggccgggcgcggtggctcacgcctgtaatcccagcactctgggaggccgaggcaggcggatcacgaggtcaggagatcgagaccatcccggtactaaaaatacaaaaaattagccgggcgtagtggcgggcgcctgtagtcccagctacttgggaggctgaggcaggagaatggcgtgaacccgggaggcggagcttgcagtgagccgagatcctgccactgcactccagcctgggcgacagagcgagactccgtctcaaaaaaaaaaaaaaaaaaagaaaatggctgtagcagttctaggtctcacatctatgtaccacaccattcagagctcttctctaatcactgaaagttctacactcttctcttgcttttttcttgctcttcaaacggaaggattgattatagaaaatctcaaatatatacaataacaataatctttcatgtacccatcatccagcccctgctgtcatcaacttatggccaatcttgattcatctctaaacactccccaccactgccaattatttgaaacaaattccaaacatcatgtcatcccatctatacgtgtatcagtatgtatttctgtaagtccactccctttttaaaatgtaattgtggcacagccatcacagcactgttgtcacagaattccatatcatcaaatcaatatgaacatttctgattgtctcataaatgttttttatttttattttacagttttatttgttctagttaggatccatctaaaggccatactttgtaattcgttgatatctctttatattgttgtgtttttttttctttttcaggtatatatgaccagaagattttttttcttaatgtataggctccttctccatctcattttaatcttccttgcagtttatttgttggagaaaccagagtatttgtcctataaagtctcctacagtttggagctccatgatattaacaagtttctctttgtcctctgtattcgttataaattgatagttagatctagaggattgattgcattcaggtttgatttttttttttttttggtatactttatacgtggtgtatagttctaccacaagatacttaatatctagttgtctctctatcatgacttctctatttattagctgaaatgctgttttaaaaataaatttccctttattatttggttaccctgagtgctgtgtgggaaattaccttgatccaatggtagcctctaagtgcgtgccatacaaaaactagcctagaggtcacagaacagaaagctcacagaacaacttaaaatgcccaaattatgtgatttgttaaatcagtttttagtgagaagcaagaggaaagagataggatgagttaaaacacttaggataggatgcaaacagggaggaaggaccacactccctgaatgctgcagtatatacatttcatgtgtcctgtctctactgcattagccttctctgctgatagtgtggtcaccaggaccagagctgaggtttgaacaaagaggcccacacagacataggccagtgccacacacttgctctattagacatgggacaaggaagcctgccacagctgtagcttgccacaagcctgatgatagccatgggcattgtgttccttgggcagaggacacatgggccagactgggcatcatcaatgggtagctgaattaaggactcatgaatatcatgctcatgtgttcattgactcttgtttagtgtcatgcatatttactctgtcatgaatatttagtacttagtatatttagtgtatcatgaatatttaatacataggtgcctcataaatattaggtatcttgttttttccatccctttctatgtttaatatatgtgtgctattaactgcttacctttatttaacatgttctatcaattatatgtttaacaaacttttaaaactagctccttatctatacttaaaatatctttgaacatttcatctacattttacaaactttttcatctttatttataatagaattgaatagtctcaaaagtaaaattttattacattgagatacagggaaagcaggataaatgctatattctttctctttatgggggggaaattggaccagactgaatggatcactggcccctgagaatctgaaaggaggtaaagaatagggagaacattccagagaatgtgaaaaggctccggagtggaagagagcatggtttccaggaactgaatgtgactggcagggataggatcattccattcttgtaggccagaggaaggattttaatccttagagaagtgggaagtcattggaaacccttggggatggggtggtgtgtgtgacatgaccaaatttgcttatgggaaataagcaaattctggctacagtagagaatggtttggagcggggagcagagtgaatgtgggaagacaaaatttggagtaaatatagtaattaagataaaaagtgctggttgcctgaactagggagaaccagaacctggagtctgagattgtgagaagggggaagactttagcctggattctgtaatggattttatttatggttgaaggagagggaggcattaacgatgactcctaggtttctgacttgttcggctcgatggattgtggtgtactttattgatataaggaacactgaaagatcatcaagtttgggagaaaagattggtttggggcattttgaagttttgtagctttttcaacataatttcaaatgtgtaagaatagtataaagaattcccaaatactctttacccagatttaccaattattttgtcccatttgttttattattctgtctcattccttcttcctacctcccacacaaatgcctgtatgtgtgtgtgtgtgtgtgtgtgtagagagaaagagatagatagatagatacatcttttttttttttttgagacagagtttcgctcttgttgcccaggttggagtgcaatggcgcaatctcagctcactgcaacctctgcctcccgggttcaagtgattctcctgcctcagtctcgcgagtagctgggattacaggtgactgccaccacacccagctaattttttttgtatttttggtagagaccgggtttcatgatgttggtcaggtgatccatctgcctcggccttccaaaatgctgggattataggcatgagccaccgcgcctgcctttttttttttttttttttgagacaggagttttgctttgtcaccaggctggaatgcagtggcacgatctcggctcactgcaatctccaactcccgggttcaagggattctcatgcctcagccacccaagtagctgggattacaggcacgtgccaccacgcccagctaatttttgtatttttagtagagatagggtttcaccatgttggccaggctgatcttgaactcctgacctcaagtgatctgcctgcctcagcctcccgaagtgctgggattataggcatgagccgccatacccagcaatgtatatataacgtgtgtgtgtgtgtgcttgcatatatataggatataaataaatatatataatatttctggaccatttgagaatatgtaaagagatattgtaccctacactccttcagtgtatatctcctataaaatgaaggatagttcctgaacataatctcatttaaaaattgggaaattttagctgggtgtggtggtgggcacctgtgatcctggctacttgggaggctgagacaggagaagcacttgaatcaggaggcggaggttgcagtgagccatgatcgcaccattgcactccagcctgggtgacaagagtgagactccatctcaaaaaaaaaaaaaaaaaaaaaaaagctacaagctacaatatgaggctatggtaaaggcagggaccagactaccagattagtcagttctctctaaatcataacagaatatttaacaaaccctaggagcaatggaaggtcactggtgtgtcaaaagctttccctggctaatagtaaggatgaaaagatggtgagagcacagaagtgttgctggaagtcacgcaagaggtatgggacctggaatgaggtaattaagatggagagacacagaggtgttcacagtctgtgtgggaatctgtgttggaaatagagcttggttataaattagatggagaatagggttgggctgtgggtgtaacaggtgcaaaactgagcctcagttgactcatttggaaatagcagagttgtggtttactgacgtggaagcactggattggggcagacttattgtgtgcaacatgggccacattaacttggaaatgcctgtaaagcatacaagggaagatatcacaaacataatctgtggctcaaaggggaggtctgggctacaaatccaaatgtatttttttaattttatctttcactttaaattaaacattaatgcatgaccgttgggggaaaaaaagcattaaaaatgaccatagagttctttctctacatgtgtacacataattattatttacaaaagaattatattatttttaatctgatttttaacattttgagcacagtttcttcaggtaaatatagattccttctgtgatatgtaactttactgagcatataatattgcttaatgtatctatactgtaaattattaacctggttcttattttaatatatatagatggtttctaatattttgctacaataagcagcactacaattaacactcttatatgtctttgtgtaatcacttagtaaaattcataattcataagaaaaaaaattgggaaatttaaccttgacgtgatactcttatctgattcacagcccgtattcagatttgccaattatgttgattttcattattgctattttatttcccaattcaggatcatgctttgcatttagttgtcatgtctcctttttttttttttgctgagatggagtctcgctctgtcgcccaggctggagtgcagtggcgccatctcagctcactgcaagctccacctcccaggttcacacattctcctgcctcagcctcccaagtagctgggactacaggtgcccgccaccacgcacggctaattttttgtattttatagtagagacggggttttgccgtgttagccaggatggtctcgatctcctgaccttgtgatccacccgcctcggcctctcaaagtgctgggattacaggcgtgagccaccgtgcctggcctagttgtcatgtctcttaagtctcctttaacctggaatagttcttcagtctgcctttgtctttaatgatattaacacttctgaagatagagcaccagcctgggtgtggtggctcacccctgtaatcccagcactttggaagattgaggtgggcggatcacttgaggtcaggagtttgagaccaccctggcaaacaaggtgaaaacccatctctactaagtggtgtgtgcctgtagttccagttacttggtccgtgcttgtggttccagctactcggtaggccgaggcaggagaattgcttgaacctgggaggcagaggttttagtgagctgggattgtgccactgcactccagcctgggcaacagaggcaaaactccatctcaaaaaaaaaaaaaaaaaaagatagagcacccttagctgtgtgctggctggatatcaagccccttccttaggcattgtcttagctcttgccaaacttttgcctgtgtgtctggtacaagcagccagttctctgcaggagctgactgggtgcctccttctttgtgttcctctttactctggagtgctgggccctggtttagcagatgtccccctccacccttggttcaaatgactgggacaatgatgagatccttacatgggtgctggtattgataggaatacctagacagtaggaaaaaaacaaattacacagagtcctgccctcaaacaagagctgatggagacccaggaactggagaccatctcctaaacccctactacttctgccctctggtgcaccctatcttttggctttcttccctctttcgtacttcccttcttccctctcttccattcactcttccctgctcccctctggcagacccactctgtactcctcttgcttgtcactgccactaccacgaccaccagttgtctctctgtcagcagatgtgccgtgttgcctctctgcacagtaccatccctgcattccacagaagacttgggcaagggtgcctgagaggtacccagagacaaatcacgtggcagccaggcagccccagagcaaagatattcagacagatgaaagtctccttacccccatttcttccaagatcagaacagcttgacatactccttcatacacagtgatgccaggaaggcaggggaggcgtgggaagtcttccttcccagtacctgcaaaatgtctgagcattatgttgatttttttcctttattaaaatgtactgtttaatcttataagaacaatatgcctgttattttatagaatgtctctaaatttggatttgtttaaggtttctttattcaagtttgataaggttcaagttatagaagcctggtagactactgcagaagagatgttgtagtctcagtaaatcatatcaggggacacataatgtttgttccagtataggtgatgttaactttgatcacctggtcaaagtggtatctgtagttttctccattataaaattatttttccactttaaattaattagtaatttatagggaggtaattcaaaatatcctgttcattaaactgttacccaccattttagaatccagtaatgatcttgcctgaaccgattattgctgttgattactatcctttttttccatttgtttgttggtattattctaccacaagaaagagctccttttttttttttttttttttttttttgagacgaagtctggctctgtcgcccaggctggagtgcagtggcccgacctcggctcagtgcaagctctgcctcccgggttcatgccattctcctgcctcagcctcctgagtagctgggactacaggcacccgccaccaggcccggctaattttttgtatgtttagtagagacggggtttcaccgtgttagtcaggacggtctctatctcctgaccttgtgatctgcctgcctcggcctcccaaagtgctgggattacaggcgtgagccaccgcgcctggccgaaagagcttttttaatgtattatttatttgtgtcaggatagactcattgatgcgtgttttattcagtgggttataattctttattatgtattctgatgttggtgttttcccagttttagccaatggcatccccttccatctggatcctgtgttcttttgacatggctccattatttgttagcatttccttactttctggcacataccacaacaaagatgttctaagcatatcttatactttccctgctccagacctggaaacatttcttcaaggagcagtgttgcttttggtggggaaggtattagaaaccaagatacaggtgctaggcttattgctaacagtgttatttagcagacagatagtaaacacacacatatatacatagtgtatagctaaatctatttcttttgctatccatataaataaagagatatatatctgaagcatcatgtatttataatgacacttcccatttcaaccagcaccacagagtttattctagtttttcctttttccatatttgtaactcccctggtcactgagaaacctggctcccattttgagttaggtttctttgtgacacccaagtgaagagctgagtaggctgatggcttataaggatctggagctcagaagaggtgctttggccttatagggtaatgggaggagtagaggtgataatttaagctcaggaatgctgtaccacacttaccatgttaggtaataatgtagagggcaggagggagctaacttttaattggtaccttcttggaaggcaaggctctatgtgtaggtaccgtacagtcttggtaaatatttgagtgcgtactgtgtttcagacgcagttccaggtactagtgacacaggacagataagtatcttgctctccttcaggtaccttatagtgagaggaggtagaaataaaatattatgggatagtaatagttgttatctagagaattaaactacaatgagtgactgggtggtcagggaaagtgtgtttgaggaggttacatttaactgagatctgaatggaaagagccaaccattcattcggttaaggggaggaacattagaggcagaaggcctctagtgcatgggccaaaaggtctgaacctggcatattctagcaacaggaagagttgggtgtttggaacatagcggcctggggaaagtggaggaagttgaggtcagagtaggagtaggcagtacatttgtggaatatggagaaactaaaactcagagaagttaattactgaactcaagatcccatcaagtaaatggctgggccgggcatggtggctggtgcctgtaatcccagcactttgggaggccaaggcgggcagatcatctgaggtcaggagtccaagatcagtctggccaacatagtgaaaccccatctctacgaaaaatacaaaaattagctgggtgtggtggcacatacctgtagtcccagctactcggaaggctgaggcacaagaattgcccgaacccaggaggtggaggttgcagtgagtcgagatcacgtcactgcactccagcctgggcgacagagtgagactctttctcaaagaaaaaaagaaaaaaaaaagaaaaaaaagtaagtggtgaaattaggactcaaccgattcttttaaaatctaaagcctatactttctcaaagcccaaatttttccaaattttggaatggatgcaggtagtgaatgtaggtaaactgaaaacctatgtggttttgagagggattgctgtcacagaaattaagtgtggcccagagaaaactaaagtttctcaaagcgtgtacaaggagtaaataatgattactagcacagaatcaggtagtaaacttgagggggaaatttgaaacctgggagtactttcaggaaaaggctagtgactagaattttttttaataacatttttatttattcatcaaatctttccttaccacgtaccaggcgctgagttaggccctagagattcatatcatggtaaatgaggaagacatgatccttgccctttggtcatatattagggtattcatatcggtacacccttgtcaacagtgggtttaaactttttttttgtttgtttgccattttgataactttaattactggtactatgaagttttaaatgttattgatcatctttatgtcttttggttaatttcaagttcagattctgtggcttacttttaattggagttctttgaaacttagaagttctataatagttattaccttagaaactattttttagatttggaaaataaggtggcattcctatgatttagtgtgatgatatttctaaaatgtactcccctcctgcttcctgcccctttattgcttttaataaatctgtgtcacttgctggaatgtggatgcaactggtagctaacccagttttatagaaaattgccttgagcagtactgtctctgctccctctacctgtacctcaagcatttcaggtggatgttactttcaaaacttaggtctagtcaggacttatagtagcatgattaaattatgttctgcttaagtcatggtatacaagaaaaactcatctcatatcctttgcaattctagcagtggtatttcattcagctgttctgtctgtattaatttcttactttttgtgttctggaggttagggagagagtgaaaccccttatctttgattttgctgtttattttctaatatgctgtttcagttcatttttttttaatgtggtacaattccaaactttaaaaaaaataatagttttataccattggtaaaatgatagacacatttgaagtcttctcttaagtatatttagctcttgaagacttgtttttaaaatgacctattttatattcagtatgaagttttacattctcttgagggctgaaaaatctatttttgttgtattcttgaaacagtctttgattagctgtggatcctttcccttttccttgcattggggtctttttaaaacttacactttcacaacttaggttagtggatatgctttaatgaaatggaagcaacccctggactcttgtcttccaccttccacccttttgatcttggcaaatcattattatgtttgagcctgtttagcaagatggtgtagagctataattctgtgcttatcagctatgtgcccctgggcaagatgtcctttcttgagttctttatctgtaaaataaggtaagagggttgtcagaattaaatgacagaatgcatgtttaggactgtgtctgacaagatgttataaaggtcatatatgaaaatggatgtaaaagcagtaagtaaatgctaggtggatatataggtatgatagataaatttgtaatcctgataatgagcatttacttttcacagctaatatttagatgccaaataacttatattagccattttttactgatacaggaaataaaaatccattgtttatacatttgataagttatcttaaaatcaaataattttccttttacagctgttctactaatagtttctgtttatttcctacaatactaaagtgtaaatgaataccagcactatattctgcaatttaaaactgaacttcaccatcacgctgaggcagctatattaaatttaaagctggctcactactgggtagtgcatctacgaagaaaggaaagtgttttcaattattaaatgaggatgatatttttagatgtcaccaaaatcccaaattgatacatccactcttgacctctttccagagtcctatatctccagctgcttattggatatttccacttggatatttttgctattgtttcaaactcaatatgtctaaaactgagtttttgatcttgcttttagaattggtgctgcctctgattttcatttttctattaatgatatcactgtttccctcataacgtaggcttattattgatttccatcttgaccctctttctttgctttattcctgggtactttttgtttgtctttagcagttagtctcttatgtcctatactttctgttttcactactgcctttgaacttcatttccttatatctatatggtaatcttctatctctgatttttatggccatcaatattaaataccagattgttccaaaacgtcagtcttaatgtgacactgtcctgtaaaactgtcagcacctccttgttagctaatatacaaagtcctcgtgtttaaaagatgaatatttctttcaagtcctcatcacgaacctctcccattccagctttgcctcttactgctttcccacatgaactcttctctccacccagattgttcaatttggtgtctcttcacatcttttttccctactctttctctcctccctctccttacgtttagaaaggctcttttttttctgactaaaattctgccgattcctgctattctattttttttttttttttgagatagagtttcactcttgttgcccaagctggagtgcaatggcgcgatctcactctctgcaacctctgcctcctaggttcaagcaattctactgtctcaacctcccaagtagctgggattacaggcacctgtcaccatgcctagctaattttgtgtttttagtagagaggggtttcatcatattggtcaggcaggtctggaactcctgacctcaggtgatctgcccacttcgacctcccaaagtgctgggattacgggcgtgagccaccgcgcccagctgcagatttttcgaagtaccagttttggttagtattgtggcattattgagcttatattaaagctgcctattcaggaaacagctaagatcagtgatgggatggctggcttcagaacctcactttctagagagaaggcaggtgagggactggctaggtctcaggacagagctatcaggttctataattgcagctccatgttaacctctaactcagaagccctacctctgggggacatacctcatccttgtcctgcttcgatgagaggtatagagcccaggtaagaaatggagaggaggaggaagagatacagggtagaataggcaagaaaacttgtaaaacaatgagaagtattttgtttctctcgtttgttttggtaattttgctgctgtcaaatacaaatgcctttgcttaagttgatttgggagcagacattgggagagtgggagtggacattggaagagtaggacttggcattcttaaagggtagtggctagcaggaaagagaaacttcggaggagattttggttttcttcccatctcccatttctaaactactacttatgttttagtcgaacttgtcagttgggtgcccaggaagtctttttcaggtaggatggggagtggtcagtggtaatgtggcaatatcagtggtttactagtgtaagggatttttaagagtagttctctcctaaacaattgctataattctttttcagtagtgtcagcaagctaagcatgaagggagagacggcagaggtcttgaggcaaagagatagaataagttaggcagtctctattctgcagctcattagctgtaaaactgggcagatgattttgtattctcaggtggcaaggactagcagtctcctgaaatacctattgtgcatttccatgttgacagcttgcctgtgaggagcgtcattgaaattagtttttaggaatcttatagttcattctgtagatttgactatgaatgtgggaatactttcccaagagccactagactcagaaagcttttctccttgtcttgtagtccctttttggaatatactcagaaagtatcttctgtaaaggaaatttgtatctttgtctcattccagagtatatgtcaaagtttaatgaatcatcttttcagttaaagggttattgctatatttttagagggaatcttaaattctatgacataaataataattattaattaaattctatgtttcttttataaaaatcttgtaagagaattttttccattaatctttatagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggtgagtctttatatacccaagattattttaagtttgaagtgtgtacttttgagtgtgaatgatatactgtaaaacagagggaaatgttttgaaattggattgtatttttgcctagagtttacaactcatctttttcttaaccttgtttccaaatgaaggaagattttaacgattttggaatgtttggtgccatctaataccttggagaaacaactacataatttccaactaccttaatgtaattttaattgaaaacttttattttttccgttgtagagactggctagaagagatggaaaatgcatccttgactttatcattaggaaagagttgagattaataagtgctgatttatggccgggcgcggtggctcacgcctgtaatcccagcactttgggaggccgaggcgggcagatcacctgaggtcaggagttcaagaccagtcttaccaacatggagaaaccctgtctctactaaaaatgcaaaattagccgggcatggtggtgcatgcctgtaatcccagttacttgggaggctgaggcaggagaatcgcttgaacccaggaggtggaggttgcggtaagctgagatcatgccactgcactccagcctgggcaacaagagcaaaactctgtctcaaaaaaaaaaaaaaaagctcatttatgtacttgaataacttcttggtaaatttctgcatatcagatattttcgtttatttgatagctttgaactcattcttgtagacaacacacacagaaggcctctaagctggcctggggccatcatgcaggaactctctcataggcagtctcaggaaacataaatctaaatgtttaagttcattgtatgctggttcagtccattgtactgctttagcttgagtttcacaaaatgtggacatcatcaaggatggtattagaaagaaaagtggtttttccatactcgattaaatcaaagagtagtagttttgcttgggaggaaggtaaggtgtatatgtagaaaagtatattataaaatttatgaagttatgtaatttaggaagaatgaacaaaaaaattagtttataaaatctattactaaatgaggtgatgacctgttttgttttctggtttttttccttctttaaagtaactcttttaatatttctaagtaatggaaaataatgtattgattagttaatggaatttatagatttacaatatagttattaacaataactagaatattgattatccagtatgagattgtcatctttcattgatggctccaaaatcaccttatagttaccctctgactttggcatacctgctttgcatacatatcatatgtgaacagtttgcccataccagggacaagcagaatctacttaggtccttatcagtgtctcatattcatctcccccagaatcattcccctagctggacactccagcttgtgattacttctgcttccgttgtttgaaggctaagtggatagttagaaagcacatccatgactttgtgaagcagtgtttgtttagttgctgttctttcagatacagatatatatgtcatagataacctacttatccttagagtgtctatttcagatcctctaataagaatgaaacaaatttaacatgttttctacatttttttccagtgtagtttgtatgtgtgaaatacttggacaattaattttaaaatgaggggtttggtagactgctgattgtgttactcatgtttctttcacactttattgatcctgctgatagctttgaatgtattttaataatatttaaggaatggagtttaaatgacttagaatctttttttttttcttagttggagtctcactctgttgcccaggctggagtgcagtggtgcgatcttggctcacagcaacctcagccttctggtttcaagcaattcttgtgcctcagcctcccaagtagctgagattataggcgtgcatcaccatgcccagctaatttttgtacttttagtagaggctgggtttcaccatgttggccaggctggtcttgaactctagacttcaagtgatcctcccacctcagcctctcaatatgctgagattacaggtgcacggcatgggcaacatagaatctttatctctggttctaacttctatttgtggattgttagaacttgagaacttcaggctgggtgtggtagctcacgcctgtaatcccagcactttgggagacaaaggctggcggatcacctgaggtcaggagtttgagactagcctggctaacatggcgaaaccccatctctactgaaaatacaaaaattagccagatgtggtagtgcgcgcctgtagtcccagttactcgggaggctgaggcaggagaatctcttgaacccaggaggtggaagttgcagttagccgagattccgctactgcactccagccagactgggcgacagagtgagactttgtcttaaaaaccaaccaaccaaagaacttgagaacttcatatttgacctacatcatcttaaccctttgcagtgtcacatttaccaacctgtgttttaattgtttactttcaacttttatcacaatttgatttaaagttttccagttgctgtggcattttgattgatgatatttaatgtaactattttcctgaaacctgcgtgagaaaatttctcagattactagtaaaaagttgttccttaagaaactatgtttttggctgggcgtggtggctcgcgcctgtaatcccagcactttaggaggccaaggagggtggatcatgaggctaggagtttgagaccagcctagccaacatggcgaaaccccatctctactaaaaatacaaaaattagccaggtgtggtggcaggcacctgtaacccgaggtcgggaggctgaggcaggagaatcgcttgaacctgggaggcggaggttgcagtgagccgagattgcgccactgcactccagcccaggtgacaagagcaagactccgtctcaaaaaaaaagaaagaaactatttttttaaagagtaaagtaagagttaatgtaaattaacagtttttttttcctgctttttgggaagtatcatgaaaaatagtgtgtttaattgcactgaatatattgccccccacttccacttctaaattatttttaatttgggatattttatttctgtatgccagccttttggggggaaaaaaagtgtggtggtagcaaaagtatcatcctaatttttcaagaaataatgttagtactaattctttttcttcaaagtctcagtataaaaatttcctgtgaaataatatatatgaagacagaaatctttagaagaatttacaccagactgttaactttggtttcttctgtgaaatgggattaaataggattggagaaataaatggtaactttcatatcttatttgatgtatttctgcactattaacatttttatatgattttactgttttaaaatttaaaatgtagagaagaaatttaaattcaaatagaaattatcattatctgaaataacatgccttgtatgcatactaaatatttctgatagttaaattgttaaagagaaataagtatcctgcatttagcctttaagcagacataggaaataagaataaatattgaagacctctctaaatggttaaattccaaatatcccgtaaatggcaattcaaacctttaagatatcttttctgtagttccttttagtaatcaatctttaaaaagaaaagatgtggctgggctcagtggcacatacctgtaatcccagcactttgggaggccaaggcgggtggttcacctgaggtgaggagtttgagaccagcctggccaacatagtgaaaccccatctctactaaaaatacagaaattagctgggcgtgatggcaggcacctgtaatcccagctacatgggaggttgaggcaggagaatcacttgaaaccgggagaaggagattgcagtcagccaagattgcaccattgcactctggtctgggcaacagagtgagattccatctcaaaaaaaacaaaaaaacaaaaaaactcaacgtaacttctcaaaacaaaaacatttctctcaatctccaccccaaaattaatactacaatctgcttatcagtcaaacttgccttagtcatacttctttatttatttattttttcgagactgaattttgctcttgtcacccaagctggagtgcagtgacacaatttcagctcattgcaacctccacctcccaagttcaagcaattctcctgcctcagcctcccgagtagctgggtaaattacaggtgcgccaccatgcccagctaatttttgtatttttagtagagatggggtttcaccatgttggccaggctggtctcgagctcctgaccttgtgatccactcacctcggcctcccaaagtgctgggattacaggtgtgagccaccgcacccggccatatgttatgttctatgtatccagctgaccactgacatctccgcttgaatgatgtttgaactaaaaatctaatgaggaagaaaactgggaaaaaaaactagacagtatgaaataagtgttctaactttaagcaatagatactgagatcttagaggtggatgtgatcatctctattagggaggatcagggaaggcatcacagggtagaatgataaatgggatttcagtagttgggaaaagggatgggatgagagtagtaactgggttgaaggaattgtttgactcaagattgaactgtgaaggtatgttaagtattataaattaaaatattgactgcatggagggataaatgtcagatgaggctaaaaaataatttagagctagatcatgaagagtctgtaagttagataatgaggaggctgtaagtctgagttaaggatttttaactttctgtgggttacagaatcatggaatagattttcatactatattacaaaacacttggaagcattgcaaactgaaccgctatactgtcagcttagtttaaataattattgcagtctgttaattctcagattttatctattgtttatttatgagactatcaagtagctcttttttttttttttttcctgagacaggatctcactctgttgcccaggctggagtgcagtggcgcaatcacaactcactgtagcctcgacctgcagggctcaggtgaccctcccacctcagcctcctgggtagctgggtctgcagacgtgcaccaccccacctggctaatatttttttattattttttttgtagagacagggtctccctatgttgcccaggctgatctcaaactcctgggctatgctgggattacaggtgtgagctgggattacacctggtctatcaggtagctcttttcatttagtttactgtgtgccatgcagtgtgcttacactttaacactctatcttacgtaatttaattcttacaacaactccaagaggaaaggatcatcccttttctattgatgaagaaactgaggctttgagaatataaggtcacagagcaagtatagttaagtagtgaaggcaggattctgaacatctctgctttaactataaatcctatattctttttcggttttttttcttattttacttctcttttacatgataacaggataaatcctatgttcttaaccactaaattgtattttcgtctttgcctagggaataggtagatgggaagtagtaaggtggaaggaaatagaaatggtgtgccacctggaactctgcctggtggtttgtttgaaatcttggtaatttgcctaggtttctttccaaagtaatttcccctctctgttccatttacccactctgttcctgtattaaaggttatgttaattccatgtaccttaggagtaattatagcagttaagtagaatgactgctgacaggggatgaagtagagttgtgacagagtctaggtggacatgagttaattgatacagtatttaagaatatgcaggcagggcgtggtggctcacacctgtaattccagcactttgggaggccaaggcaggtggatcacctgaggtcaggagttcgagaccagcctggccaacatggtgaaaccccatctctactaaaaatacaaaaaaaaattagctgggcatggtggcgcactcctgtaatatcagctacttggcacatgcctgtaataccagctacttgggaggctgaggtgagagaatcgcttgaacctgggaggcagaggttgcagtgagctgagattgcgccactgcactccagcctgggcaacagagtgagactccatctcaaaaaaaaaaaaaaaagaatatgctgaataattctctagttaccattatttttgctggatacacaaaatgtattgagaacagagaagctgatcccaggaactttgtgttgtccctcttttttttttttttttttaaacatattggtcttatttggcaactatgcttaggaatttccattgtgtcaccatctgttggaactcaagtgtaatttacttgtgtagaggcttgttaaaaaaaatcctttccctgtttaagaacaggattatataaatgtagtattgtaatagtaggtgagaagacattaatttctggtcacccttgtatatgagtggcttgcaaatttataagccaaacctgtctttgaaaaattaattacattctcatagatgttgttgaacagggttttcttcttcatgcacagtgctagaactcaattttctgtttactactcatgtacctaataatgttccattatttctaggtaacatctatacctctgttacaaattcacaatatcttttgataccttacaaccatgtttatcatgttagagtaactctttatttgtgatcatttatttggagctccaagtttactttctcatagaaataacttgatgaatggtacttactttactaggtgatctcacaaagactctttttaataaaactgaattgtcagaccatttattaatttatttaaggagcttctgcattgtcctttgtattttctaccatgattacaaagagtttcatgttcttcagtgtctcactttctagcggtggcttatagaaaactgtccaatgttttaggagtgtaaaggcaccaaactctgtactacacttcaactgagttttgaaggatgcggaggaatttaccacatagagaaatgaaggctgtgttgtacggtattgtatttgggagtataatgggatgttaaaagggagtgtgagagcatggtgaccctcaggtcaaaggaagcagcttagttgtggcgttagcactagctgccttttgaggggtgataagaaacgagatcacagagttagatagggttagggcatgaatgatgttttgtgctatgccaagtgtttacgttatcctggaagtgatgggaaccctagtgtagggttttaagccagagagggtatcatcagatttgtgtttcagaaagtcactgtggtgtattgtagaagagataccacttaggaggctgttgaaatagctggaggcctgaactaaggtgcaggccatgaagatttattagtagggttgagtgggagagactttttttttgttgttgttgttttgagatggagtcttgctctgtcaccaggctggagtgcagtggcgcgatctcggctcactgcaacctccatctcccaggttcaagcgattctcctgcctcagcctcccaagtagctgggactacaggcgtgtgccaccacgcctggctaatttttgtatttttagtagagacagggtttcaccatgttagccaggatggtctcgacctcctgacctcgtgatccacccaccctggcctctcaaagtgcaggggattacaggcatgagccactgtgcctggctggagagacctcgttaaggtaggattgagatgataccttgatttatcaagaattgggagattaggaagagaaaccagaacagggctggcaaaaaatattttatcccttatgtcaactctaattaattaattagtagttaactactggaaggtgggaaaaactagctccttggttttcactctgttcctttgagagcctcggggtctagatgttcccttccccatcctttgttcctcctagtgcttttgaactcttgtattttttacctaatagtggtaaatgacaaaaacaagtaaaggaacagctttataagtttgaagtcttgagctgatattgctaaacttactatttttgatgagaaagataaaggctgttctgtaagactcatactaagtttctcttttcttcttagaaaaagagttgaaaagagtttttcccaacacaccaagcaacggacaccagtggggtgtcctctaattcagttccaacattatctacctggagatagtatcagatcagtgtcagatcccacaggttgagggcttagtccccaagactaccccaccaccacaccagtcacaagtccaggcctccggtacttctcactgaccggcttcaagttggggttcccatgaccccctctttgggttcagttaatttgctggagcaactcacagaactcagggaaactcttacttacatttactggtttattataagggatattgcaaaggatacaaatgaagacacgtttagggcaaggtatgggagaaagggtgcaccaccctccaggaacctcactgtgcttagctgtccagaagctccctgaatcctcttctcagttttttgaagctttataatcttggcatcccttttcccagggtatagggtgggactgtctcatagagggtcttaagacccacagtcagaaaggcaggagaagattagattcctgccttggggcaggtgaaaggagggcaggagattctgtttcctgaggcctaacacacccaagattataatgaaagactataacaagggctttagaagttatgaaccaggaactgtagatggaaagcaatatatatcataacaccacagtgatcaagtagatagatgattctcccctatcatgtcttggaagatgtgaggtgtgggattaaaaaagtgagtgtggaaacgggataggaccgaaggtacagaattgtagggatgacatgagggatgaggaaaattgagtacactttacaaatattatgaatgtaatgtatgatataggtggtgccctattgatgaggaaattgatctataactgactccaaaaggtgagttaacttgcccaaagtcaaacaggtaataaacgataatgttaggatttaaacttgcatctgctgattccaaagcccatgcttattctgtttacaccatgaggccttcccaaaccaaaacaaaatgtccccctactatttcttttttttttttttgagacggagtctctgtctcccaagctggagtgcagtggcgccatcttggctcactgcaagctctgcctcctgggttcatgccattctcttgcctcagtctcctgaatagctgggactacaggtgcccgccaccacacccagctaatttttttgtatttttagtagagatggtgtttcattgtgttagccaggatggtctcagtctcctgaccttgtgatccacccacctcggcctcccaaagtgctgggattacaggcgtgagccaccgcacctggcctactatttctatagtacttaatagtttgtaaaacatgtatacgttattattattattttctgataataaccagagaaggcaaatagggcagttattaccatctcttttttcacaagtaaggaaactttacggatgggtttatttagtagatactcggttcttagtggaaagaggtgtagaaagaaaaaatgcatagatcatgatcacatggctaggctagttagtaacagagcagagatagatcccaatcttcttacttctaacccagtgcttattctacaaatgcatcctgcagccatcctttttcctgtccttgtggattataccatgtattgattccggaaagactaacagagaatatgagcatggagtaggatgtcaaacactgagaggcgatagcaaagaaggggagaggggaacagggcaggaatcccaagaataggaatagaagggagaaaaggggattgttttgctcacctgactaaagcattattttctcatataagagatatatcttgtttagtgaccaccgacaggaagatttagatctacaaaaataatttactttgcaaagtaattttttatttaaaaaatgtttagaattaattttacattgttttagaaaaatagaacttgaagtaacaagttttcaagaacacatgtgaaatgaaaaataccatattcattataatgtttaatataatgttgattatattaaaaattatctcgttcttaagtaaaatatacattctcctttactgataacatattttatattttttatattgtaccacatatcatgcctggtacataagggcttgataaacaaagtgttaatttctggtcataaagagatattttagacaaattggggaggtggataattccttatttttccagagaccatgtctatgcctctcactttgcttttggccattgctgattgatctcaggattaagaaatcagatgtaagatgggctgactagattgttttctggaaaactggaaacccaaagggagggagaatgactgtacagtgatggaaggtggttggaaccaccctgtcttatagaagcagtgccctagggagaaatctgtgagctcctgctgctgaaataccggtgctgctcaatttccatgctttctgagcttagtgttttggctcttccttagattctgtgaactactttagtgttccctcagtaaattacagctaatttaacagggttagattctgttgcctgccattaaaagaactgtagctaaacaataaataaataaaaagccacccattgaccatttttactcacttgaggacagatttcattacagaagtatagttttagagctgaaagagatcctagcaatcatctggtctcgagttttgaaattctcttaactatgactcacagttaggaatgcattttacttcaagatacccacctggtttacctagttacacatgtattacagaaacaaaagtacttatccttgtaactttatttttttaagattctatttgaaaaaaaaatatgggttgtgaccaactaaattgactttatgcatgacccatgaatgggttataaacccacatttaaaaaatactaatgtaggctgggcacagtgactcacacctataatcccagcactttgggaggctgagatgggtggatcacttgaggccaagagtttgagaccagcctggacaacatggcgaaaccccgtctttactaaacatacaaaaactagccaagtgtggtggcatacgcctgtaatcccagctacttgggaggctgaggcatgggaattgcttgaacccaggaggcagaggttgcagtgagccaaggtcatgccactgcactccagcctgtgcgacagagggagactatgtctcaaaaaaataaataaaaataaataaattaattaaaaatacaaatgtagttaaattgctttatcttatagagaagagtggtaaaatgacagtgttactagaaactaaataccatacccatgtttttctttaaaaatgtattttcattttcaaattaccaatagcatctatttgtttgaaaagagctatggaaataatttgttgtacatactcttacttccttgaagtttgtctaatctctatggtatactgctgccagattaattttcctgaaatatcactttgatatctagcttatttcctaattcaaaacttttaattattttatttgacttaaaatgccatatatattttggtttcagatgtatgtccttttaaatttgtcagattttcagagctagcaactgtaagtatgagggaagaagttgctgcaaactttgtccataaattagataattcacttttgaatagtggaagttttatattcctttgtttgtaatcttatgtacataagagacaattcaaagtaacaaaagctaagatacttaaggagttgtctgatattacagacctgccagcaataatttttatgaatatagaagatgaattaagcatatattaaccatgacttttcattttttatttttatttatttatttatttattttgagacagtctccctctgttgcccaggctggagtgcagtggtgtgatctcggcttactgcaacctctgcctcccaggttcaggtgattctcttgcctcaccctcccaagtagctgggactacaagtgcacaccaccatgcctggctagttttttttgtatttttagtagagacggcgtttcgccatgttagccaggctggtctcgaactcctgacctcacatgatccgcctgcctcagcctcccaaagtgctgggactacaggtgtgagctaccatgtccggcctcatcttttaaaaagataaaaagatttctatgcattcactgcagattaataaatttaaatagatggtatattgtaagttagcgtcagtgtctgggacctggcctattgtggagtaataatgttctcctagtttaaatatctaaaaaactaatagtagacacacacatataaataattggagtggcttggtgcggtggctcaggcctgtaatctcagtactttgggagactgaggtgggcggattgctggagctcaggaagtcaaggctacagtgagccatgattgtgccactgcacttcagcctgggcaacagagcaagactctgtctcaaaaaataaaataaaataaaataaaataaaataaaataaaataaaataaaataaaataaaataaaataaattattggagcacaaggttgagatgttttagtaggtttggtattaaaactacatatttttctgatttgcagaatacagtatagtgctatagaacagtggacagtcatggcagttgtctgtggccatccataccccagtgtgtgttgagcagattgatgctccaacactgccatgatatggaaccatttttgcaatttgttaggttatagcagtgaagcagattgtttttaattaatgtcagtgatgtgatttagtggaataaaataggtggtcattaaaacaaaaactttagtaactgttattttgttgcttgcttgttttccggtaactgcataaatgagcttctgtaatagaaaaaaaaaaaatctttacaatgctcagattccttctcagcctgtactgttccatgtttgaaacagtgttagaatgagctgtgttacaaagtgcactatgttagaagctgtcccaggggcccgtcttttcaggaagttcttttgctatacttggaggattgtgagaatactgattattgttttcctgaagctaaaactgttagtttgtggttagcaaacaagtaaacaaatattaaaaacgtaactagagagtggtgaaagctgtgaagaaagtaaaagcaggataatacaagtgatctgaaggaatcatgtgttattatagttagagtggctaggagcagtcttatacaggagattatatttgagcagagatttgaaagatgaggagccatttaggcaaagatcagaggctatcgcattgccgacagagggaataaatacgaagaccctgagttagtatataattcacaaaataaataaacttcatggctggatgataaaggtcctactaagaatttcctggagggaacatcttcaggaatttgaaagtgtagagtcacatttatttaccatataatatgtgtgataggaagtacttgactcattcaataagtactttttggttacgggatgtagtaatgagaagacagaccaagcccctgctttcatggagctactattttagtagtaaagttgaccagtaaacaattagacaaattgtaacaattgcaggaaatggtaaatgctgtgaaaaaaataaattagtaaggagctacaaggagtggaacaggctcttttcataggaggctttcagggaaggcctgtcaactgagttgatatttgaactgagacctaaatacctgaaggaactggcagatgatctggaaaaagaacattccaggcaaaagaaatagtaagcttactggctctgatgtaagaggagtttggtatgtttcaggaactgaaagaaggccactgattttggtagtgagcaagattgatatggagagtgataagagatctggttgagaaaaagattgtagccaaagcaagtgaagctctataagccagattttattgtgaatgtgcaaggatgtctctggaggattttaaggaggacaatgagttgatctggtttatttttttttcagaatcattaaatgccataataataattttggtaaaatagaaaagcttcctttttcatgaatatccgaggcttttttgttgtttgttttttgagatggagtctcactctgttgcccaggctggagtgcagtggcgcaatctcagctcactgcaacctctgccttccaggttcaagcagttttcctgcctcagtctcccaagtagctgggactacaggcacacgccaccacacctggccaatttttggatttttagtagagatgaggtttcaccatgttgacccaggctggtctcgaactcctgacctcaggtgatccacccccctcggcctcccaaagtgctgggattatgggcatgagccactgtgcctggccagaatgtttgtattttaatgtagtaacattatagtaaaacaaaataatttgggaaaagacttgatggcaagtatataactttagtaagtacagagtgctatgccaatataaaatcactgtttcatcaaggcaaaagctttcaaggatctttaaaaacaaaaaaaaaaagaaaagaaaaatcactgtttcttgcatggtgaagtagggagtcaacatgagtaataatcagataagaactttcagaagcttcttttttataccaaaacattttgccaatcttattatttttttaaaaatttgtttttggtgttgaaaatgcatagctttagatgttgtaatcatagtatttggtcagggagcttggaaacattttaattgttcttccatccagccttcaggttgctttgtggagaaatacttgagagaactaggcacagaaaaggcaaagcaagaccaagaaaacattttagcattagctcaggttaggttccaacccctgatgcagaaatctggtaggtgaaactggaccaagtaaaagggctgtttttgtcctgagccagattggcctagaaccaagtgtagtcataaatgtcctttattttcctacgacaaccaaacatggaactcattcttccaaaaatagggtcaatgttcatcctgcctgttttagaggaagaagaacttgagggtaagagagagagagaaacctgggcaggcttgtgcacaggaagggcaggaaagagagttgactgggtgtgttgttgggtgcctgtaatcccagtacttgggagacggaggcaggagaaccacttgaacctgggaggtggaggttgcagtgagccgagattgtgccactgcactccagcctgggcaacagagtgagactccgtcttaaaaaaacaaaacaaaacaacaacaacaaaaaacccagacattcatgaaaaaggaagctttttattttaccaaaattattattatggcatttaatgcttctgaaaaaaagtaaaccattggtggaagacttgggagaagagtgagagaaaaggaggaaggagagacaatgagaaaggaaggaaaagaaggagctggaatggggaggagacagtttccagacaggtgcttgcctcaaggccccttatgtggaaaatcttcaaaggagagagaaggacaaaacacctttctcagagctcctcttaataccttatttaataatcataaggaagagagaatgagagaaggatgaccaacctttctcctgagggagtaggtcctgggctcatcaacactgcagccatatgggaagaggcaaagaaaaggccatgactcagtgctgacctttgactcctttgaatatactaacctacaaaatgtggggcccagtctgtgttttggagtcatttattctctatcctagatatagaataaagggatgggcccctttattcctcatggtgctttgaagagagaaattatttccttccccttgagccaactttgtaatgaaaaggatttagactttttcattttttgtctgtatagtaaagttgcttcagaaaaacacaatgagaagaagcatggtagaacatcttgtgaataacctcaaaagaaagaatattgcatgtatctctaattgcctttttttcctccctgataaatgaggagagataaatcgtattgaacaaagtactaaaaagtgctcaacaacacttttatctctttaagtttgtctttttctaacttctaggagtcatttttaggaaagatggatgcctgtagatttcagcttatttttatataatggagccaaagtgaaattcttcaagttcttaataggaaaaaaaggtatactttacagttgtgccacccagccaaggctaacatatattctctatatatgctatatgtgcatatattctgtaatataatctatattaaaaagtgtgattttggaaataaaaaattagccgggcatggtggcaagtgcctgtagtcccagctactcgggaggctgagatgagaggatggcttgtgcctgggaggtaaaggctgcaatgagctgtgattatgccactgcacccagcccaggttacagagcgagaacctgactccagaaaaaaacttgtgaggccaggcacagtggctcacacttataatcccagcactttgggaggctaaggccagaggatcacttgagctcaggagttcgagaccagcctgggcaacatagtgagaacttgttaaagtgtgctttttacagaatcaaaaaacaattttatatagaatctttttatacagaatcaactccacaaagagggggccataattgtcatcgtattcccagtgcctagtctagagaagatgttgaatcattgaataaataagaggtattagcgaatgttttaattaagaattaaatatattttttaagaaaagaaagtcattcagaattattactaagagagtggtggaggttctttgttttgttcctcccccttgacatttgaatagagtaagcagtaattattgaaatacgtatttattgagttgtgagaattaagtgttttgggggaggctcctgaatgcctggagtttatacgagaatctaaccaagtgattagatggtttgttttctgctttatcattttaatataacaagtacctttataatttcaaatactcatagggaaaagagtgttgactttttgtttcagttaaccagtgatcatttgactttcctctctacctttgctttttgtgtctagctgtgttgtttaaaatttaacaaataattaatcatgtttaatatataatacctgcatttttaccagtttttttcatgaagtgaagcatgattgagatataaatactgtagatctatttaataccaatgatatattttagaaactaaatccggctacagtagatttaggttgttcctcattttttttcattatatattaatagttggattgtattgatctagaaatcttttaattatatgttaatttggaattttattgggttgggtccaagccattttttttgcaagagcagataaaatccaaagaatagctatgacctacggctcttggcgtggggcctggcacaagacaatgaatgaggccaatcagattctttgcctcagagacctgaacaaatcgtggaaggaatttgcttgttagcaaattgggaaattaagcagagtcatgaggtagagttagggctggaggagctgtgagaaaccatggagttaacgctggggagggtgcctggaaaagcctcataaccatttttccctattaatgaatataggtctataccatgatttttgaaggctgcacaatattctgtggtatgaaaagtaccacaatttatttgccccaatcccttgttgatgaatgtgtaggacctccccacaccaaagggtttttaatcacaacaatgacaccatcagagttcgatttttaaaagatagaaaagactatgtaacctagactaagcaaactaggtatatattgtagtgacttttactgacataggaaaaagaggagagaaaggaattggagtgggggaaatggccatggtagagtgcagagataatacattcagtttgggacaggtttaggatgccttcaggacacccaggaaaagataaccagggagatatgggcttgagatagagatttgggaatcagctgagagtagtggttattgacgtcatggaaattgtgatgcccagggagggcatgtttcgaagtgaaaagagaaggtcagagatagaactgttagaagacaaatattcaactaatgtgcagaaaatactgtggagggtagtcaaaggtgtaggatatagaattgaacaactctggctaacatctgaatcttcttgttctatgaaatgcctatttttttttctgattttttttccattttgctggttgatcatgtttttggtcttatatctcagattgggaattttaacaatgtgtttaataactatagaatatcaggatatgttaagagtgatcttatagatttttcataattttgaaataaaaatggaaaattctttaaactttttttaaataatgaggcagacaggttcagaaattatttggctattttgacattttatcatttgcaataaatactatgcataggtaccatgtgtctataataagccttttcttcttattaatagagtttatgccataccattagtttccttgtcactaaaagaatataagaatattattcaagaaagcctgaaaacgcaaggaaactagttttttgtctttattttgttaaaaagcattatttattgaattgttaatgtttagaatttagatttaagtaatgtctgtgatttattacaaattagtgttttaaaggatccttatgtgacatggtctaccaaaattacagaggtcgatgttttatgtgggcagtacttgtcaactctttgaaaagctgatgctggtaaggtgttgtcagctgatacagttaaaaaaacttaacagtcttttgtaaccctttagcagtaaagattgacaattttatgtaggtaggagcatttagtgagaattatgacaccctgtcatttttgcttaatttgggggcaaggaaattctagcatacttgttcatatattcaaacttatttcaagtaagtataagttctggtacccaccagatctacaattcctgatagttacactttctgtgctctggccatatgtatttgtagaggcagtgaggtgtgggttaggtaatgtttggtctcttagttccacctctaaggcatgctaatatggtagttgcttgccagcagcattggtctggaaatgggtgacttctagatacctggtaggttggaggaaaggtgttactacttcttactgtgctgtttgagtatctgccatagatatttatgtgcaaatcttgtgaaaccccctgctgtttctcagctgtaagttgtctttgtagtttataaaaacctgggatggctacttaacgaggtggatatcatgactttttcttttctgtttctcacagtgcttgggaagtgaagcctgactgagtggtagaggtaaattggggaacagttacgattatgtcaaaaccttgtgtggttcagtttcgttttcttctaataaaactagcgccatgaggcactttttttatacacacccagctgaaagaaatgtgctgacaaactttttttcagggaattttttgagtgttaattggagctgttactgatggttatttttatatgataaagtgtatttcagtgaatttaatgtaacttgttttagatttttagatttgaagcacagtttttggctcaggaccaaatatgcctggaaaactttcaaatctggaaagctataaaacacaaacatactttgaagtacggcatatgtgactgtttaaaatatactaggaatgtctttattggttagcaaatgaaagaacatagctatcatttttatattgttggcatagggtagcagcaattatgttgagtggtggtggacaggcctgagctgccttatataaattatcataaaaataagtttgcccaggtcactatggttaggacatttgaaaaatacgtatgttctgtacttaaatcttgatttattgaatataatcgtctagtgggttttttcataaagcctatgttgtatactgtttttttgttgtatgtttgtttttgttttttttgagacagggtctccctctgttgctcagcttgaagtgcagtggcatcatctcggctcactgtatcctcaacctcccgggctcaggtgatcctcctacctcagcctcccaagtagctgggattacagggatgctcactatacccggctaattttttttgtattttttgtagagacagggttttgccatgttgccctggctggtttcgaactcttgggctcaagcgatcctcctgcctcggcctcccaaattaagaggattacaggtgtaaaccactgcctgtaatctcatgattacatcatgtgtactcttgatagttactgtttttttcctgcttacatgtctttgatggctcattggcaactccattattagtgaaccaggcacatgaagaaatttcctaatttatttcctttaagtgttaattgatataacattttggggggaaaacataaaaataaatgattacagtgaagtttgaagattatcttcagattttattcattattgtaataaaatgattctgtaggctaatctgatggccatacagtgactgtataatgccttaagtaataaaaacactaaaaatctttagagcattgggaaatttttagagcagtttgatatacatctcatttgatgccgtgtgtggtaagaaatgaagtattatcccacatttaacagatgaagaagatgaggctgagtgaagtccattgatgtcctaaggtcagaacttactttttaaaaaatcaactttactaaggcataatttacataaaatgtacccatttaaagtaatttgaacagttttgacaaaggtatgcactcttgtagataccactacagttgagatatagaacataataaccccccaaaattcccttgtgcctttttgcagtcagcccgcagccccaccccacttcaggcatccattaatctcagttctgtcgttgtagattaatttttgcctgttctagaatttcatatagatgaaagcaaactgcacgaactctttttttactagattcttttgctcatatttttgagattcatctatgttgctatgtgtagtttattcctttttattgctgaatattccattctgtgaataccacaatttgcttattcatttacctgctgatggactttgatgctgtttccagttttgatgtgttagaaataacgcagctatgatttgtatttagacatgtattttcatttctctcttttttttttttttttttttttttttgagacagggtcttactctgtcatccaggctagagtacagtggcagtggcttgatcacgggctcaacctcctgggctcaggtgattctcccacctctgcctcccaagtagcgtgcactaccacacccagctaattttttgtagacatagggtttcactgtgttgcccagcctggtctggaactattggaatcaagcaattcgcctgcctcggcctcccaaagtactggattacaggcctgagccactgcacccgaccttattttcatttctcttggtgggccatatgtatgtttgactattaagctatcaagcaattttccaaagtggttgtactttctatttcaccaccagcaatgtctgagcgttccagttgctccacttctttgccaatacttttggtattgtcagtcttaattgtagacattctagtgtaaattagattctccttgtggttttattttgcatttccctgaggactaatagaatttaatgttttttgtatgcttactggtcattcatacatcttttatgaaatgtctgttcaaatctttttctcagtgtcttattggggtttttattttcttattactgtaggagttatttatactgaatacaagtcctttgacaaatacatgcattgcagatagtttctcctaatctgtggttcacattttcttttcttttcttcttttgagacaaggccttgctctgttgtccaggctggagtgcagtggcatgatcacggctcactgcagcctcgacttcctagcctctatcaatcctccctcttcagcctcctaagtagctgggactataggcgattgccaccatacctggctaattaaaaaaaaaatttttttttgtagaaacagggcctcactgtgttgcccagatagttttgaactcctgggctcaagtagtcctcctgccttggcctcccaaagtgccgggattacaggaatgaccaccatgcccagcctgcgtttcattttcttcgtggtgtctttcaaggaattttaaattttgatgaagaccagtttacaatttttttcttttttagttagtgcttttatgtcctaagaaatcttttcttgcctatattatggttgtaaagatttttttcccctatgttttcttctcgaagtttacagttttagctttttcatttagaactatgattcattttggatcagtttttttgtatagtgtggtcgaggttcattttaccctttttttttaacaagattatctagttgttccagtagtatttattgaagactgttgtctcctcattgactgacgtcgacacctgtgtctcttccattgatttagatgtctgttaggctgtgccacacagtcttgactaatgtagcttcataataagtcttgaaacttgttagtgtaagccatccggctttgttgttttttatcaaaattgttttcgttattctaggttctttgcatttccatataaattttagaatcaacttgtcaatttctattaaaaaaaaagcttgctaggatttagattggaattgtgttgaatctatagaccattttgggaagaattaatagtttaacaatttgtgtcttccagtgaaaacatggtttctcttctcatttaagtattctttaatttatttcagtagtgttttatagtttttagcatatgagattcatatgcactttgttgaatctttcatatttttgatttggaattgcatttcagatttaattcttaaattatttattgctaatatatagaaatacaattgaattttgaacattttttttatcctgtgaccttgctatatacatttattcctagtatgtttttgtggatttgtcagaactttcaacgtaaacaatcatgttgtctgtgaataaacacagttttacttcttcctttccactatgtatgtggtctgctccccgcttcttattgcactgccaaacactaacagttaatgttgagtaaaagtggtgagaccagacatttttgtcttattcctcatcttatcaggaatctgttgagttcccattgttaaatgtgatattatctgtaggatttttgaagatgttctttttcgggttaagggagtgcctttctgttccacgtttgctaagaaatatatgtatgtttatgtttttaaaatcatgaataactgctgtatttttcaaatgctttttctgcctctattaagataatcatatggctgttctcatttatcctgttaataggtgagttacgttgatttcaaatattaaactggtcttgaattcctggagttaaactcagttggtcacggtaaattatctcttttatatattgttaggtttaatttgttaatattttctcaagggtgtttacagccatgttcgtgagagatatttttcttctcatttctttgtcttgtgttagcatcagggtaatactgtttttatataatgagttgcaaagtgttccctactccactgttttctgaaagacttcacttaggatttctgtaatttcttccttaaatgtggggcagaattcactaggtatgccaccggggcttgatgttttctttttttttcttttgttttttttttttttgaggtggagtctcactctgtgcccaggctggagtgcagtggcctgatcttggctcactgcaacctctgcctcccaggttcaagcgattctcctatctcagcctccgaagtagctgggattacaggtgtccccccaccacacctgggtaatttttgtatttttagtagagacagggtttcgccatgtttgccaggccggtctcgaactcgtgacctcaagcagtccatctgccttggcctcccaaagtgctgggattataggcgtgagccatgtgcctggctgatattttcttttttttgagacagagtcttgctccgttgtccaggctggagtgcagtggcgtgatcttggctcactgcaacctctgcctcccaggttcaagtgattcttgtgcctcagcttcccaagtagctgagattaaaggcatgtgccactactcctggctaattttttgtatttttagtagagaaggggcttcatccatgttggtcaggctggtctcaaactcctgatctcaaatgatccacctgccttggcctcccaaagtgctgggattacaggcgtgagccacggcacccagccaattttggttattttatatcttttaagacatttgtccatttcatctaaatatgtcaatttattgtcattaagttggttataatactcccttattatctttttaatatctatagaacctgtggtgatatccctttttactttcctggtgttattaatatatatggaggtttatcaattctgttaatcttttctaaaaaccagctctttgtttcagttttttaaactaatttttgcttgttttctgtttcattgatttctgttctttattatttcttttctttttcttattttggctttttaaaaaaatctagcttcttaagatgtactcttaggtcattaattttaaagctttcttcttttctgatacaagcacttaaagccataaattgctttcttttttttttttttctttgagatggagtcttgctctgtcgcccaggctggagtgcagtggcgcaatctcagctcgctgcagcctccgcctcccgggttcaagcgtttctccatcctcagcctcctgagtagctggaattataggcgcccaccaccatgcccagctaatgtttgtatttttagtagagacgaggttttgccatgttggccaggctggtctggaactcgacctcaggtgatccaccaacctcagccttttaaagtgctgggattacaggcatgagccactgcacccagcctaagcaagattttcgatgtagatgaaatagccttcctttagaagaggatgccatataggacttgcatagctagagaggagaagtcagtgactggcttcagtgcttcaaaggacaggttgactgttttgttatgggctatgtgggctaatgtagctggtgactttagatcgaagccagtgctcatttaccattctgaaaatcctagggcacttaagaactatgctaaattgactatgcctgtgctctataagtagaaaaacaaagcctggatgacagcacatctatttatagcatggtttactggatattttaagcccttattgagacctgctcagaaaaaaaaaaaaaagattcctttcaaaatatcactgctcgttgacaatgcgcgtggtcacccaagagctgtgatggagagggacaagggcatgaatgttttcatgcctgctaacacagcttctgttctgtggcccatggatcagggagtaatattgaatttcaagtctttttatttaagaaataacattttctaagtatatatctgctatagatagtgattcctctgttggatctgggcaaagtaaatttaaaaccttctgaaaaggatttaccaatctagatgccattcatgattcgtgggaggagatcaaaatatcaacatgaacaggagttgggaagaagttgatttccaacttttagggatgactttaaggggttcagtacttcagtggcagaagtatctgcagatgtggtagaaataggaagagaactataattagaagtgaagcccggagataggactgaattgctgtaatctcattatcaaaattgtctggatgaggagttgcttcttacagatgagcaaagtggtttcttgtgatggatctattcctggtggggatgctgtgaacattgttgaaatgacaacaaacaatggatttacagtattatatatcaagttagttggtgaagcagcggcagagtttgataggactgactccacgtttgaaagaagttctactgtgggtaaaatgctatcaaatggcatcacatattatagagaaatttttggtgaaagaagagccaatcagcacgcaagttttgttgtctcaagaaattgccacagccatcccctccttcagcaatcaccactctgatcgaacaacatggaaccaagaccctccaccatcaaaaatactgtgtttcattgaaggcttgggtgattgttagcattttttagcaatacaatatttttaaattaagttaggtacattggttttttagacataatgatattgcactcaatagattacagtataagcataacttttatatgcctggggatattaaaaaattgtgtgacccggtttattatgctacttgctttattgcaatggaatggaatggaacctgcaatatatccaaggagtgcctgtagttggaatcataaagaatgtagccttttcacattgactttttatttaataatgtgcacttaaatttcctcccatgtatttttataacttgattgctcacatctttttagcactgagtaatattttgttgtctgaatgtgctacagttttaaaaattcatatatcaactgaagaatgtcttggttgcttccaagttttggcaattatgaataaagcttacataatcatctgtgtttaggtttttatgtggacataagttttcagctcctataggtatataccatggagtgtgattgctggatcatagagtaataatatgtttagttttgtaagaaatcaccaaactctcttccaaagtggctgtatcattttggattcccactagcagtgaatgaaagttcctgttgttccacaggaactttccagtccagtatttggtgttgtcagtgttgtggatttagacgttctaataggttttaatttgcatttccctgataatatatgacttagaacatcttttctttttttctttttttttttttttgagacggagtctcaccctgttgcccagactggaagtgcaatggcacaatctcggctcattgcaacctccgcctcctgggttcaagcaattctcctgcctcagctacccaagtagctgggattacaggtgcctgccaccatgcctggctgacttttgtatttttttttttttttagtagagacggagtttcactatgctggccaggctggtctcgaaatcctgacctcgggtgatccgcccacctcagcctcccaaagtgctggaaatacagtcatgagctactgtgcccggccagaacatcttttcatatgcttacttgccatctttatatcttctttggtgaggtgtttgttaaggttgttggcctgttttttaattgggttgttttctgagttttaagagttttttgtatattttggataacagtcctttatcagagatgtcttttgcaattgttttctcccagtctgtggcttatgtttttcattctcttgacacccttccgcagtgcaaaattttttattttaataaagtccagcttatcaattattttttcatggattgtgcatttggttttgtatctaagaagtcattgccaagcccaatattatctagtttttcttctgttatcttctagaagttttatagttttgttgtacatttaggtctgtgattcattttgagttaatttttatgaaggctgtaaagtctgtctagagtcttttttttttcatgtggatgtctggttgttctagcaccatttgttaaaaagactgtctttctccactgcattgccttatttgcttctttgtcagagatcagttgactttgttcgtgtgctctatattctgttccggtgatctatttgttcttttgccagtaccacattgtgttgattactgaatctctgtagtgagctttgaaggtgggtagcatcagttctctaactttattcttctccttcaatattatttgctattctaggtcttttgcctctccatgtaaactttagatcaattcatcaatatctacaaaataacttgctggaatttttactgggattgcattgaatctgtagatcaagttgggaaaaaccggtatcttgatgatactgagtctttttatccatgaacatggactctccatttatttagttctttgattttgttaatcagttttatagctttcctcacatagatcttatgcatttttttagatttatacttagtatttataatttgggggtgctaatgaaaatggtattttgtttttaatttcaaataccacttgttcattgttggtatataggaatgtgtttggcttttgtatgttaaccttgtatcctgcaaccttgctataatatggtggtaaggtgtgggggagaggagaagcattctatagtcctataattaggtctcaggcttttagtgagcctatgcctctggactgtggacttcataaatgtttctcaggtttttttctccttctttaggtgggtcaggaaggctagaggggacaggatttgaatgtttccctctcccaggtcagttaggctttgatagtaccttaacagattaagctctggtttaacctagtttcttctgagggcaggccttgttaagaagaatggagtgctctagtatatttagaaattctctctcccctcccactggaaccatgggggcagcggggctggggggaagggttggggacagtttctgatatttattgtgagaacctgttcaagccagagcctggttgagctcttgaaggtaaagctccctataacttgatcccttggagttttaactctcagacttgtttactctgaacctgcaacaattcatcagttacagtttagttttccttctccagcactggttcccttggctgtttctgtttgtgagtctttgctctggtaatctgtgacttccctttgcctgtctgtctctccatcctttgggctggtggtttgccttgtgttctcacctttctttcagatctacctagaattgttgatacttcattctgttcagctttgtgcttgttgttagaacagagtgactgctaaggtttttacatgcagaccagaaactaaagtcttctttcttttacatttttttgtagtgcacatttgctagtgacatctttagatcaataaacattgagaaaagttatctttattttacctccttttttttttgagacggagttttgctcttgttgcccaggctggagtgcaatggtgccatcttggctcactgtaacctccgcctctcaggttcaagtgattctccagcctcagcctcccaaatagctgggattacaggcacatgccaccatgcctggctaatttttgtatttttagtagggatggggtttcaccatgttggtcaggctggtctcgaatccctgacctcaggtgatccacctgcctcggcctcccaaagttctgggattacaggcgtgagccactgcatccggcctttacctccatttttgtaggttatttttgctgagtaagatgcattctgtgtcttatggcttgcattgtttctgagagaagtcagatgttattcttatcagatttcctctgtatgtaatgtgtaatttgattttcttcagctgcttttaagatttctttctttttttttcggaatttggttatggtgtgccttaatggatttttctttgtatttaccccgttggggatttttaaagctactcatatccttgagtttatagttttcatcaaaattggaaaaatttcagccattatttctctgaatattatcccccaccatgttttttagactccatttgtataactgcttgctattgtcccacacacaggtcaccgatgaggctctgaggctttgttcatttttttaaggccttttttctttttatgctttagttggatagcttgaaatatcactggaagttgagaacaggaaaatctgttatatttacagtcttattcctgtggtccctttcaaagatgtattctgttgcagttagcacctgtgattgttattcttttcctttaagaccctcttagagatttactttttgtgcgagctagttagatatgttaaaaattaaataaatagtaaggccaatatggtgaagccctgtctccactaaaaatacaaaaattagctggatgtggtggcacgcgcctgtaatctcagttactcaggaggctgaggcagaagaatcgcttgaacccaggaggcagaggttgcagtgagccaagaacacgccactgcactccaccctgagtgacaaagcaagaccctgtctccaaaaaaaaaaatacttacccaaaataatttttttatttaactatgccatatgacctgagttcttctttttaagaatatgaactttaatttccttagaactttaaacattcctaagaaaggtaggttaaattgggaaaattaggccacccataatagtaagattagtacttccatttaatatatttgaggtaatcctaaaaacattaatgagatagttttgttgaatgttcaatgtgtaagtcaagctgatgtatttacatttacaaaagtgtttatatttcataatctgaaataattgttgtcttaagtagtttaccggaatactactcagcaataaaaagaaatgaactattgatacatataacagcttgtatgaatatgcatagacatgctaagtttaaaaaagccaatcccagccgggcgcagtggctcaagcctgtaatcccagcactttgagagtttgagatcgggagtttgagaccagcctggccaacatggtgaaaccctgtctctactaaaaatataaaaattagctggttgtggtggaaggcacctgtaatcccagctactcgggaggctgaggcaggaaaattgcttgaacccgggaggaggaggttgcagtgagccgagatggcaccactgcgctccagcctggatgacaaagcaagagactccgtctcgggcagtaggggtgggggagaagacaatcccaaaaagttacatactgtataaatcccatttatataaacattcttgaaatgacaaaattatagaaatggagaacagattagtgattgccaggggttggagagaagtagatgtgactgggaaagggcaacatgaaggatcctgtgttgtagtgttttgtggcttaattatatccatatcagtatcctggttgtgatattgtactatggttttgcaaggtgttaccattgggggaaactgggtctatggtaaatgggatgtttctgtgttctttctcacagttgtgtttgaacttacaatgagctcaaaataaaaagtttaataaaaagatgtatgaggaatgaatttttaagatgaaaagaaaatgctaccatgtggagcagaaatggtttcagtgtcatttctcactggtagtgagaaagtatggagtgatcgagtacattatctctgtagtggacagaccccaacaatgatcagcagtttgactttataacatttctaaaactctctgagcttcagttttcctcatctatagtaagcaatgataatattgtctgccttataaataggtgtgaggattaaatacaatagtggctgtgaagtatctaatgtggtgcttgacctatagtaagaaagatcagtaaacgttagcaatcatcgttggtttttattgacctacttctatttctagggtgtttttttaatggatattagtatatatgttaatttaaataacatgtataactgagttactaggaaaaatgtttacttatatatgggaaaacaaaatagtaacaactaaaagaaatacaattatttttcactttagatcataaaatttcttaagagtggatttgattttggaagggttgctgcagagaaagctgccttgtttggatattactgatggtaggacagtattctgagcttaaaacacttgtatcctgttgctctgcatatttatggtataattaaagtggcttatatttgctttgaaaacccacttgaaggcattttattcttaaggcttttttttttattttcatcttttatttctttttggcttattgatccctcttcagtttctgtaactaattgtagcaactggactcacaaacgttgtttaattagcactacattaaggttgtagactttcttataaccacctgatgacgtgtgtattaaacaaacaaacattttgaagtgcattctttataaggtaaggcttgggaggaaagctgcccacaattaacctaggaattaaaaaggtaagcagaaacaacttattctgtggatgtagtaacagctcctttttactccagatattacccaaagcttacttgtaaacatagttttctgggacaagaatattgagatctgtaaattcatcttcagaccttagctgacttagctatgacatatataatgatgcatgtataagatgtgcttactgatttctgtggaaaaaatacaagctttgtttgcttctaaattatattttcttctattcttaattttgccaaaagtttaaaaactaagataagataaacattttgccatacagttgacccttgaacaacatgagtttgaactgagcagacccactttatacacagttttttcagtaagtacaatagaccctgcaaatcagcgggtttggcataaccaaatatgacataaccaaatattccagactcactttcttctttccctatctctgacctggaaccagctgttttctgtgaagccttgggtttatattaatggggaatgttatttagaaaccatgatctggggatagatgtatttattgctgctgttttagtgttactgctaggcccttaactcatgacaatgccaggagaaatatgtaatcatgagttcttactgatatctccataggattcttccatatttgaatcttaaaatgagcatctgccccagggccccttcccagaggtacgcattcccagcacaatgcagttcttggctagggtcaagttgtattgcctcctgtgcctgccttaatctggctctgctggctgagatccatgtctatctggattcaccagcagcactcaccatccatgctctaattagagtcccatctgcatttccacattgtagttttgtgcatttttcagtatggcaacctccagccatgttgatgagtctgcctgggcagtcctcattgcctcctggttataaagttgtgtgacttttgagtgattcatcctaaccctattcttgacataaaccatgttatttttacagcatgaaatgccttgtactattattgtcactccattttatagttgaggtattgaagcacagagaagttaaggaatttgccaaagatcacctagttagtaagtggcagagttgggattaaacctaggtactctgcttaaatggtctttgctaacctatgctgctagactataggatttatgtggggaagtattagaagacctgaaaagagtgattattttaagatcttgaagaattttaatattatttaaataatcctggacttgttgggtaggccctgggaagtcactgaaggcttttgactgtagagtgatgtgattggcaatgtcctgtagaaaggttaatcacttgtagctgtgagggactgtgaaagcaagattcctgatagtatgctgttcttgggcttctctctagagatctaatgagtcagcctctaaggtttgatgccagggaatttatgatctttttgatgatcatccatatttggaacgactgctctaaactgtttcctttgtttactatattggtttgactactagtatgccattcctgtatgtgtccatccagtacagccacatttaaatgcccttaatttgccatttgaagctacatatagtccagatgaagtcgatgagtctgctcaggagacatatctttcatctgtctgggccttgcgtttcaatagatatttgagctatactctttcttatatatattaagtttgcaataaagcttaatatcagcttgttttaacattatcttggaaacacttcttcattgggtagtgtgattattaccaaatgtaagtgacaagatgtaaaccagatactcatctacttgtatataaacagatgaaagagaactctcaactacttccttgtctctaatatttgcttcctaaaaatttgggcagaattaaatagcagttaaatcagtatcattgtgctgatagtcgcatgctagtcatcatacttttttgacttgctctgcctacttcattgacatatctaaccagggaggtccaaataaaataaaaatagcagttttgtgcgatcagttgtttaagcatatgtcatattgttaagattttgaaactcttcagagaggtattttgaatctcatgaaagtcacccctcttgccagggctgccacatgcatagttccacctgggtatagcagagtagcagtggcacctttggtcctgactatgtttaatacagattgggtataacagcagtacgtctggaacaacaatgccataatcctcttgtaggttactacttaactatttgctgttcaatagttaaacaaaattttttgtgttaaaaaaaatcaattgaccatagacatatgggcttatttatggactctgttccattgatctctgtttttataccagtaccgtattgtgttgattattgttgctttgtagaaagttttaaaatcaggaagtataagtcctcctactttgttccctttcacgattgctttggctgtggtgagtcccttgagctttaatatgaattttaggatcagtttgtcagtttctataaagaagctacctgggattctgatagagatcacattactttgtataccaatttaggaaagtattgccatcctaggagtatgtagtcttccatccatcaatatgggatgtctttctgtttatctttaatttctttcaacaatgttttgtagttttcagagcataagtttttttttgtctttttttttttttatactttaagttttagggtacatgtgcacattgtgaaggttagttacatatgtatacatgtgccatgctggtgcactgcacccactaactcatcatctagcattaggtatatctcccaatgctatccctcccctctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcttccatgtccctacaaaggacatgaactcatcatttttatggctgcatagtattccatggcgtgtatgtgccacattttcttaatccagtctatcattgttggacatttgggttggttccaagtctttgctattgtgaataatgccgcaataaacatacgtgtgcatgtgtctttatagcagaatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttatttcctgactttttaatgattgccattctaactggtgtgagatggtatctcattgtggttttgatttgcatttctctgatggccagcgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcatgtttttgtcaggtttgtcaaagatcagatagttgtaggtatgcggcgttatttctgagggctctgtcctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttagttttttccaattctgtgaagaaagtcattggtagcttgatggggatggcattgaatctataaattaccttgggcagtatggccattttcacgatattgattcttcccacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccttttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtctttggctctgtttatatgctggattacatttattgatttgcgtatattgaaccagccttgcatcccagggatgaagctgacttgatcgtggtggataagctttttgatgtggtgctggattcagtttgccagtgttttattgagggttttcacattgatgttcatcagggatattggcctgaaattttctttttttgttgtgtctttgccagattttggtatcaggatgatgctggcctcataaaaagagttatggagaagtccctctttttctgttgtttggaataatttcagaaggaatggtaccagctcctctttgtacccctggtagaatttggctgtgaatccgtctagtcctggggttttttttttggttggtagacttttaattactgcctcaatttcagaacttgttattggtctgttcagggattcgacttcttcctggtttagtcttgggagggagtatgtgtccaggaatttatccatttcttctagattttctagtttattcgcatagaggtgtttatagtattctctgatggcagtttgtatttctgtggtatcagtggtgatatcctctttatcattttttattgtatctatttgattcttctctctttccttctttattagtctggctagcagtctatctattttgttaatcttttcagaaaaccagctcctggattcattgatttttttgaaggctttttcatgtctctttctccttcagttctgctctgatcgtagttatttcttgtcttctgctaagttttgaatttgtttgttcttgcttctctagttcttttaaatgtgatgttagggtgtcgattttggatctttcctgctttctcttgtgggtatttagcactataaatttcactctaaacactgctttagctgtgttccagagattctagtacatgtgtctttgttctcattggtttcaaagaacttatttctgccttaattttgttatttacccagtagtcattcaggagcaggttgttcagtttccatgtagtttagcggttttgagtgagtttcttaaccttgagtcctaatttgattgcactgtggtctgagagactgtttgttatgatttccattcttttgcatttgctgaggagtgttttacttccaattatgtaatcaattttagaataagtgcaatgtggttctgagaagaatgtgtattctgttgatttgggatggcgaattctgtagatgtctattaggtctgcttggtccagagctgagttcaagtcctgaatatccttgttgattttctatctcgttgatctaatagtgacagtggggtgttcaagtctcccactattattgtgtgggagtctaagtctctttgtaggcctctaagaacttgctttatgaatctgggtgctcctgtattgggtgcatatatatttaggatagttagttcttcttgttgcattgatccctttaccattatggaatgcccttctttgtctttttttatctttgttggtttgacatctgttttatcagagactaggattgcaacccttgctttttttttgctttccatttgcttggtaaatcttcctccatccctttatttttagcctatgtgtgtctttgcacatgtgatgggtcttctgaatagagcacaccagtgggtcttgactctatccaatttgtcaatctttgtcttttaactggggcatttagcccatttacatttaaggttaatattgttatgtgtgaattttatcctgtcattatgatgctagctggttattttgcctgttagttgatgcagtttcttcatagtgtcgatggtctttacaatttggtatgtttttgcagtggctggtactggtttttcctatccacatttagtgcttccttcaggagctcttgtaaggcaggcctggtggtgacaaaaatctctcagtatttggttgtctgtaaaggattttatttctccttcgcttatgaagcttagtttgactggatatgaaattctgggatgaaaattcttttctttaagaaggttgaggcctgacgcagtggctcacacctgtaattgcagcactttgggaggccaagacgggcggatcacagggtcgagagattgagaccatcctggccaacattgtgaaaccccttctctactaaaaatacaaaaattagctgggcatggtggtgtgtgcctatagtcccagctacttgggaggctgaggcaggagaatctcttgaacccaggaggtggaggttgcggtgagctgagatcgcgccactgcactccagcctggagacagagcaagactccatctcaaagaaaaaaaaaaaaatagaatgttgaatattggcccccactctcttctggcttgtagggtttccacgtagagatccgctgttaatctgatgggcttccctttgtgggtaacctgaccttttgggtgaatctgatgattatgtgtcttggggttgcacttctcgaggagtatctttgtggtggtctctgtatttcgtgaatttgaatattggcctgtcttcctaggttaggaagttctcctggaaaatatcctgaagagtgttttccaacttggttccattctccccatcactttcaggtgtaccgatcaaacgtaggtttggtcttttcacatagtcccatatttcttggaggctttgtttgttccttttcgttgttttttctctaatcttgccttcatgctttattttattaagttgattttcaatctctgatatcctttctaaattatctgaaggttattaaagcttacaccatctaaattatatttagatgagttacctataagctaaaagctagagtcagatggcagtatctaagatgaactcttaagtgtaggtggtatccttgttttctttttcataatctctttaactcgtcttagtaccttatttatttatttgttctgggaaccacatttgagctttgagaggcaggaggacagtgcttgatgtgttggcagctagtaacccctagtttaactgagttgaggacagtagtaatactatggtggcaatagcaagatttttatctctgcagccttatagtacaactgtcttggtttaaaactggattttattttaactaaattctgttttaaaccaagatagttctatataagaatgtctttggattggaagccttggttttagtttattcttgaattgtcaatatcagaagtttagaaatagtaattcaatggcaaagtattattacataataacaaaagatttattgtgaaatactggggccaacatggaggaatggcaagtatacgagctttgaccatagacagaccaggattttgaatcctagttctaactcttactaactctgtgaccaaatgtagatactcatcctgagatttcctcattgataaaatgacatatcatctcagcggagttgcaagtggtgttttacttttatctccatgtaaattaaagataaatgaaacttatgaaaaagtgtttatatagataaatgatatgtaaaatattttctaagttggaataactttgaaaaactatagagtttaatatgaatatgcagtatgtaccattttagcagaataactagtacctcatgtttgtgattgattaaagtatttatttcctcttaaatacctgtgggcgtacttgggcatagtaggcagtctagccactttattagtccaaaaactaagttcattttaggatttttttttaagttctatgtctaaatctgatacaagaatagtaaaagccatgcagtagtagatcttttatcttaatttatgaggctaaaaatttcttataacactgaaaccctttcctttctttaataggtttaaccttcatttctaatacataaatgtaatttatttttgcttagactccactggttggagatgataaaaatataacccttgtaacacagatatagaacctaatggtggcctttggatgatacttcagctctcacccagtaaagtccctgggattccacattccccaaatccttttcttttcattgaaatgccaagtagccctcctgctttttcttccataaccagccttcctgctgctgctcttagatgtcatgctatgctctgccacctggtggttgcaatgtacactgctgtttctgttgctgccgcagttgcctcctacaaggtgcagaggttgggatttaagtctgcaggtgtgatgttcagtgttgtgggctctggaggcagatttctaagtttgaatccctacatcactgcctccttgctgtgtaaccttggacaggttatacagttttcttatctgtaaaataggtagagtaatagtgcttaccctcacagggttgtttcattaaattaatacaaatgctgagaacattacatactgaaaacagtacatgacagaaaacagtaaaatgccaaaaacagtatgtgacacttaacagtgttagttattgttattattctgatctgaatgctttaggtaagcaattaaacgtgtatattttatttggagctatcatagctccaaactgattgattttagccttgagtttattttttaatgttgatcttttctaaatccattgtgtatatactttctgttatacataatttttaattatcactatcatattgtaaagttaagaagtaaaaaaaaaaaatcacactaaaatgtaagagttcttaaagtgagtgaatatcatatggaaataaccacagcacagtagtggaatttttagaaatttgttttttaatttgggaagttaatcagtgaaatgagctttgttctgaaaatgtatcccaattttcgaagtaaactatagattttatttgtgtttttacatactataacaaggtaatttctaagttttacttttattcattcattttccctttctgttgtgtgtgcgtgtgtgtctgtggtattcaaacattattatggtatgatgttctgtttttctttttttttttctttgagacagagtcttgctctgttgcccaggctggagtgcagtggtgcgacctcggctcactgcaacctccacctcccgggttcatgccattctcctgcctcagcctcctgagtagctgagactacaggtgtccgccaccacgcctggctaattttttgtatttttagtagagacagggtttcaccgtgttagccaggatggtctcgatctcctgaccttgtgatctgcccacctcggcctcccaaagtgctgggattacaagcgtgagccaccgcgcctggccagatgttctgtttttcttgtttcttgtctgtttccttcctttttcatatttttatgtatatatataaaacagtattatagtgtggtattctgttttttccactcaattttatattgtacacatttcccttatttttaaatagtttaatatatcataaattactcattttggttggatattgttttctttctgttgtataatattataatggttattttttatttatacagcgtttttatcctctctcatgtgtttatagaacaaactgccaagaggagtcttaagagtacatgaatgattttgtggctcttgaaatattttcccacattttaatccaaaaatgccatgctttttaatgctgttaaacaggaatttactttcacccataaaacattgtctaggaacaaaagtgaaaaagacaggatccctgctctccagggatggagtataacggagaggatacatacagatgaatgactaagagaaaggctgcaatattctgagtgtgaaggaagaactgggatagttggacagtagcagtgtggaaaatacttcttagaggagattgaatatgaaaatgcggttttaatttgaaataattattgatcctactttttctttcttgcatattatgtttgtcatttctgaaacatatttttttgctttgcaacaaaatgacttaactcctgccaactgcatgatatggtagaaagagcacacaggtttggacaaattgcataattgtctaaacttcagtttctgcacatataaaacataaatgatacttcctttagagacttttgaggattatagaaagtgttttttatctattgtctccaggcttatttcaaaaaatatttgaaatgaaagagttaatatactaataaagtatttagcacagtatatggcacataagttagacttagtaagtaggagccactgttggttttatgattgccagtgttaagcattctgcttcttacaaagcgtcagctttcctataaatactgctcagttttctagaagctggaactgccacctcctaaacgatcagaattcacttcctcaacctccagagtaacccagctcttgagtctttatagtaaccaaaaggctagcttctttctttcctttcctttctttagcccctgctagttgccagataccacgttagatgtagggaataggaagataactgagataatatcctacaactgtctatctagagaaatagagtcatatgcaggtgactgtgcacatgtcagagaaatcagtggttctcaaccctggctgctcattagcatcacctggggaagctgtttaaaaataccagtgctgatgccgtactttagataatttagaaattaatgcaaacagaaacaatattctgtaggaacctgtactcattgataggttgagtgagtcattttgattggaaagagaactggaaaaatcttcacaatcagagtaacattcaaaccaacgacaaaacttagtctgtattgttaggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgaggtagactttatgagagaatgatatgatgcaatctccgatttggaaaaaacagccgctagtttataacattgtcaaaagtaaattccagatggaattaaagttatggaaaaaatagagaataatatttctatattttggggttggagaagacctttataaacatgttatcaactccaaagccataaaggaaaacactgagattaacagattttaccaagtaaatatttaaaactctgcaacaaaaggtaccctaaagttgaaagtctggagaaaaactaggggaaagtatttgctacctcaatgacagaaggttaaaaagtacttaatatataatgagctcttacaaatcagttaagaataggcaaaagatttgagcaggtagctttccaaagaagaaatgcaaatggttgctaaagcacataaaaggatgctcatcttcagtgataatcaggattgtaaagtcaaacaagagtggggtcttctaaactttcatgttgatacagatttttaaaagtgaataatatctaatgttgtcaaaaatgtggagaaacaggcaggctgataacgttggtgggagataagttggtgtaacctttctagagagtagattaatggttatctatcaaaacttaaattgtggttgcccttggacccagtggccacaactaagaattatccctggagaaatacaatgttgtaacattgttggtaatgccaagcagtgtaaatgtgtacatatttcataggcattaaacttttttgtaggaatatataccagactgaagaaactggtggagggaggggcacttcatatactactgtaatgttttttttagaacttccatataattgtgtgtgtgtgtgtgtgtgtgtatctatctatctatctatctatctatctatctatctatctatctatctatgccaaatctatctatctgtgccaaaggctagaagtcctgttctggatgaattagatgaggaagaagttggaggcaggaaaaccagttaaagaattttttaccttgttcaagtgtgagaaatgtttgggtctgaattggaactgtgacaatcagaatgaggaagagggaagatttgaaagatagagaatctataaacttgtactatgtgggtgagaagaatgaggaaagactgtcaaagatggttctgaagtcggtaagttatattgctgagtaaatgaccatgacattataaaaaataggaaaaacaagaaaagaagcatctttggagtagaagataatgagtatcttaaatatagatcctcaataagtatttgaacaataaattagtttgggtcagttagctcatctttagcatgtacaatttatgctttcttattaaggctggtcttctgtagttattctgctgcttgttaggagatgtcattaacatttcaaaatatgtaaaaagcaatttctaaatataatttttaaactatttgttcttgttttatattttcagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaggattatactcacttgagtaaatcgcatctcatagccagaaaacgtgaaattctaaattatacattgccacttcattactctttttgtttcaaatcaaagtgcaaacttaagttgtaaaatacacttaaattttttagtaaaaaagcttaaaatgatgaaaatagttttctgtatacttagcaatatttatgattactctttttttttttttttttttgagaagtagtctcgctctgtcacccaggctggagtgaagtggcatgatctcggctcactgcaacctccgcccttcaggttctagcaattctcatgcctcggcctcccaagtagctgggattacaggcgtttgccaccacacccggctaatttttgtgtttttagtggagacgagttttcgccatgttggccaggctggtctggaactcctggcctcacggtgatctacccaccttggcctcccaaagtgctgcaattacaggcgtgagccaccacgcctggccaatatttataattactcttaatgattaatctggttcataccagattatgaaaaaattcagaacactcctaatagtgaactatacacagtgggtgttcagtaaatattttttgaattcatttcaagaatgaaataattttcttacatttccagttaggggattcttaggtttgcttgaccaagttgcacaagatcctattgattgtggattcctcttcttggaaatttttatggagctgtgatttgtgctttgaagatgcttaatttgtcagcttatcactccctttgccaatttgagtagttaatttgtcttgatccactttcatttacaactgccagccaaaagaaaattaaaccttatctgaagacaagcactaaacggatttaaaagaagttatatctccaggtatcctttcttgaaagctggcatgaagctcgtaataaaaagctaaatgtaaaaaacactattacagctatcttcattatccataatatcagtatcattgtagaaggactgcttaatactttgcctctggagttcctttatttcttcatctttagtaatctttccctgactcctcctcagctgtagaaaatcacagttacattctagacctattcatcttgagaaactatgcaaccttcacatcccattacagacttcccattcttgaacagtttctcctatcttcctaacccacttgctttaaataataatttttaaaatgttgaacctcattatgacttataaactattgagcctattaatttctcacaatcttattggacttcatatttgtccatcttgaacttagatttttataagtactctcagttcttatgtctccccttccctccctgttactcatttggtaacagctcagatggtttagcttagttacccattttatttctaacctgcatttgcagaggcaaatattgctggagaaatttacacaaggaagttggtttcactttaagttcataagcacaaacttccactgccagtccaacaaatgtgtccctaagtttgctttcccacgcttcatgacaactgtgttacccattttcctctaattctcggaccttctgtaaccctttccctactactgtcagctaaatttgccttatcttttcttgagaccagagatgggaaggctttaggtgggaattatcttccctttatactagcaaatctgtaaacagttttggatcgcactcattgcctttcttttgtcctactgttacaatgaagaatttcccccttcacatcaaacgtgagttttctactacttgctctagaactttcttcccttttttgtggtcattggtcctgtacttcagttcttactttttaatgtacataagaattacctggtgtattagtccattttcttcttgtaacagaatacctgagccgggctcagtggctcacgcctgtaatcccagcactttgggaggccaaggcaggtgggaggtcaggagttcaagaccagcctggccaacatggcgaaactccgtctctactaaaaatacaaacattagctgagcatggtggcagatgccagtaatcccagctactcaggaggctgaggcaggagaatcacttgaacctgggaggcggaggttgcagtgagccgagatcgcgccagtgcactccggcctgggtgacagagcgagatcctctcaaaataataataatgataataataataacagaatacctgaaactgggtgatttataatgaaaaggaatttatttcttatagctatggaggctaagagatcccaggtgaagaggccactggtgagagcttcctgctaagtggggactctgcagagtcctgaggcagcacagggcatcatcacatgtctgagcatgttagctcaggtctgtcttccccgtcttacaaagctgctagtgatagcccgttgatccattgatctgtgaattgggtctgctctcataacccagtcacctcttaaaggtcccacctttcagtactgccacagtggagattaagtttcaacatgaatttcagaggggggcaaatattcaaaccatagaacctgggaacgtgttaaaatggctgatctgaatgaggaggtgtctagggtgaagcaggagagtctgcatttctaacaagctccaggtgatactaatgctgctggtttgggaccacactgttatttgttcactcccacattgtctgactcttccggtctattggatcattcttataagaatacagatttgggccgggcgtggtggctcacacctgtaatcccagcactttgggaggcccaggcaggcggatcacctgaggttgagagttcaagactagcctggccaacatggtgaaaccccgttctgaaaatatagtaattagctgggtatggtggcgggtgcctgtaatcccagctacttgggaggctgaggcaggagaattgcttgaacctgggaggcggaggttgctgtgtgccgagatggcgccacggcactccagcctgggtgacagagcgagactccatctcaaaaaaaaaaaaaaaagaatacagacttggagactgggggcggtgactcacgtctgtaatcccactactttgggaggctgaggctgatggatcatttcaggtcaggagtcggagaccagcctgaccaacatggcgaaaccctgtctctactaaaaatacagaaattagctgggcgtggtggcacgcgcctgtagtcccagctacttgggaggctgagacaggagaaccacttgaacctggtaggtggaggttgcagcgactcgagattgcaccactgcacaccagcctgggcaacaaagcaaaactccatctcaaaaaaaaaccaaaaaacagacttgctctagtgtcttccatcctaagaaacaaaacttccccatccaaatacaaccctatttctccatacaacagactctctcaagagttgtttgctatttcgttagcctgctcttctctctctctcccatacccattcctaacccgaaattgttcctgagttggtcaaaaaggcaaatccaatcaatatttttctgtccttaatttaaactcaatctttacttctaaagcatgaaccatctttttgaagtttcagtggaaaacccaaggtgtttaccaagccctcctctacttggtgggatttgaacaacaaactctgtctcccctgtggtggcagtttctttggcttctcagcagttttttctccctgcacttcttagaatctttcctacacatgcacagtccagggctcagccaagagttgagggaagtttatatgcagattttgggcctcccccattacccttcctagaatattcctcctcagtatccagctactctagcagtgccagatttcccttgattcctcctgccaaccagactacagttttctccttgagttctagtcacagtgcactgttgaattgagggtaaggccatataaacatggatttcactcagtgtgtttctttctttccaaagttgaattctttcttgcttctacttgctcttggttgctcaccagtacctccaacagatgctttatatattttgtccagagtttataattgctctctgcggggattagtgtgatgcatgctattccactattaccagaaccagaattctacaagtatctttttatagtgcagcttggatcatgccattcttttgctcaaaactcttcagtgacttcactttacccttaaaataaaatgtaaaatttatcgtggcctgcaaggtaccacctaacctgaccctgtgtactccattgtaggctcatggccactgttcccctttctcacttctttgacttccttcccgctatatgccctttctcacctctgaaccgttgaacctcatgtttcctattcctgggcagctcagctcccagctttctgcatggcttagtgcttctgctctccgtcagcttggatagcactttttcctgacaaccttatctaaatgaagtgcctctatcaaccccttgttttctataccctaacactctactttttttctttcatagcacttttcagactaattacttttcttaatcatttaattttttaaaatctgtcttcctcactagaatagtctatgtgaggataggtacaatgaactttttatttctagtgcctacgatgaccttcttcttttcagttttagtatctagaccagcacagtgtttgacaaagagattatatttaataaacactaaactaataaagagaaggatagtttaagccattgaattaagctaggcactttagaactttggaaatctacacaaaattaaggaaatcacttaactaggaatgttcagcacctttatgcagtcatatccacctcattccattttcaaattaggtttaaaacaatttgattcaacctgaactgcagtgtattttttttccttgatccattctaccagccccagcattattttttattctcgcattatgactttacccttgcctctcagatttagtatatgttttctccttctggctcttgttttggctcgtcctaacccagttgccttttttcctggataatgcatccacaagtataaaaaaacctaccaaagaaaaatggcaataacatggctaaaataattatcagcatagtggctaaaatgagtttaaacttaaaaaagcaaaatcacagaagacaagattatattgaatgattgaatcatgcagaggtacacaaaaatcatgaatatattaaccttatattatttggctctacctctgtttcctatctcattttgtgacttctttgggttcactatgtcattctgttacttaaacacgcaagtatttttcctaccacagggcttttgcttatgtttttcattctctctctggaatgctctttcctctacttttcccatagccagcttgttctctttaagatctcagcttaaagttacttcttaaagaaattgtcttagtctgtttgggttgttataacaaaatgccttagcctaggtaatttataaacagcagaaattcattgctcatagttctgaaagctgggaattcccagatcaaggtgccagcagattcagtttttggtcaggacttgctctctgcttcagaatggcagcttcttgttgtgtcctcacgtggccgaaagggccactgtgctccttcaaccccctttataaaggaaccaaccccatatgcaagggcagagcctcatgacttaatcatgccccgaaaggctacacctcttaatattaacacattggggattaagtttcaaatatgaactctggggggcaaacatttagaccaaagcgaaggccttgtctgatataaccatcttttctaaaatagatcttcctgctcccattattttctactcacattttaatgtatttatagcatttacaaatggtttttgttgttgttctatctcccctgcttcatgaggacaggaatcactttggctttgtagtccattgtatacctagcctcttaatacagtatctggcacataactggcattcagtagatatctgttgaatgtgcacatacatgagtgaatggtggtttaaaatgttaatttgtgaccactttgctttttggacagaatcagataaaaacctctttaaaaatgaaggtatttcctcagtggggaaaaaaataaaaacaaggatatttccaaactggcagatcaattacgactacctgacaatgaattagaaagtgtttgttttttaacttaaagggaatgaggctgggtctggtggctcatgtctgtaatcccaacactttcggaggctgaggcaggtggattgcttgagtccaggagtttaagaccaatctgggaaacaaggtgaaacttgtctctaccaaaaacaaaacaaaaaacaaaaattagctaggcatggtggtacacgcctgtggtcccagctattcgagaggccgagacaggaggattgcttgagcccaggagacaaaggttgtagtaagtcgagatcacgccactgcactccagcctggctgacagagtgagactgtgtttccaaaaaaaaaaaaaaaaaggtggcggggggaggggtgggcgggtggggaatgaaaatactacaaaacaaacaaatagaaaacattataaactttcccaggatttggtcctgtcttcttcccctccccgaattggtaaagagaccaaaatgcttaaagatacatgggtgttataaaactgctttgtaacacaatgtattaccatgatagaaaatatggggctgggcatggtggctcatgcctttaatcccagcactttgggaggccgaggtgggtggatcacctgaggtcaggagtttgagaccagcctggtcaacattgtgaaaccccatctctactagaaatatttaaaaaattagccgggcatgatggcgggcgcctgtaatcccagttactcaggaggttgaggcaggagaattgcttgaacccaggagacggaggctgcagtgagctgacacagtgccactgcactccagcctgggcgacagtgtgagattgcatcccaaaaaaaaaaaaaaaaaaaaaaaaacaagaagaagatatgaatgattttgtcaacatgtcacactaaaactacaactcttcctgttaggaacacctaaaaatgcttgataaatataattagaaaagtttatactgcagagttgagtttaaaggaagaaaagggaattcttaggtgccagaaacaaagtggggactgaaagttttggtggctaatggcattaatattttctacagtgccatgattaataaatttgaacttttattgattgttactagagtgaccttaaaatcattaactcaaaaccaaaaattatctaaagtcttctcaagaaataatttatgcaccatgtagacttttttttttttaaactgtttttggattatggactgcttgaataatctgatgagaaagaaattaagctctctcctcaaaaagttttcatatgcagaaattttgcatgtgttttaactgtggcattatgactgccctaaactcccccatgatcatggatatgtctgaaatcataccttaagaacttgattcacagtgttatttattgataacaacaacattaattttagggaaaataactttcatttactagttctaaaatagattgtaaaatttttacttgatattagtttgcttcctaagcattaaaactgacattaccaagtaccttttttcccttagcgctccaaccagttcctgacatacagtgtctgctcaacaactatttgataaattaatgaattctagaatatcaaataagtacccataaactatttttttctgattgtgaagctgaaattttctttatttgagtgagactgatatttgacatcagggctctgactataggcatcttaatgtgtgttattttattgttatatttgaatgtaaattcaaaaaaagaataaaaattcaaactgatatttttatattttaaggtaaatgaacatttgaaagacataatggaacaagaacaaaaactgaaagaacatcacacagttgaagctccaggaggtcaaaaggtatttatttcaaaaacaaaaaggtgcctttatgagactgtatatatgttcacatatttgtattattttgggaaatgttaattgtgtttattaaattattttttagtggtgttaactgtaccctagaaagccatactgtaaacactaagtaaatagaagtacaaaatgaaggttaattggatgatggtgtttgtaaaaaaatatattaatgactagaactcaagttctgaggttcttttgtcaaaaataacagtttgcctttctttggtaaaatgtgtaaaacaacaaggaaacaattttaaatgttcaggctttataatgacatgcaatgcagcaagaccaacatttaaaacaaaattcccagaatttcactgggtgcgatggctcacgcctgtaataccagcactttgggaggccaaggcaggcagatcatgaggttaggagttcaagaccagcctgacaaacatgatgaagccccatctctgctaaaaatacaaaaattagctgggcatagtggcgtgtacctgtaatcccagccactcaggaggcaggagaatcgcttaaactcaggaggcagaggttgcagtgagccgagatcatgccactgcactccagcctgggggacagagcgagactccatctcaaacaaaaaaaatatatatatagggccaggcgtggtggctcacacctgtaatcccagcactttgggaggctgagacgggcggatcacctgaggtcaggagtttgagaccagcctgcccaacatagtaaaaccccgtctctactaaaactacaaaaaattagccaggcgtggtggccggtgcttgtagtcccagctactcgggagacagaggcaggagaatcgcttgaacccaggaggcggaggttgcagtgagccaagatcatgccactgcactccagcctgggcaataagagcaaaacttcatctcaaaaaaaaaaaatatatatatatatatatatgtatatatatacacacacatatatatgcacacacatacacatgtgtatatgtgtgtatatgtacatgcacacatatatgtgtatatatacacacgcacatatatgtgtgtacacacacacgcgtgtatatatgtgtgtacacacacacgcgtgtatatatgtgtgtacacacacacgcgtgtatatatgtgtgtacacacacacgcgtgtgtatgtgtgtacacacacacgcgtgtgtatgtgtgtacacacacacgcgtgtgtatgtgtgtacacacacacgcgtgtgtatgtgtgtacacacacacgcgtgtgtatgtgtgtacacacacacgcgtgtgtatgtgtatatatctacacatatatacatatatgtgtacccacatacacacgtatatatgtgtatacccacatacacacgtgtatgtgtatacacacacgtatatatgtgtatacacacacacgtatatatgtatacacacacgtgtgtgtatatacacgtatatatgtgtatatatacacatacacacatacacacacgtgtgtgtatatacacacacacacatgtgtgtgtgtatacacacatacacacatatgtgtgtgtatatacacacatacacacatatgtgtgtgtatatacacacatatatatatattttcccagaattccaaaatgtacagtatggttgttctgtgaagaaagaagaaacattaacatggatttattcttttaaaaatctcaaacagacttttagaattttcttctctgaaaatttagttgtgtgtttgtcatatgctaagaccaaaagcatattttctatgatatagtatatcttacgtcttttaaaatgtattgtaattggaaccctttaaacatgttgtatagtattagaattgaggtataagaaattgtaatcattcagaaactttaatctccatttggtttaaagtttcttcattattacacagtacttctattattttgagcttattcttattccactattcactgatctctccataaaaagagaaagaagggaaaaaggaaggaaaagcgaagctgttctgtctcttatcaacttcaatagaaaaatcttgtggaggaccacgtacaattttgtctgattttgatgttttgggatcacaatgctttcccccatttggttaactgactggctcctgaaaatacgatttgtgcttaatccttcattctaactctgttgaggtcctttaccctaaaggtagattggaatggaattctcctttttccccatcaccccagattatgtttcatttccctgcttccagccaatttctgtccttgcctcttccctgttacgtcccacagtcttttcttgtcagcttccttccctttctctttttcataatcataggagctgaaacttttgccttggagatatgtgtaatcctgcccctcaattttgctcctggctttttatcagtaataaggttgaagtggcatcattctaaattataacactaatgaaatttctctatagaaatcttgtgtattatatataatggttaaattctgtagtattgcatacacattatgaaccaaatggggattttatatgatgacagagggcccaagaaacatttttttaatgaaaaaaatgccatttgtatttcaaacaatcaaataaagtgatcttgaagaaaaactgtatggaatctagacattgttgtattacatggcttttactttttcacagcacttagctccatgcagttgcacgtattaactgtacaactagtatttggtgaatgggtgactgagtgaataaagaaatgattgtgcaattcatttttaaatatttgattagtatacacttgtagtttagcacatacatagcatttaccccttcattttcaaatgaattttatccttttccccccattgtttttgaaaattgaatctttgtgaaaataagggttaatttaacataatcttactgtaggttcaggtgttgtcattatgaagaaacacacaatcacagaataaactagggaaaggaatcttggtctgttacctaacaatgggatttttggcatttgaactgtgtacttggtttgactggaaatattatcattccattcttggtttttaattctgtaaaagcaaaattcatgctccttttcttcttttacaaatgagagagaaaatgacttgctctttttattgctatacagttggtaagaagttgccactctttccatctacttcagtcagcttttctagtgaggcgtactcaggagcctagccctgttgcctattgcttgtccagctatagacagagcccgtggtattgaataataacatatcttaccttttgtccttgcccaactactcttaactcagatgtccagtagaatttgttttatgaaatatctttttataaccatattcttggtaaaatatatgcacatgttgaaggatacttgtactatatattattagggttggactgaaatgaaagatttcaaaggtatttgtttagggtattagatcctccagtgatgtatttctgatcattggattgggtggtgtcctaagagaaaggcattttaaatagtgtcatgtcctaggaaaatgttttgtttaaacagtttactaatgttattttctcttttttttccaagttgctcattttgcttctaatacttcttttgattgtaaattagggtgcctaattaaatttgaatgccagagaaacaacaaataatttttttataagttgcacaggtgtcttgtattgtgtgagcatcttgtatttatttgctaaatctggaagccgtacttgaacgatttctgaagtttatagccaagatgacattaagtccaacattcattctcttgaagagtttgtataaagtactatggtaaaatgagtattgcacataaagtcaggctagttctgccactaaatagcttcatgacctttacaaaggcacttgacctctctgggccttgggtttgtttttttttaatctgtaaaaattagaaggttggattaaatggtttctaaattctgtaattaaaaagatgctcagtttttcccttctcgatatgttagtaaacatgagacaaaaacaaaaggttggcaaaaatagtaaatagttatcatagacttttctatatgtatattactagtagatttatgctaactgtatgcatgaaatatctaggagtaccttctagaggatgtgggactttaacagggccttagtagatttcatgatactaggtcataaggaacaatataagtagtgacactaagtcacaagtgaagtcacatgtgggaattactgagtggatgaatttggcagaatcagttttgaaagagctatgaattcatgagtttgtattctaatactaactatatagagaatgaagtttaatgtttctcaaaaaattttttttttttttttgagacggagttttgctccgtcacccaggctggagggcagaggcatgatctcggctcattgcaactttggcctcctgggttcaagcaattctcgtgcctcagcctccctagtagctgggattacaggtgtgcaccgccatgcccacctaattttttgtgtatttttagtggagatggggtttcgccatgtgctggtcttgagctcccgacttcaggtgatcccccagtttggcctcccaaagtgctgggattataggtatgagacaccaccccagccaatgtttctcaaagtattaaagatacatgtttacttaatgtggcatttgctactttttaaaaagaaatatttgtgaggtattttgcaagggagtaggaattaggtgaaggaattacctttggagaaaagacatccacagagctctaattgcttttcactttaaggtgtatctcaatatagactacactttccccctgtgagagagtaggtaaatgcttatacctctttgcctgattacttcagcccttatgaatttctcccttgactaaaattccttaacagttacaaactataacccacttttttctccctcaaatgctgtttcttcaaatagtactatttgagagaagggctccgaagtaaaatacatttgggaaatgctgcctagtctatgcccctttaagaatgttgcaatccatttcagtacattaaagtcccagtcaaagagactgtttagccattttccaaacatttttgatctttgaactgttttataaatgacttttactagcatcccatagaattagtgttcttcagtgcacaatttagaaaacggtaatttttaacgtataattttgtacttaagttgtctatttaatatgtatataaatatataaaacatttaatgttcaaatatagcgcatcattctcagatacatcatttcatttgactcttagatttacctcgatttcttttataccattattttagttaactgtgaagacatagcctgtctaaattagataatttttgttttgaatcctacccttaagattctgttttataattataaatctatccatatgtagcctgcttcttcttcttcttttttttttttccttttggagacagggtctcactctattgcccaggctggaatgaagtagcgagatcatggctcactgcagccttgatctcctgggctcaagcaatcttcccacctcagcctcccaactacttgggactacaggcatgtgccaccatgcctatctaatttttttactttttgtagagtcagggtctcaccatgttgcccaggctgatctcaagctcctgagctcaagcagtccgcctgccttgacctccaaagtgctgggattacaggcctttggccaatgtgtagtcttctgtggtcaatgctaattcatttcttcttcttcttttttttaaaatgttttttacattaatagggatggggtttcgccatgttggccaggctggtctcaaactcttggcctccagcgatccacccgcctcggcctcccagagtgctgggattacaggcgtaagccaccacacgtggccatttcttttttttatccctaatatcaacataccttttctctttcataataatttacttgcccttacaggaaacacaacaacctagagtacgtccctgttctattattaactcatttattatagttaagagaacttggcattttaaacatttttttgaattcagagatggtaccatggttttaatctttacctaagagtatgataaccattagatttctctaacagttttataaattaataatcttgtgcatttggacacaagaccctataaagacttggattggtatagatctaatataacttttaaagaacttttattttattttgaaataattacacccttacaaaaagttgcaggaatagtaaaaagaattctcaaactctgttcagattcatcagtttttcaacagattcatcagtttttcaaactgaaaatttcctttatcattctgtctccctctctctctctctctcgctctacacacacacacacacacacacacacacacacacacgtaaattgttctaccacatttcaaagaaggttgcatatatcatgcccctttaccccttaatacttcaatatatatttcctaagaacaaggcaattcatttccataacgacagtacaggtaatttaatgtcagtataatactgtatcatttatgttcccattttatcattaatttatttcgctgtcatatccctagtcttctttaaactgaagcagttctttagcttttcttttctttgtggccttgacatttttaaagaatcgggctattttaatagaatacttctcaatttggctttttctaatatttcctcattattagatgaaggttgtgcttttcaggctagaatgctttgtaaattgtgtccttatcacaatgtaatatccagaggcacatgatatccatttacccctgctagataatgttcattttgatcagttggttaagatattctctggtttcttgactacagggttacattagtcctcttttatcctcagaggatatgttccaagacccccagtgcatacctgaaacctcagatagtactgtatctacactttgttttttcctatacagcaatgggcaggtagcatatacagcatggaatgctggacagaggtatgattcccttcccagactggatggaataggacagcatgtggtttcatcacactcctcagaacagcatgcaatttaaaacttatgagttgtttatttctggaatttttcattcattttcagacagtgactgtgaataactgcagatacaaaactatgggtaagggggggacagctatattatgtttccgtttgtaataggtaatttgagaggagttactctaccactgtaaatagcctatctttcttgaaagcttcccctcatcctagatttagcattcattgaatatacctacctgaattaattttactatgatagtcacaaatttataattttctaaccccttcatttattccatatttattagttagcattctgttataagcaagtttttcttcttccacccatctacctgtctatataatatttctctactatctgaatgagcttatggatatgtaatgggttataatcagtttttgtccttatgtatttacttttaaaattattacagaattattttagatttacaggaaagtttcaaagatagtacaacttcacccagttttctctaatgttaacatcttacgtaattggagcccatttgtgaacagtaagaaagtaacattggtacattattattgagtacactacagactttatttagattctactggttttccactgatgtcctttttaaatatttgtcaggtgttttgtagtgttcttcaatttgggtttgtctgatatttctcatggttagactggagttacaggttttttgagaagactaccagagaggtcatatatcatatcatatattgtatcacggggtacatgataagaacatgatttaacactagtgatattaaccatgatcccttggttaaggtagtgtttgtcaggtttctccattataaatttactggttttcccttcttatttttggaagtgggtcaccacctccatcctgcactccaaaggagggaaattaagctcactccctgaaagggagaatacttgcatatactattggggattcttctgtaaggaagatttgtgtcttcttccccatttattttttatattcaatcatttatttatatcagtatggactcatgtatacttaatattttatgctttgagttacaatctaatactgcgttgtttattttgttgctcaaaattttacagcatcagccactgagagctttttggggttggctttggtatctcttggatatgccccaatccttttgttttttgagcacttccttactttctggcactacagaatgctccaggctcatcttgttctttccttgacctaaaattagctatttctttattttgatgctcaaatggtcttagatttggccaacgggagtcccttcagactgactcctgtgcttttgatatgcccccattcatccatctcttttttttttttttgcccctccttatttaatttctagctcaacaagatgtttcagattcattttgtagtttccttgccataatcctaaaatcagccatttcttcagtaagtcttaattcttttttatggaaaacagtatttagcaactgtaaaatctgggcactaagtggctcattgctacaggaatatcattacttctaggccctatttcagtagacagagttcagaaataaaattttaaaaatacacaaacatgagttcatatataaacctccaattccaatcaaactccacagagttcttcctggcttcccctattccatgcaggacttccccttccacagtgagaactcaggcttccaacagcattaatatattttacttatttgctcagtcctacaatacatatacagtagtttcagaattgctatactcataccaatatgaaaaataaacctactggccgggcatggtggctcaagcctataatccccgcactttgggaggccgaggcgggtggatcacttgaggtcagaagtttgagaccagcctggccaacatggtgaaaccccgtctctaccaaaaatacaaaaattagccaggtgtgttggcatgcgcccgtaatcccagctacttgggaggctgaggcaggagaattgcttgagcccgggaggcggaggttgcagtgagccgagatcgtgccagtgtactccagcctaggtgacagagtgagactctgtctcaaataaataaataaataaataaatttaaaaacctactaagaagaatttaagatttgtttgcaatttttttttagactaatagtatatagtcaaagtacagtgttcttaagttgtttccctctgcccccgccttcactgtggttatattattcctttgaaatacatttgtgttaattggtttctgtattctttccattttagcgatcttttttgacaccatccttgttaacttttgttttttgaatatgtagaacattgacataattccaaaaatcagaactatataaatggtatactcagagaagtatcaatccctcccctatctcttctaccccttacttattccacatgtactccctcccagcccttctaaatggaccaagcacgtatgtgcatgtttgtttctcctcctttctagcacaaaacataacatatttattcttttgcagtttgctcttttcagtaactgtatatcctggaaattactccatacggtccctagagatcattctttctttctttctttcttcctttttttttttttttgagacagagtcttgctctgccacccaggctggagtgcaatggtgcgatctcggctcactgcaacctctgcctcccaggttcaagcgattcttctgcctcagcctcccaagtaactggtactacaggcgagcgccaccacacctggctaatctttgcattttttagtagacacggggtttcgccatgttggccaggctggtctcgacctcctgacctcgtgatctacccgccttggcctcccaaagtgctgggattacaggtgtgagctactgtgcccggccaatcattatttcttaaagcagcatagtgctgccttgtgaatatgtgccatagtttcttcaactatgtacctatgtgtaggcatttaagtagtttccagtatcttgctattgcaaattgtgctgcacagaatactgttatatgtggccttttgtattttggatatgtattttcaaggtaaatttcctagaagttggactgctagattgaagggtaaatgcatactgtatgtagttttgttaaatgttgacgaaatcccctccaaaagagcttgtaccattttatattccatcagcgattcggcataacttttggatctgcaacagctaggagattaagtctaatggctgggcgtggtggctcacacttgtaatcccagcactttgggaggcctaggtgggaggttcacttgaggtcaggagctcaagaccagcctggccaacatggtgaaaccccgtctctaccaaaaaatacaaaaattagccaagcatggtggtgcatgcctgttgtcccagctactagggaggctgaggtgggagaattgcttgaacctgggaggcagaggttgcagtgagctgagatagctccgctgccctctaccctgggtgacagagggagactgtctcaaaaaaaaaaaaaaagattaaatctaacaagttaacaagtcatgcagtaacaagtcacagccatgattaactccctgaaggaccccaactctttgaggtctccaataaagaccacaccaaaccaatatcctcctggaacggcctgagagcacctagaagtagttcaggaattatcctaccttgccagaatgttgtagatacccagaggaagagtattatttggagagtattaatggcaagtcctaaaacaactagccaaaattcagggtgagccaaacatgtattataaagacaattgaaaggaatatttgaaattagaactattccagaaaatctggactgcctaggttggcccctttgtcggtagaaacttaataaaagttttttcacctgttatccatgggttttaaaaaaccctttgtttcttgcctggtggtcctgataaaaagaaaaaaaaaatcaaaaaacctttgtcctcgtggttatttacatcttaaaacaggatttgatgttgcagtttgcctaattcttccctgaaaaccaaaaggatagttgctgatcacttcagaaatggcgttattcttcagcaaggaacttatgctatgtatttgagctttttgaagcatacgtatataagtatgcatagtatatttatttgttcttttagtacatttactctttagttaaatttccttcacacagccaatctgtgggtttcctttttccgccaagaagattgctgttaccagtttagatcaatggagggccaagagaaaggccagagcagtctgaattagtaacaaaatccaattattgcatattttacaagaaatatggaataactttaaccgttaagagacttctttgtacacctgctgttaggaatagtccacaataatttcttgttatcaccattttctatttaatgggttcttctagtctagaaaacaaaaaaatccttgtttttaaaatttctgttacaaattggaaaccctgacacgttttcagtggcttcctgctctttggtcctgctcttgtactttttgtggctattataactgcagctgccaaaaacgttcagttaaatgggagattaaaatacattccacaaaattattgaggctattcttcctggtgctataagaaaaatttattggaaatgttgtttatatgtaggaagctggtatgtttctgattcttcaggtgacatttttctaattcttaaagttcttgaaaataccttatttatattatttttctgtttatacggaaaaactttctacataaaaattttggatatgaattttaattttggatatgaattttaactcagattctatttactttggttcacttcaacaaacatttattcagagccagaagctgttttagcagatacaaagataaacaaacacaaatgattaattcatgttatctgaaattatgggtttattatattcatttttttaaagaagaaaattagattctttgggacagccctagatagtaaatttaataacatttatattctctttgtgtgagtagttacttgctttagacacttacaaaaatcttaactggtaacaattgccaactaggtttttttccattaattaaaagaaactttttatatagtgaaggaaatgatcatcttgatatattctactatattattatttgctttatacttgtttttattgaaattatctttctactttgctttttggggaatattgccttgtcagacacagtctactaatacctaagaattatgattgcaaacctagctgtagaatatttttacttcccttttgtgatatagatttattttttaatatgacatatgattccaaaactcagaaataaaattttttgctgctaaagtatacagcatattctaggtatcctacaatgaatatctgtatggggagaggagagagacaggagaagatagtggtctttagcattaggaacttatgtatttttaactaaaatatttattaacatatgaaatgttatgagaactataaacttggaactccactatcagaagctttactataatttgttaattgaagataattctgatgaattttccctttaccttttgctttccccttttttcccgctgcttcctctgaagtctccttccaaatggttttggaaactggttccagtaagtttgctcagctacttcagtttgctctccagaattgtaattgtagaatggtattgtttatgtcttgctgttaaagtcatttcatgtaattctgttagtcattgaatagagattggattttaaggtcatgtaaaatggaaagataaaagatacagccaaggtttagatcagaagttctaaaaataatttaaagggtaaacatcctgttgctaatcttgtcagtattcacagactatcagtaagtaggttaaaaaaaaaaaacttatgggccaggtgcggtggctcacacctgtaatcccagcactttgggaggccaaggtgggcagatcatgaggtcaggaggtcgagaccagcctgaccaacatggaaaaaccccatctctactaaaaatacaaaattagctgggcgtggtggcgcatgcctgtaatcccagctactcgggaggctgaggcaggagaatcgcttgaaccagggaggcagaggttgcagtgagccgagatcgcgccattgcactccagcctgggcaacaagagtgaaaccgtctcaaaaacaaaaacaaaaacaaaaatcttactatgtagcttctcattaatttaaataattttagtaaatattaatttgaattgcatgaataaattgcctgcatttaaaaatcatctttgtggctgagcatggtggctcacgcttataatcctagtactttgagaggccaaggtgggaggactgcttgagcccaggagttcaagaccatcttggacaacatattgaacccccatctctatttttaaaaaattatctttttgacagacctagttccttttcagcttgaattatagatgacacttcactttttgtgtgattaagaaagcagaaggttttctgtgacctcaccagtagcggaccaaaaccatattaaattctgatttgacttaaagattgatctttcagatttaaatatggggatgggtgtgttaaaccacttaagaactattttacatcctcgataataaaactctaatttagaaatataccataatggccgggtgcggtggctcacgcgcataatcccacactttgagaggccaaggcaggtggatcctttgatcccaggagtttgagaccagcctgggcaacttggcaaaacctcatctctacaaaaaatagaaaaatgaggcaggcataatggtacacatttgtggtttcacctactcaaaaggctgaggtgggagaatcacctgagaccaggaggtcgaggctgcagtgagccatgattgtgccactgcactccagcctgggtaacagagtgagacgctatctccaaaaaaaataataataataaaataaaaataaaacaaacaacaaaaaaaaggagaagaaaataaatataccataatgttgaaatataaaaatatagggggttctttctaaatgccaaacttcttagtttgcagaaagaaagggcatgtttccatgcaataagtttataaagcaaatagcatgttcaagtacaaaagactctttcatgaactgcggatgaaccttctgagtgctggacataatctcaagatttaaagttggtttacttaatatatcttctagaatacaatctttaggaaaatgttttggcatcccattcataattctctgtctagtctaaaccatagatacttattgctaatgtcatataaagctgtgtgtgtgtgtgtgtgtgtgcacgtgcacatacatgtgcctgtttgcacataccttgtacaaaagtgctactttgcaggagggagtagaacaaatcacataattcaattctttgttgcatgaccctgggtgcttggcttagtccaattcaggtcataggctgaaaacaaactactagtcccagcccaattttgaggatgtccaagaggcagactgtttttatcccagataaccaaagaaaagcatgtaaggatctggaacagatactaattgtgagaacggtagcttaagcctagaagataccgctgtactggttgatttcttttttctttcttccttcctcttccctccccatggttgattttaagctgtttcttagctgcaaagtgaggaattttctaagaattatgttaaaatcagaatcaattaaagaatccatatagtacctgcaagtaatttttttctgaatatagttaccccctgaattagggatgtactcttaaatacggagtctattatgcactaattaacaagaaccttcagaaatctttaagaggaaaacatgttccatgaattttgtccttgggtagccagtgagagaaatccaggaataagtatctccttcttcattaatgctgatgcttttctgagagatagcattgaaaagaaatctaacttcactaccaaatgttgtgttctctttcagtaaatttttatttttctatttttattctcacaaaagtgttttatcttataattatattttaattctaaactatagagatgaccaatttagatggaattagaagaaaaaatagtttgataaccttaaaaaaactaccagtaatttatgttatatattttgctagcaaaatactttcgtgtgtacattcactaaatcttcagcattattttacttggctttagaagagttaacagctaataatagctaacctttattgattgcttgctgtgtgcccagcaggatgcatagcactttgtgtccatcatcttacttaatcttccagtggttctatgaagtgggtactattattacgccagtttacagatgggaaaatgagaaatgagagtttaagtaacttgtccaagatcacaaaactagtaagtggcagaaccaggatctgaaccaggatctgaatttgttctcttaactattacagcatgtctcattttttagagatctatttttaaaaattctatctagccacaccaaacaatctttaggaaacaaaggtttcttctctttttctgagggggagcaagaacccgtatacttgctcaattattaatgaaatctaagttggaagggtttttttttttttcactttcaaagttgttaactatttgtgtttcctcaacattcagataataacccagaatgtcttggtgatactattccagttcctcaaatttcttttaagaatagtatattcttttaccttccccctcattttgataactctttctgcttgaatagtattcttgctcttcccgtataagaattttcagtttaaattaagtctgaattaaagtagatgaattttattatcttcaaaagagcagaactgattatttggatacaaagtgttcaaaatctgttttgtgatgcttttatacttaaatatttaagccaaatgtcagttagtgtaaattagcagtatgttatattaagtattgagcttcaaaactatagctattgttgccgtgtatttaactttggtaatacctagcgttatttagaaaaaaagaaatattggtgagtggtctcatttctcatgatttattttattactggtacattagaatttacagtactgatttttttcctatgcgttatttggtacttatttattttcatgtattttttttatatcgtaggctcgttatcggaaagagcaaacattgcttaagcaactgccttgcattccattggtagaaaatttgttgaaggatgggacagatggctgtgcattagctgcccttattcatttttactgtcctgatgttgtcagattagagggtaagtgttccattgtaatacttctgaactgtagacagatagtaaccaatatttaagacagtattattttgcactccagcctaggtgactgagtgggaccctgtctcaaaaaaaagacaatattatttaataagtactgaagacttttttttaaaaataaagaacatttatatataattctgagggaggtagttcaaaaaaaaatagtgctcggtttctaagtcttaatgtataatgactactatatttataaatgtatgtttgttaaccagaattgtgtatttgtactaattacaagatggatatgaaatatttattatcaaattaatccaaagtcaccaccttgctcttttcttatttgaagatatttgtttgaaagaaactatgtctttggctgatagcctgtataatctgcagctgattcaagaattttgccaagaatacttgaaccagtgttgccatttcactctggaagatatgctctatgctgcttcatccataaaggtaaattaaattattctttttttccctttgctttgttaaaatatgtttttttaaaaaacaaacaaaaacaccgggaacagtggctcatgcctgtaatcccagtactttgggaggacaaggtgggaggattgcttaagcctgggaggttgaggcttcagtgagcgatgatcgtgccactgcactccagcctgggcaacagagcaagaccctgtctcacaaaataaataaataaaattttaaaaataaaaaataaaccatagaacaagatatataaatgacctagcaactttaagcttatagattaactatattagtcaaaagaacttttgaagaaagtttttaatttttttctccttattttgttttttaatatactataagctacaagtttcttttatagtgcaaagccaaacttaaagtcatgtacaaaattggccagttgtagtgactcgtgcctgtaatcccagcactttgggaggaggaggtgggcagatagcttgagctcaggagttcaagaccagactgggcaacatggtgaaaccccatccctacaataaatacaaaaattagctgggagtggtggcatgtgcctgtgttcccagctactcgaaggctgaggtaggaggattgcttgagtctggaaggcagaggttgcggtgagctgagatcgcgccactgcaccctagcctgggcagcagagccaggccctgtctcaaaaaaagaaaaaaaaaagtcatgtacaaaattgatctattgtcttaatgtttgcaaaatagagaataagccattaaatgtttcttacaaatagcaatgcttacaaatagtaagattctttataaataatgaagctttctttttcttaaagaatttttaatttttgaattaaaaaattaattgaaaagtaacattatgtactatttaactaccattatgcataaatatatgatatgtatagttaaatgatatggtatccttgcgtatttttatgtgtacaatgagtcattgagcattaaattgaaatttagtttgtttattctcactagattatatataattgttctgtagttaccagactgtttgaaatttgtcacgtttattgtcctttgactgtaggctaatgtatgctgtcagattgtgttaaaataataaaatttcacatgggtagtattattttcttaattttaagttgaatatattttatttacattgatgttaaatgttaaaaataataatcatggctgagcatggtggctcacacctgtaatctcagcactttgggaggctgaggtgggcagatcactgaggcgaggagttcgagaccagcctggccaacatggtgaaacctcacgtttactaaaaatacaaacactagccaggcgtagtggcacgcacctataatcccagctacttgggaggctgaggcaggagaatcacttgaacctgggaggcagaggttgcagtgagctgagatggcaccactgcattccagcctgggtgacagaataagactatgtctcaaaaaaaaaaaatcattattatcatcatcacgaatagatttttgaaaatcattccattccattcccaagtttgaaaattaagttgtgttatgaatactgttatttttaatacttcaagaattatgtcttatcctccagatgttattttagtaatgttagtgttgtactttatgtgagtcaataatataaagtcaattcagaaatcagaaatgttttctagttgagtcatattaatttatgaaatactgaactacaatataaaaacttcaggcctggtgcggtggctcatgcctataatcccagcactttgggaggacaaggcaggaggatcgcttcagtccaggagtttgagaccggcctgggcaacatagtgagacctttgtctttacagaaaataaagttagccaggcgtgatggcacacatgtgtagtaccagctactcaggaggttgatattggaggattgcttgaacctaggaggctgagactgcagtgagccctgattgcatgactgcactccaaacttagtgacaaaccaagaccctgtcaccaaaaacaaaacaaaaaccataggggctttctcttttaatttttaaaggttaaaaaagagtgtttaaaatagtaattatttgaagttcaagatttgctgttgttaaaaacatggtgggaatcatatacatgctatataaacacaggcaacccccatgtatgcagttttagttctggtaaaccatttggaagcagactggggaaacgaactgggtacacctttgcttttgaagaattttaggatttgtttgcagctactctaggttaccaagtgtcacatgtgcatcattagaacaaagccctaatttaagacactgaagaactacagaatgcaagtgtgtaaaagttattaagatgaaaagaaaggagcgttaaacaagtttgtcagcaaaatgtaaaatggcaaaatttggagattattataacttttagaacattgcaggacccacactaatgtttgaaaaatattttagcgagagactattatatgctagacactgtactgagcctggggatttggtcatttattcattcatcggcagatatttactgagtatctccatgtgccagacactattcttagctttggaggtaaagcagagaacgaaatggcagggtaaactataaagccagtggtaaagacatttctaaaataagccactgctcctgctgacccaaagttgtacccagtctcttgtgtctgacacatcaaaaaaaatttttttctaattgatgttgaaggtttacacccttgccattcatatcagaatgaaaggtaatatcatttccatatatatcttgtaatgctttttctggtattttcaggtaataacagaaatattaatttctgttagtaccagaaaaggcatcaacatgatatctacattgtcagctaaaaatttaaatgctacttctgtaatctcaaaggaaaaaaactgtctcactaaatacatggagatataagattgcatttgtttaagttggtataccttggacttccaatacataatatacagtcctgatgtttatatcaactttgtctgggtacgacccatataaagatattttcttaaattaggtatatttaaactatgattttctacagaaagggctttggtcactttctatgttctttacttattactaccacagctttgacttcatttgaatctttttttttttaattcaatcttattttaaacttttagcttaagctcaagggtacatatgcaggtttgttacataggtaaacttgtgtcatgggagtttgtggtacagatttttatttcgtcacccaggtattaaccttaatacccatcagttatttctcctgatcctctccctcctttcaccttccactcgtggatagtttgcagtttctgttgttctctttctgtccctgtgttttcgtcacataagtgagagcatgtggtgtgtggttttgtttctgcattagtttgctaaggataatgacctccagctccatctgtgttcctacaaaggacatgatcttgttcttttttatggctgcatagtattccatagtgtatatgtaccccattttctttatccagtctagcgtcaatgggcatttaggatgattccatgtcttggctattgttaatagtgctgcagtgaacatacacatgcatgtgtctttttggtggaatgatttatgttcctttgggatatacccagtaatgggattgctgggttcagtagtatttctgtttttaggtctttgaggaattaccacactgttttccacattggttgaactagtttacactcctaccaacagtgtgtaaatgttcctttttctctgcaactttgtcaacacctattattttttgactttttagtaagagccattctaaccggtgtgagatggtatctcattgtggttttgatttgcatttctctaatgatcagtgatattgggctttttttcatatgcttgttggccgcgtgtatgtctatgtcttttgaaaagtgtctgttcatgtcctttgcccacttcttaatgagattatttttatcttgtaaatatgtttaagtcccttatagatgctggatatgagaccttggtcagatgcatagtccgaaaaattttctcccattctataagctctctgttcacactgttgatagtttcttttgctgtgcagaagctttgtagtttaattagatcctatttgtcaatttttgcttttgttgcaacttcttttggcacctttgtcatgaaatctttgcccattcctatgtccagaatggtactgcctagattttcttccagggtttttatagttttgggtttatatttaattctttaatccatcttgagttaatttttttatatagtgtaaggaaagtgtctgttttccatcttctgagtatggctagaccgttatcccagcaccatttgttgaatagggagtccttccccattgtttgctttggtcagctttttcaaagatcagatggttgtagatatgtggccttatttctgggctctctgttctgttccatttttgtaccagtaccatgctgttttggttactgtagccctgtaatatagtttgcagtcaggtaacatgatgcctcctgctttgttctttttgcttaagattgccttgggtattcaggttcttttttggttcaatatgatttttaaaatagttttttttagttctatgaagaatatcattggtagtttaataagaatagcattgaatctatacattgatttgggcagtatggctattttaacaatattgattcttcctgtccatgagcatggaatgtttttccatttgtttgtatcatctctgatttctttgagcagtgtattgtagttctccttgtagagatctttcacttccctggttagctgtattcctaggtattttattctttttgtgccagttgtgaatgggattgcattcctgatttggctcttggcttaactgttgttggtgtataggaatgttagtgatttttgtacattaattttgtatcctgagactttgctgaagttgtttatcagcttaaggagcttttgggacaagagtatgtagccttatgaccatcttaactaaaagaaggaaagaagaagcttttaaatgaattaatctggcatcattcctgaaatatggtgacagatttattgctgtttaatcgtcatgaactcagaaagacataatcttcataagttttaattactgggaaaattatttcttactctactgacatcttgtggccaaatagtacaattaatgttattaggatggctatcttaccaaagtccttaaaatattaacttattttctgttcaacagataattattgagcacttaagcagtattttttcaaaatataatcagctttcagttaactaggctagtaaaatggaacctagcaccagtacttaaaaaccaattttatactttggctttagaaagtataccataaagataagtataaagaagaaatataaatcacaataatcttactaatcagaaatattgtgtcaatgttttgatgttttactgactgttttttttagtacgtagattcattcatttgtacattcatttaataaatatttattgagcacctatcatgtgccagacactgttttaaacactgaagatataatgatgagcataaactttgtctttttagactttatcatctggagggtaagatgaggaaacttggagaatgtagtaatagataaatctgggaagagaaaaagggactgtaccaagtagcctcttgtaagccatagtaagattccctttacctcaagagcaatggaaagagagttgcattttgaaaagtttgttttcttagcaagccaaagaaaaagctattgtgttccaaacaaggcaaaaatgtttgaatcagagcagttatgatggagagaagttggtgaattccagaaatatttaggatgcaaaatctgcatgctttggtgatgaattggacatgggagaaagaaggtgtcaaggatgactcctaggtttctggtttgcacactgggatagtggtgccattcagtgagataaggactgcagtaagatcacatttgtagggaaggtcactatttcaattttggacataggcctttgagatatccaaaagaaaatgctcggtaggccactgcatatataagtgcagtcagtacatttgagaatcatttagtagctgatggacgtaggcatggcagtgtttcaaagaggggcgagatcaggaatatcaaatgcagctgagaggtcaagtaagatgggaaatctgtttgatttagcaacatatgtacatcattggtgacttgagcagttgctgttaggggaatgatgtgactcagtgccaagactgaagtagattagagagtaaaagtgatgaaatggaaaatgtcagtagaggcctgctcctaaaagaagtttgtgaagaggtaaaaagatggtgggaatgaggagaaactagagaatagttattgagtaaaggttttgtttcatttattttgatgggagggatttgagcatgtttaaaagccaaataggaaggattctgttgacaggggaaggatacatatgtaggagagaaaagtaggattaagaatataatggcattcacagcaatttggatggaattggagaccattattctaagtgaagtaactcaggaatggaaaaccaaacatcatatgttctcactcataagtgggagctaagccataaggatgcaaaggcataagaatgatacagtggactttggggactcagggaaaaaagcaggagggaggtgagggataaaagaccacacattgggtacagtgtacactgcttgggtgatgggtgcaccagaatctcagaaattacttaaagaacttattcatgtaaccaaacaccacctgttcccctaaacacctattaaaataagaaataaattttttaaaactgtaaagtttctgagaagtcaagcagggatgagagccactgcatagcctttacggattataagcattcttattactttttttagtcacaaattttaatggctgcttcaattagtatgtatctgtatatcaacattctaaaattctgagaatttacagtaaaagcaaacatgaaggtaaagtagaaacctaccaaatgctcttcaccactgtgcattatcttctgtaatactccagactcttacactcagccacctacaagacaggtccacttaaatgtccagtgaacatctcaaacaatgactctagattcctttcattacctgtttctcccagtcctttctatctcactattagttgctcgagacaaaaacctaagagtcatcactcttgattcttctcttttcatcactttctttttatttttttttagagacagggtctcactctgtcacccaggctggagtgcagtggcacaatcagccaaatcctgggctcaagctgtattcctgccctagcctcccaagcagctaggatgacaggcacgtgccaccatgcatagctaatttttaaaatttttatagaggcaagctatgttgcccaggctggtctcaacctccaggcctcaagcagtccttcctcctcagcctcctcaagcactgggattacaggcatgagccactgcgcccagcctcttttcttcactttctacatacacgatagccttccagaactatcagatgagagatgatatttgaaagtcaccaacttaaatatgagaaaaccaagagaacgcatgagttctagtggagagcatatagagtttaaggattattcataattagcaagtaggaagaaggcaagacattagaaaataaccatatccaggataatcttaaaaactttaatatgaaataagaccttattaaacattaataaatttgatagtaactattttattaaatgccaaacacccaaaatttagaaaacatattattttaaatagttatgaaaacagattttgtagtttttaaaaatttaccgaatgcctaaaattgaaataattcttcatgcttacagcttttattttatatgcattttaaaatataaacttgtagtagaaatgtgcttttgaggacccttaatcctttctcttaattttaagccatttaaaaaattatttacattttaaaatagtaataataaaaggtaacattgttgacttattgataacttttcaaagttaggtagatacattcattgtataaataatgttttgtacatttcaaaattattaaaaattagctataaaaatttagttttggtgttatttagcacctgtattactggtgagtttaacattactgagcacatacatataactttttttgtttaagacggagtcttgccctgtcacccaggctggagtgcaatggcatgatcttggctcactgcaacctctgtgtcttgggttcaagctattctcctacctcagcctctcaagtagctaggattacaggcacgcgccaccacacccggctagttttttgtatctttagtagagacggggtttcaccttgttggccaggctggtctcaaactcctgacctcgtgatctgcccaccttggcctcccaaagtgctggggttacaggcgtgagtcaccacgcccggccaaataaagtatttttttaacactacatccagttacgttttggagaaatttctagggatctgagtagagcttagttatgttttgaaagtgataacccctctttagagtgtcagatgattgaataactttttaagttgcttatatttactttggaatgaaagtgccttatatattatctcagtgttctacacagttagaggtattcatgcctgctagatcaattggaccaccattttagaactatagagcaaatgatcagcaagaggttttgaatagttataatttttacccacaagagttaatattccatcccatgtttaatagcctactatagtgaatatactccagtgatgaatgaatgagatttaaacctatattttaaaacaataaaattctgtttatcatgaagttttacctaatgtaggctttctcttaaatttcctatatagagtaattatttggtgttcatggcggaactgttctggtggtttgaagtggtgaagccgtcttttgtacagcctcgtgttgttcgtccacaaggaggtaatcaatctttttaattttaaatgttcctatgaacagaaaaaaatggaatgttgatataaccttacctggttacatttttagaaatcagcctattattttttttttagatttcagctattacacttgatagattctcctaacctcttaaaatggttagaggagaagaaaaagaaaatggagggaatggctttgaatttgaagtcttatgatgtggaacttttagctttaactgtccatttcttttctttgcatcttttatcgttatcccagcttttattcccttttagattcttagtttttaacattgtgttacccagaatccccacaaattattgtttggccttaacccgcaactcgaatttgccattaaactataaaaaggtttgtatggatttttaaacctagtggattttatgactattatatcatgaactattgattgtacataataagaataaaattagtaagaaataagggggttactgtaaagacccctagatataaggaacaaaaaatcttcctaaattttctgtaaagcaaaatttcacatagcaaaaccaattttctcttggctcccattataaaactagaggtttatttctaggctgggtgcggtggctcacgcctgtaatcctagcactttgagaggcctaggcgggtggattacctgaggtcaggagtttgaaaccaggctgggcaacatggtgaaaccctgtctctactaaaaatacaaaaattagccgggcatgttggtgcatgcctgtaattccagctactcgggaggctgagacagtagagttacttgaacccaggaggcagaggttgcagtgagcgagattgcatcactgcactccagcctgggtgacagagatgagacaccatctcaaaaaaaaaagaaaaaaaaaaaaaactagaggtttatttctatagggggaaaaatgatcttaaattataagcttagcccactaaagaactttcttccagcataacttatggaaacatttctgtctgctaccaatagctgccctacccaacgcaacacatgatcattgtgcatcccaactacttagcagctttccttggctccaaagtttgttatttttgtaactgctaccgttacctgcacctccccgctaaacccccaaaaaataaaagaagagaaagtgatcaggaaggaggaaaaacatatgtagccaaaggggaggcatagtctagtgagtacaatgaggttacttcaggcagcccaccgcatctcaggcaaaaatctgtgaaataagcaataattagagtattgctaagcttcttaaggcagattctgaatatcgagtcactatataacattatataacttctttacatgcctataaaaaaattgagatgctcccctaagtccattgaatgaagtcagatattcttagtaattttcataaccaatatttgtataatttttaaaaattattaacagggttttcactacattgctttctgtgatttcacctgtgaagctcactattcaaaataccaacagctgttgcatcagatctcaaagtcaaaaagtaaattgagtcttcctccagagttacttacaaaaataaaagtataccagcaggtttaattattttctaaagaaattctgtttttctctaattgaccaaaataccagctgtttcataaagaagcagagctgaccatatgtatctgaagttctatgaaagctttcacaaaactaaacgctcaaacttatttttgttttttttttgtttgtttgtttttgttttgttttgttttgttttgtttttgagatggagtctcgctctgttgcccaggctggagtgcagtggcacaatctcggctcactgcaggctccatctcccaggttcacgccattctcctgcctcagcctcctgagtagctgggacaacaggcgcctgccaccacgcccggctaattttttgtatttttagtagaggtggggtttcaccatgttagccaggatggtctcaatctcctgacctcgtgatccaccggcctcagcctcccagagtactgggattacaggcgtgaaccaccacacccagccacttatttttgttttaaatacatgtatttattttatgttaggctttttccccctaattatccttaatcagatgaattttttaatttaagaaatttttggctgggcgtggtggcttacgcctgtaatcccagcactttgggaggttgaggcgggcagatcacaaggtcaagagttcgagaccagcctggccaatatggtgaaaccctgtctctactaaaaattcaaaaattagctgagcgtggtggcgggtgcctgtagtcccagctgcttgggaggctgaggcaggagaattgcttgaacccaagaggtggaggttgcagtgagctgagatcgcgccattgcactccagcctgggtgacagagcgagactccgtctaaaaaaaaagaaagaaaattttttttaattttgaaattaagtctgaatacttcaaaaagatcttaaagaaacttgaccctttgaaaattatttaagaagaaaactttatgctatgatttctcaatacgtagaaagggaaatagaagttaaattttgttataaatttgcttatggtccagaatttttcatagaaatatgctaatttgagggtgtttttaaaaatcttttattccagctgaacctgtaaaagatatgccttcaattcctgtcttgaatgctgccaaaagaaatgtcttagatagtagttctgacttcccttcaaggtaaactccacaatgactttattttcaccatttctattctatttactaattaaattacataatattatattacattaaataaggtttttaagaatttcagttggattttgaactgttataattagcttaccctattaaagcctgttttaacttaaatataaattgaaatatacactgaaatgaatgtttatgtaccacactgaaaagatgggacaatatattctaagttcccaataaccaacctaaaaccaaacttttgatgcataacttgttcataattgagaactgtctaataggtaactcttaggccttggagggaaattttgaaattctattaggacttttacatattttattattttaaaaatctttgaaggtttttcctgctttttttttttcttgttaggatagctattgagagatcacagtgttacccacacaacgggtgggtttggtctcttggcagatgacagtccaaagccacaaccaaggaggatttaacaagacgaggattttattacttgcagcaagtaaggaggacaccgggaataattccccaaagcagtgcctcctcaagcagaggtgaaaatagggcttttagtaggctggttaactgtatcattgtgtgtagaggtggagtaaaggcagtaaaggcacagtcatcagtcatgcttctgcatactggcatgtatagaaaatgcggaataagctcctccttggatgggatttttagtgtggtaatggtaatacatttccgtctcaggcatctctacatccacccagcttgtgtagtttttgttttgtaatgtggggttgggctgcttcctggaaatttctcaaacaataaaaatttcaaggtgcaacagttacaagcaggtaccttttcacagtgtgtacctgaaaacccaaggaccctgggttacaacaatagaatatttattacaatattaaatctttaatgttttagtacatagtattaggaactaaactgaaagcaaagtaaaaatgtcctatcatattaatacctagataatcctgacttctcacccaggtatatgatagggacattagtttgtttaaaaatgtatttcagcagctcctataagcagctttttatttgaatctattagaacctacaatttatattgactttggactccctaatctatctgattttttacgttaaaactaatgtcttttgtgggtttttggaaattcagacacattaaaaatacatttcaaaaattatgagtaaaacattcaaagtaatttctgtatgaattcttggcttaacacaaaaatatgaaatttagcaggcatggtgggtcaatagtgacatttccttccttgaagatttagaaaacactcagtgttctaggtcatcactcttgctctattaaatctttaaattccactttcaaagtggaggaaagtaaagctttccactcaaagattagattattccataattattctaggaacctaaatggacagtctcccacatttctgaaaaatgttttaattcatgtcctctggaaaactcatctcttttctgtctctcagacatctcagcagctcatttttcctatttttcccagcagaaactctttttataatgcagatggatgtctacattcttttccttgaaaagttattgtgtagccattattctaggctattctgagttcctagtcatcctctcatttctataagtctccatatggtccattgtagttctccaacactgtggaacttttgagaaagaattgaagtatttttacccttcctgggaataatgtagccacatctcaaatgttagtgaacctaaataatgattttatgagaaagaaaaaaacaaaggacgaagacagacaaagcaaaagatgttttcagcagctactccacacacttggctaccagctgttggagatatacaaacaggtccgtgagcagagaggctgtcaaggtattttactagggtttattatacctatagtttttagagattagatttgaccaaagtatttcaaattggtgagtttcattttacttttttatatatcagtttttatgtttataaaaatgaaaataattcatatctcacaaagacattgagatgtatatgaaagtacttcaagttgtttggctaaaagacataaaatatatatagatacatactgtaatcacagccattctttggtttaaacaatatgtttccatatttttaaaatttaggttgtagaatgagaggtggtagtgttgtttctaacttaagacattctacctaaatttatattaaacagctaaaatataacattttaaatttattttccattgcagtggggaaggagctacatttacacagtctcatcatcatttgccttctaggtattcacgtccccaggctcattcttcagcctcaggtaatatatttgaaaaagcctaggaaaatactcttttaagtaggttacctgggaaatgattgacagtaaatataaataaacaaatatccagggtttttttgtgtgtgtgtgtgtgtgtttttttgtttgtttgtttgttttctgaaaaatggctattataacacactaaaagcatggtcagtttcactgtggttgcttttcttgataaaattatctctaattctccttatgtacctatttaatttgtattgctattaatgaatcctcaaatacatgaaatctcctaagttgctataagttaatttttttacatgatttcaatggctttttcttttttgcatttgaaggaggaattagaaggtcttcatctatgtcttatgttgatggcttcatagggacatggcccaaagagaaaaggtaaacaaagagaattacttttagtgtattcagattattaagaaatgcaaattgcatctgtgtctctcttttattgataaccaaattgctaaaacttttaattagttcctaaatttgaaaaaggcagtataggcagatgatagagatgtaaaagaggctaactttaaaaagtagctagatagccctccccttaccttgaagacagtatgattatgagaactggggaaagaaaggaaatgtaatttcaaataattcttgttaaatgatactaaaaatcatttctaggatttttaaaggatttttctctttaacttttttttagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggtgtagtattaatctgcatagttttgggcatcttcattagatgagtgtggttgtgttggatattttttttttcagttgacatgcttgcttctttcagtagcagtcccttttgatacaagttcatccccattaactatagtaacattcaagcacactgtggtttccagtatggactcaaagctgtaataaatccttttatcacatgtttagatgtattccttggttttgctcctctactgctctttctcactcacaaaagccttttaaaaattaagctactcagatctcttcagagaatgattccattttgtctcttaatcatgtaacactgccattttttttaacagaatgctactgtagacactaatagatattaaaatttactgcctagagactctgttccttgcagaggaagggaaacaaaggggaagaaaatcattagtataaaacaggcagtacctctgttgcttcatttctattccatttatttacacatcttcaccaccccattactcatctgttggactatggttacagcttcttgactgggctgtctgtctccaatcatgccattccagtcttcatactgctactaaaggtgatagttccaagagcatagctccaattgagtctctttctagtcaaaaatcttgcctgttgaataaagttcaaaccctttagcacaacattcagggactttcacagatgaacctaaatctttttgtctagcttcttccccataattttattttgtattgttctttaagattaacttcaagcttcatctaaagccttttataattccttcagtcgaggtcaaatgtttcatcatttgtgtatctattgtatccttaaatatactcatacctgtcctgtgtcccggagttttcaactgttttgtatgatttgctttgtctcttagaccatgacctcctagaggtgctgcatctttttatttttatttatttatttatttattttttgagacagagcttcgctcttgttgcccaggctggagtacaatggcgcaatctcggcttaccacaacctccgcctcctgggttcaggcgattctcctgccacagcctccctagtagctggtattacaggcatgcaccacaaaataaattttgtatttttagtagagatggggtttctccacgttggtcaggctggtctcgaactcccaacctcaggtgatctacccgcctcagcctcccaaagtgctgggattacaggcatgagcccccgtgcccagccaaggtactgcatctttttatccccatagcataataaagtgtctggcaaactacaatatatgtaatttgatagatgaagacatatgaatgtttgaactaattgcttgaatggtatcttctgactttctccattcagagttaaatctctctctgggtttccatacaaagcctgttgtttgtacctcttctccttgtgattttttaggctccttgacctgaggtaccatatattttaatatatgtaatatctgacactatgttgtgagtatgttagacaccaaagaaatgtttattgaattaagcattggcagggacagttgacaaggagacattaagacagtgaaccacttctacaacagcttgttactttgctgaattctgaagcattttggaagcccgctgagaactagggctgtccctaaggattcaggtagaaactagggcaggcccaggaggcctatagataatgaactagctctcaaattaaaagtactgtagaagggaagtataatcatccccatcttttcttcaatggaaaaatgttcattatagttcagaacctatcaagcagactgtcagtacctcaacttaaaatcatgcagcaatagtttcatttatgtgctacaacattgggtggctaattttgggatgtttttacttgaggtatttttactgagcttatattttaaataaaatttaaatgcaattttaaaaattggtgggggaactacctactgtaagttattaaattagggttaaaaaaaatttgtgcttttttgttttgtttttatggttgttctttgcaaatctcataggttttgacagagtgtaattaaataagtttgcctgtcctcttttttgatggaactgttaccactgtagttccgttcttccttcataatttctcaaccacacccacattcagaagggttgtaatagttcaaactttcagttataggactaaccacaaaatgtgactacaacaattgaaaatgagaatattggtacctaaaatgtttgatcgttttcaatgaaattcgttcttaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggtaaaggaaattgctggcccagtgctagatctgaactttaatgatgcatgggcatatttagaaaaagttggtaagtactcaaagaggtggtctctcattaatttttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacacacacacgacctaaattatctcaaatacctttatttttatttatttatttgactcttccttccctcctttatttacttatttatgcttaatcccatgtctcagcagaatcgtcaagtaccttttaaatgaaccatttattcaccaaggtgatgaaatagaattctcctttctcatatcaaatacataactctctcctgtatggtttgtctttggtatgcagaataagaactgtaaccatttgatttcttaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccaggtaacatagcttattatgaagagtctgttcataaaaaacaccagcttgattggtttgtcatactaacttggttgtactttgatgtgcaaaattggatacacagtttgagattgtgcatgctcccttttggaaaaccaaaatgagcaaatgaagtttttaataaattaaatgtattatgtgtgcatgcatatattcagtagaacaaatgtgaatgctaaaaatcaaatctaaatattaatctattagggaactgtgccctcagatataatctccttgaactattaactgccctttacatacttataaatttaaataaatgttatatgcatgaaatgtacaagaaacatgttggtataataaggaatgcaagatcaagagttcacaagtccctccttcaagatagaaatggttgaaaatccaaacttataatatctggagttgagagaatatattttctttaaaagtcagtatacatactcattattactattattattttttgaaacggggtctcagtctgttgcccaggctagagtgcagtggtgtgatcatggctcactgcagcctccacctccctgggttcaggtgatcctcccacctcagcctcctgggtagttgggactacaggtgagtgccaccatacccagctaacttttttgtattttttgtacagatggggtttcttcatgttgttcaggctggtctcgaactcttgggctcaagtaatctgcctgccttggcctcccaaagtgttaggattacaggtgtgagtcactgcgcctggccatactcttatttttaaaaaaatcttggggggcagggataaattcgtaaaaataaaagaaatctttattaaaaccaaatgccatggaaattttttagagaattctcatagttatactaaacctgaggaaaaataacataatattgactgtttaaagagaactctgttttcaagcctgtaaaactaattgatataattttctacctagaatttagatattatgaaatttttttttgttattgtttttttctttaggatcacagtatcacgtctcatattaacactttccttttggaacgcaagttagttttatcattgtttcctaaaagtaggttccttgctaattttaaataaattgtgtatatatgcatgcaagcatattatgtgtttaaaagtacagagaaaaggaaaagaaactacagaagctcaatttttatatgctggtgttatctaatgaacagactctttgctagttgctccttttaaatttctgattttgtttttattcaggatcatgaatttatcgtgttttttcagtctctagcctttctttggcatcgctgaacacgggtgataacgagagtgtacattcaggcaagaggacgccaaggtaaatctataacgtatgaatatttttacagaaaagaatatagtacctgcaattatacaaactctaagtaaaaattcttcagtgtttttacattttataatgaccaaatcataatcacaaattttactaagttttgctgacttaggactgttagagtttctgttaaaataaattatgtaaagaggtgtctattcatctttcagtgcttgtcttttagaatttagaattattgacattgataacatactttttataagctatgaaacattaacagtaattatacatcagtaattgctaacatgattattaaatcacagtcagtagaatgagagtaccaacttctctagtctattaccaactaagacaaaggagttttccccattagaataattccaaagtgggttgcctatgacttaggaaggatctcttttgtattttctttctctaggattctttctctagattagaagctaaaagtcagtattttattactttatactataatatcatatcagaaaagaacatttctagtgacagtcatcatcttagagttcttatctttgtattaccatcctttgtgttatttgccagttttcacattgaaaaacattcactctttcaacagatatttatagaatgcttactatgttctaggaacttggatgtgtagctgcgaataagacaaacaatgttatattattttttattattaattttttttttttgagacggagtctttctccattgcccaggctagagtgcagtgacacgatctcggctcactgcaacccctgcctcctggcttcaagtgattcttctgcctcagcctcctgagtagctgggattacaggcgcgtaccaccatgcccagctaatttttgtatttttggtagagacgggctttcaccatattggccaggctgatctcgaacttctgaccttgtgatctacctgcctcggcctcccaaagtgctgggattacaggcatgagccaccgcgcccggccttatcatattatttttaggcctttaggttgattttgattgttactttcacgtataccctctgggccccattttttctctgtttgagacataaaacatattttattttctaattagatcagagtctgtagaaggcttcttatctccaagtcgttgtggcagtcgaaatggagaaaaagactgggagaatgcatcaacaacttcttcagtggcttctggaacagaatatacaggttagtgtctatacatttttagagaaacatttgaatttaacacactcataaatggagggtgtactaaagaaaattttattggctcacctttgggtcttaaacataggcaactaataaacagtgaatgcaggtggtcactttcaggtagttcagtaagtttctaaacaaaattagtgatgctacttatatctcatccctctaaccaatgctggccatttctgtgtgtagtttgggtccgaagaagttttagagaagttctacatagttcctcagtactgagtaaaggctagaatccaccaagtcctctccctaatactgggattccaggtatccagaattgtgcacctttagcaagtattaagaggctctaaaagataagaatgcattgaatctaggaaggtatctagcctcacatatcgccaccaagtcctcttctagcttctaggtaggcatgattggaataaaagcaatgaagaatagaatgtgggttaaggacacttctaaataaatgaagcaggagagaaatcagaagaaatgtcagcagcacgttgagaggtaagataggaaggcatgggagaacatgtatggggaagagcagagggaaaaggagatgcctccatctatccatgatagagtggaagtggaaaccctagaaaggcctaaggaggttagaacttgctagagacccactctgtggcttttaatactacctcctaccgccagtctgacagcctttaaggcctgggatttgacagtatttccatgttactcactctgcttctctatgttagttcagttgaacaatctgaaaaagaaagcttttttttgccttttgaaaagacttaaattactcatggacccattctactctaagctaaccagtaaccgtatagatttaagaaagaaggttaaataggcagtatgacagttatagcaatattttatttttagtactgctctcacagggtactccaaaaggccataggaacatcctccatatctctgggtggataaaacaatgttttggttggattgcagccagtaagaggcctttaagcacagaatttggtcttctattacaatatttcagcagtgtaggaacaattacatcattttaaaatagtagtatttctgacttaggaatgttatttttattattgttgttaaatccctaccataggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatgttgtttttgttttttattttaaaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcacc

SEQ ID NO: 37786 - DNA, 27179 bp, Homo sapiens
gcagcgccggaacctcagaggcgggtcgcagcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaagggtgaggcacggcggggaggggcaaggtcatgcctacggccgcggcgcctctgcttccctcccaccccggtttcggccgtcgcctgcttctcccggtcgttctgggctggccccgcccctcctcccttgtctcccctccttccccgctctcacccgctcccggagccgccgggaccccttcccctgcgcagctgcgggagaggcccgttcccgcgagtgcccccgcggcgcagcctcggacccagggcctgcttgacctcctacctctggcccgccgcccctgtcctctgttcccagcaagttccttctgcccttttaatcccccgaagcctccgtttccacatgttcttgacaagatagacttttctgagtcttttggggactaaatgaaacagtgggtatgaaggcacctgttcagttttaactggtatcttgagtcgttctcctgcttaacgtctttggtaattcttactgtttgtcacaattcggccccaagaagacctctggggccagcccagcccgtctaggtgttgtgatggccactcctgcgtcggctccgcgtgtactgggggccgagggggaagaagggcccgtgtgggtgactgaggctgtgtcctcggtcttcggataacactggaggggaagaaagctggaagctttgttatcttggttgtgtgtggtattcctggttaggggactatcgtcatcatccccgcgaggtagcaggggcctaatgagccagtgttactctgtgttatagcccagattaagacccgtggaagggcccggcccggtggctcacgcttgtaatcccagtactttgggaggccgaggtgggcagatcacgaggtcaggacatcgagactatcctggccagcatggtgaaaccgtgtctctactaaaaatacaaaaaattagcccggcatggtggcgcgtccctgtagtcccagctactcgggaggctgaggcaggagaattgcttgaacctggcaggcggaggttgcagtgagccgagatcgtgccactgcactccagcctgggtgacagagcaagactccgtctcagaaaacaaaaaagcgacccatgcacgttaaatattccacccagagtcagccatgagtcaggtggtgaagaccgcatctggcttttgacacatggcccaccctgtggcagggtgcctcccagtctcccactccgagggtgcggaccttggaggaggcgctcagcggatgttatctgttaccattacttagtacgcttccctcagatatagtctttttaggttatttatggtggcgtgtcattctggacggttcagcttgaatcgatcactctagaaaggttgtgagccccttcgctgaggcgtccttctgttttccagggctgaagaagatgcagagcagcctgaagctggtggactgtatcatcgaggtccacgatgcccggatatcctttcacagagcaggggaggcccctctgcctgaagtcatattacacattagaattacctggggaggcttttaaaaatatgaattgcgaggcccctttctagaccagttaatcagaatctgtgatgtggggtccagactgcgtgtctttgaaacttcattgttaatacatatatctgcgtcactcaagcctgacggtacggtgcagcagtggaatcctctagatgggctatgaaactgtttaaatgttcctgccaactggggcttttctcctgtacttgaggaatgaattggcaggatgtgatgattcgttcactgatggcaagaaaaaaagttggttggctggtaaagctttggaggaatttttaccttaattttgccacatcccactttcaggccgcaaccctctgtttcaggaaacccttgggcttaagcctcacttgctggtcctcaacaagatggacttggcggatcttacagagcagcaggtaaaggcctttctctcagacgccttcagcagtgtggctgtgttttcccgaggtcgcttgttctaacggaagagttgccggacgcacacttgtcagtttgcccaggcaggctctgctttagaaacagccctttgctttgcagaagcgtgccagcatcgtttctcatatggcgtgcccccatctaatgtgtggttcgtgacctggacacccagggagtgcacgtctcctgtgggaagtggccaggttgtgctgccagagcccgagtggtcagtgagtgcgcattgtgggcagcaagccacccaggtgccgaggcaagagaccgaggacacgagcttttccagtgtaataaaacatatgaaataagaatagttatactagatataggtcatagatatgattgtatatgaatattactaatcattagtttgtagcaattactcttcattccaatattattataattcttgctctataatcataacctaggaaaaaccaggccatacagagataggagctgaggggacatagtgagacgtgacaagtgtgtgagccttctgttatgcccagacagggccaccagaggactccttggtctagcggtaacgccagtgtctgggaagacgcccgttgccaagccgactgtggtctagcggtagcgtcagtgtcaaggaaaagcacccgctacttagcagaccgggaaagggagtctccctttccccaggggagtttagagaagactctactcctccacctcttgtggaggacctgacatcagtcaggcctgcccgcagttatccggaggcttaactgtctccctgtgatgctgtgcttcagtggtcacgctcctagtccgccttgatgttccatcttgtacacctggctctgtcttttagatagcagtagcaaaattagtgaaagtaccgaaagtctctgataagcagaaataatggcgtaagctgtctctctttctccctctctctctgccttggctgccaggcagggaagggccccttgtccagtggacacatgacccacgtgaccttacctgtcattggagatggctcacactccttaccctgccccttttgctttgtatccaataaatattagtgcagccagacatttggggccactaccggtctctgcatcttggtggtagtggtcccccaggcacagctgtcttttcttttatctctttgtcttgtgtcttattttctttttttttttttgaggcagagtcttgctctgtcgcccaggctggagtgcagtggcgcaatcttgactcactgcaagctctgcctcccgggttcacgccattctcctgcctcagcctcctgagcagccgggactacaggcgcccgccaccatgcccggctaattttttgtatctttagtagagacggggtttcactgtgttagccaggatggtctcaatctcctgacctcatgatccgcccgcctcggcctcccaaagtgctggtattacaggcgtgagtcactgcgtccagcctgttttttttttttttttaaatcatcgcaagtgttttcactagttggtacttttacgtcatatcagtggcaactcctgcctttgaaaatgtgactttttgtagactggtgggtggccgtctagtatagggcacagcagtgtctgacctggtcagagaaaggccagtgcttctgaagaatcgggagagaggtagacttgcccctgggtggccctgccttctgcctccctgagcagggacacccaagtacatttactacccagagtgtgtggcttcaggtgtgtgtcttatgtttgatctctccatccgtgtcatcttcgtggacagctaaataaaaccagctgaatcagtgaaggacttgttgatttaaacatcagtcatactttaggtcagatgattaacagcactgatgtttagaaatatgatactgctttgcactagtttcactgcatgttaaggccagtgaattcaaaaattatctgggcgtggtggcgcatgcctgtaatccctgctacttgggaggctgaggcatgagaatcgcttgaaccagggaggcggaggttgcagggagccgagattgtgctactgcactccagcctgggtgacagagccaagactccagtaaaaaaagtaacatagaaatgttttgtgtctttcagaaaattatgcaacacttagaaggagaaggcctaaaaaatgtcatttttaccaactgtgtaaaggatgaaaatgtcaagcaggtaggcttttcgtctgtgctctctctgacgcttctgcttcagtaggttcgaggagcattataaactgttttatgctttagtaagaagcagagctttggaaaagatcctaggtgttggtttccagctgccacacacggatgcgatctcctggggcaagtgggtctccctgtactgagggcacaaggtcaggctgtagacgcattccagggttgtaggtggtcagagtcttttggagactcaggtagctcatgtttccagttgtatgtggtagaattttctggcttgatgtgtttcttcattaaaaggtagttacagctgtcactgaagccccgggtctgccctgcttgtttttgatgggaggggacgggcataggtggtccccggccccagagctcagtctgacatctgtgacctggacagaactccagtttcccaacaccggatacttggtgtgctacctccagatgaagggtgacgcccagtttgcctatgaaatgttgggtagaattccagataggaggtttctgttttcctaacggatatgtgaaagtggagacactggaatccctaatcctgttctgaggtggcagaaggagcgggtcagtgcacagacgtccgacctggggtggctccatgagtgggtgtttgttgcagatcatcccgatggtcactgaactgattgggagaagccaccgctaccaccgaaaagaggttggttggtggggcccagagctgggagtgggaggcgggcgtgggatgggccagcccctcctgcctggcctctccaaggagaaggcgcagcgccccaggcagggaggcccctcctttgtcctctcattctcttcagtggaaagggccgaggccgtccccgctgggtgggcagagcctcggcgttaacctcccttcttccctgagctgacctggcctggggtccccttgcctgggtggggttgcagagtctcaggctctagcggccacggtgggccctgtgacccctctctctgcctgcgcagaacctggagtactgtatcatggtcattggggtccccaacgtgggcaagtcctccctcatcaactccctccggaggcagcacctcaggaaaggtactggcgcgtgcggctgatcacctcaggaaaggtactggcgcgtgtggctgatgtgctgatgccaccatctttcttggaggggacgtgcccgaggagcactgccagtcttctgctgaccccgcagccccagagcacatcttgtctcgttcagtccagttcacaggagggctgaacagtgggaccaggtcgttctgtgaatttcacacttaatttttctctcttttaaaatctttaacatgaagatggcttttctaaactttgatatttgttcatttatttaaatccctttggccgggtgcatggctcacgcctgtaatcccagcactttgagaggccgaggcgggcggatcatgaggtcaggagattgagaccattcttgctgaaacggtgaaaccccgtctctactaaaaatacgaaaaattaggtgggtgtggtggcgggcacctgtagtcccagccacttaggaggctgaggcaggagaatggcgtgaacccgggaggcggagcttgcagtgagttgagattgtgccactgcgttccagcctgggcgacagagcgagactccgtctcaaaaaaaaaaagaaaagaaaagaaaaaaaatccctttgatccagagaatacaaagcgtgtgaagtagacggggctggattatcaggcagggaggctgcaaggccattcctccatggcgtccgccttgcctttgctggagggttcctggactccggagtcgcaggcgctcctttcctccctctgtgcctgttctcagactctgattcaaagcaggagccccgagcacccttcactgccccgtgggctcttttccttaagtattttcaagtttaattcaagtccttgttggcttcatttttcatattaataaggcatttattaacaaacccattcatgatgtgcaaatctgaaggctttaaactacggtgaactgttattttacagagagggtgtttttggtgctaattggagcattgttacagtcatttattcttttaagtttatttttaagcgtattattttttatcagtggtattaagtgcatttatagggttatgcagccagcaccactattttcaaatattttggttacctgaaaatgaaactctgtaaatacaaagagtcactcccccagcctcctacacccctcgttccactttctgtctgtgaattcgatgactgtaactgcctcctccaagtggactcacagtacttggccttttgtgactggctgatgtcaccgatcgtgatgtcctcaaggttcgtctgtgttgtcctgagtgtcagaattttattcctttttaaggctgatcaccccgttgtgtgtacagaccacatcctgtcttgtccattcatctggatggacacttgtgttttttattcttgggttgtttgtccacagtggagtggcctccttgggacacaccctgagctgggtcctagagcagccagtcgcctgtggacagtgctgtgggaggcaggctgaccttggggtgcaggggtgggtccaggagggaggtgggggactgcgtggaaggagcagctcaggtctgacctccgcagtctgacagtgcctttccagtcctggggagttaggttctggtgcatttgttgaagaatctcagtctctgtgtggcttggaaagtgcccttgctgtgagctggtttgtgactgaaagtgaaacaaattatagccttgggaagctcatctggcttttagtttccattttggccagatatgtttgttacatagtctccctgcttggctggtaagttgtgtttgttacatagtctccctgcttggctggtcagatgtgtttgttacatacgtctccctacttgttctgcagcttctgtgtttagtatacatttgagcctccttttctccttttcctacagggaaagccaccagggtgggtggcgagcctgggatcaccagagctgtgatgtccaaaattcaggtggagtcctcaggggccaggcccagcactctgtcaagagctctgcaggcgtctggcacctgccgacctctgtgtggcttccggctgctgaccacgcttccctcccctccactcagtgtccccgctgagcacccccggggcaggcactgcccctgcccttattccacagtcgtcatagtctttgcgccaaacctttggggaaggcacgctgttttccccatttccagatgaggaggccactgtccagggccatgcagtggtcaggacagacctgagtgtggcgccccccgccccaccctccactcccttccttgtgttctccttgggagcagaagacaagctgttgggacctgacgcttttatttattctccaaattaagtgggaattagatcctctggggaaccctggagcttggtgagagtgacgctgccatggggttgggtccctgaggccttcctcggagcattgggtgccaggggctgcccaggcttcctgagtggcccacctgggtgggaggctgccaccgcggcctgatcatgccctctgtgcccacacaggtctctgagcggcccctgatgttcctgttggacactcctggcgtgctggctcctcggattgaaagtgtggagacaggcctgaagctggccctgtgtggtgagccggggctggggctggggctggggctgggaccggggcccctgccaccccacctttagggctggctttggcacagggcccctagacgggagttgttactgcctttgacctggttgctgccagaccttcctcgaagcttagtgtgagagctgtaatagtgcacagctgacaggcactggtcaccattccaccctgccccatgagtggccttccctttccccatttgacggaccagggcagagaggttggtcgcaggtgccaggcaggagtgggggccgggaccacagccgagtgccgtcctcttggttagtgtctttgtcagtggctggcctcttcctcacggcacggtgtctttgggctaggactggaagggatgtgtttgaacttggcaggaacatagatgtggctgtttccagtgctcacctcggctgctgcttccacaggaacggtgctggaccacctggtcggggaggagaccatggctgactacctgctgtacaccctcaacaaacaccagcgctttgggtgagtgcagtgaatgcagggcagctggggcccctcctcctagtcacctcatttaaaaaaaaaaaacaaacaaaaaaacccccagcattataaaggtattataaacacggtaacctgcacatcgtttaaagcgtccagttggacaagttcgggagtatggctatacgtctgtgaaagcaacacacaatcaagaaaacgagcgttcccgtcacccccagtccctgctcctctttcgtgaaatcaaggaaacgagcgttcccgtcaccccccatccctgctcctccttcgtgaaatcaaggaaacgagcgttcccgtcacccccagtccctgctcctccttcgtgaaatcaaggaaacgagcgttcccgtcacccccagtccctgctcctccttcgtgaaatcaaggaaacgagcgttcccgtcacccccagtccctgctcctccttcgtgaaatcaaggaaacgagcgttcccgtcacccccagtccctgctcctccttcgtgaaatcaaggaaacgagcgttcccgtcacccccagtccctgctcctccttcgtgaaatcaaggaaatgagcgttcccgtcacccccagtccctgctcctccttcgtgaaatcaaggaaatgagcgttcccgtcacccccagtccctgtgctccttcgtgatcacaccttcctgcccctccctgagcccaggcagccgtctactgtccctgtaggttgctttgggttttctagaattccacgtagatggaatcacacaggatgtgcattcttgttgatctgtcactcggcacgattgttgtgtgatccccgtgtgtcgtcgtgtgttgtccgtcattcatcctttttgttgccaggcggtttcagtgtccaggtgcgctgcagtctgtcccttcacccgttgatggatatgtgggttgtttgcaggttttggctattgcagataaagctgctgtgaacattcatgtaccgacaggtctttgtgtagatccgggctttcgtttcccttgggttaatacctaggagtagagtggctggatcataggggaggcatatgtttgagtttttaagaaaccgccacattgttttccaaggtagttacactgttttatatgctggcaagcagggaatgagtccttcagtttctctaagatcagtctttaactttggcctgtctgatgggcgggcgtgtaggggtgtcgcatagcatttcaatttgcatttccctgatgacagggacgttgagcatcttcatgtgcttatttgtcatccctctctggggaaatgtctgttcaaatccttttccctttttttttttttaactgagttgtttctttccttattgctaagttttaatcttttttttttttttttttttgagacagggtctcagttacccaggctgaagtgcagtggtacagtctcagctcactgcagcctgacctcctgggctcaagcgatcctcccacttcagcctcccaagtagctgagactacaggcgtgtgccaccacacatagctgatttttgtattttttgtagagacagggtttccccatgttgcccaggctggtcttgaactcctgggctcaagggatctgcccgcctcagcctcccaaagcattaggattataggcatgaggcaccatgcccagcctgtaacctttttctaatatattctggatacaagtccttaatcagagatacggtttgtaaatactttaagtctgtgccttgtcttttcagccctcttaacagtgttttccgaggagtagaattgttaattttcatgcagtccagtttatcagctagatcttttccagagtactcttgttgtcatatctaagaaatctttgcttaaaccagggtcacaagggtttcctcattgaagatagatggttttaggttttacatttagggctatgatcctttctgattttttggtatatggtacaagctgcagattgaagttcttttttttttgcacatggagaaccagttgttccggaaacatttgttgcaaagactgtcttttctccactgaattgtctttgcatctttgtcgcaaatcggttgtccatatacgtgggtctgtttgtggactctaactgtgtcacttttctgtgtgaccgaccgtcttggtaactgcttctaatttaatatgagatttgaaatcaggcagtgctggtagcccccactcttctttgtcaaaattgctttgtcttttcctggttctttgtattctcatgcatttttcagtcactttgtcagtttctacaaaaatccctatgtttcttgaggccgggtggcagattcccctgaatttataggtcagtctggggaagaattgacaatattgtaacactgagtctctgacccgtgaatatagtgtatctcttcatttatttaggtctttagtttttctttgcagtgttttgtagtttacagtgttttgtaagatttatattgaactcttttttaaacttttaatgctaagatttatcttttgatacaaagtagatgttttcagggtacctatgatattttgatgcattcatacaatgtgtaatgatcagatcagggtaattgggatatccatcatcccaaacatttatcttcatgctggaaacatttgaattgctctcttctggtatttgaaatatcctgtagattcctgttaactgaagtcactctaccgaactattcattaatcaacctctgtccatcccctcttcccctcacctctggtaatcaccagtctgctctctgtcttaatgaagtccacgtttttagctcccacatttgagttagaacatgcattatttgtctttctgtgcctgtttatttcacttaacagaatgatctccagttctgtttgtattactgcaaatgacaagatttcgtcctttgttatggctaatatttcattgtgttttatgtaccacattttctgtatccatcatcctttgatggacacttaggtagattgcatatcttggctattgtgagtagtgctgccgtgagcatgggagtgcagtatttcttcagtatattgatttccattcttttgggtctatacccagtagtgggattgctggatcctatggcagttctatttgtagtgttttgaagaacctccatactgttttccatagtagctgtactaacttacattcccaccaacagtgtacgacagctcccctttctctacatcctcaacagcatctgctattctctgtgttttttaataaaagccattttaactagggtgagatgaaatctcattgtggttttgatttgcatttctctggtgattagtcatgttgagcattttttcatacacttgttggccatttgtatgtcttcttttgagaaataattattcagatcttctgtccatttttaaatagttatgtggttttttttgctgttgagttgaattgcttatataatctggttattaattccttgttgagtagtttgcagatattttctcctattctgtagattatcttgtcagtgctttgatagtttcgtttcttgcttcgggtcttgccgtgccgtccaggctgagtgcagtggtgcgatcacagctcactgcagcctcgaactcttgggctcaagagatcctcctgcctcagcctcccaagtagctgggattataggcacgtaccaccatgcctggcttgctgattgtttcctttgctgtgcagaagcttttcagcttgatgtaaatttttttacatttgcctattattattattattatttttgcttttgttgcctgtgcttttgaggtcttatacaaaaaaaatctggcccagaccaatttccagaagcgtttcccttacgttttcttctagcagttttgaagtttcaggtcttagatttaagtcttttttttttttttttttgagaaggagtctcactgtgtcacccaggctggagtgcagtggcacgatctcggctcgctgcaacccctgcttcctgggttcaagcagttctctgcctcagcctcccaagtagctgggactacaggtgcccgccaccatacctggctaagttttgtatttttagtagagatggggtttcaccatcttggccaggctggtcttgaactcctgacctcgtgatccacctgccttggcctgtaatagccaccgcacccggccagatttaagtctttaatcccttttgatttggttttgtatattgtgagagatggggtctagtttcattctgcctgtggttatccagtttaaccagcacccttttatgggagagactgtcctttccccagtgtatgttcttggcacttttgtcgaaaatgagttggctgtaaatgtgtggatgtatttctgggttctctggtctgttccactgttctgtgtatgtgttttatgccagtagcgtgctgtttttggttactacgaatattttgaagtcaggtagtgtgatgcctctagctttgttctttttgcttcaggtttgctttggctgtttggggcctttagtggtgccatacaaattttaggattgtttttctatttctttgcagagtgtcattgctattttgataacgattgcattaaatctgtaaattgctttgggtggtgacattttaacagtattcttctgactgataagcatggaatatctttccattttttatgtgtcctcttcaatttcttttatcagtgttttatagttttccttgtagagatcttccacttctttggtcagatgtattcctaggtattttatatttttgtaactattataaatgggattttcttgatttcttttttttttttttgagatggagtttcggtcttgttgcccagtctggagtgcaatggcatgatcttggctcaccgcaacctccgcttcctgggttcaagcgattctcctgcctcagcctcccaagtagctgggattacaggcgtgtgccaccacgcctggctcattttttataattttagtagagatggggtttctccacgttggtcaggctggtctcgaactcttgacctcaggtaatccgcctgccttgacctcccaaagtgctgggattacaggcgtgagccaccgtgcctggcctgatttctttttccgattacctgctgctgatttttttatgttggttttgaattctgcaactttactgaaacctttttatcagttctaatagttttttggtggagtctttcagtttttcccaatataagattgtcatctgtgaataaggataattttgacttcttcctctccaatttgggtgactgttatttctttctcttgcctaattgttctgggtaggacttccagtattctgttgaataaaagtggtagaaatgggcatctgtgtgttgttccagatcttggagaaaagctgtttttccttgttcaatatactgttggctgtgggcttgtcatgcgtggcctttattgttttgaggtgtgttccttctatactcagtttgctgagagcttttatcgtgaagcgatgctgaattttattgaatgctttttcagcatttgttgaaatgattgttttttttccttggttctgtttaatgttatatgtttattgatgtgcatatgttaaaccatccttgcaaccttgagacacatcccacttgatcgtggtgaatgatctttgtaacatgttgttgaatttgggttgctggtcatttgttgaggatttctgcatctgtgttcatcagggatattggcctgtcgttttctttttctgccgtatccttgtctggtttttgtaggaggataatgccatatacagtgactttggaagtgttccccccttcagtttttttgaatagtttgagtacagttgatactagttcttccttaactgttgatagttcagcagtgaagccatcaggacctgggattttctttgatgaaagacgttttattactgctttgatcttgttacttattatcgatctgttcaagtttttccatttcttcatggctcagtcttgcagggtgtttgtatccaggaattcatccctttcgtctgggttttccagttcgttgctgtgtagttgttcgtagtagtccctaatgatcccttgtatttctgtggtattggttgtaatgtctccttttttgtttactgattttatttattttgatctttttaaaattctagctaaatgtttgtggattttgtttatgtttttgaaataattttttgtttcattgatctttggtattttttttttcaactcaatttcatttatttctgctctggtctcctgatctctgttatttctcttcttctactaattttggatttggtttgctctcacttttctggtgccttgaggttcatggttaggttatttggagtcttctgctttttttagcgtaggtgtttgttgctataaacttccgtcttagcaacacttttgctgaatcccatagactttgatatatggtgtttccatttccgtttgtttgaagaaatttaaaatttttcttattaatttctttattaacccattgatcattcaggagcgtgttgtttaatttccatgtgtttgtgtagtttttgaggttcctcttgttactgctttcttgttttatttcatcgagtcagaaaagatactcaataagattttgatttgttgaaacttgttctgtggcctaacatatggtatattctgtagaatgttccatgtgccgatgagaagaatgtgtgttttgcagcagttgggtgaaatgttctgtaaatgtcagttagacctgtttgatctagcatgtagtttcactccagtgtttctgttgatttctggctggaaacaccctacggagagggggtgttgaagccccctactattactgtattgcactctgcctctcactttcaatctatcaatgtttgctttatatatctgggtgctctggtgttgggtgcatagatatttataattgttatatctgcttgctgaattgacccctttatcaatcgtatagtgactttctctgtgtctttttacagtctgacctgtagtctattttgtgtaagtattgctgctcctgctctttatacagtctttgacttttagtctgttctgtcatctgtaagtatagctattcctgctctttttttttttttttggtttctgtttacatggaatatgtttttccaccctttgactttcagtctgcgtatgtctttataggtaaagtcggtttcttataggtagcatatagtttgatcttgttttttatccatttagccactctgtgttttttgcttgtttttgagacagggtctcactctgttgcccaggctggtgtgcagtggtgtgatcatagctcactgtagccttgaactcctgggctcaagcagtcttcccaccgcagcctcctgatagttaggactacaggcgtgtgccaccacacctggctgttttatttatttatttatttattttttgtagaggcgaggtcttgctatgttgctgaggctggtcttgaactcttggcctcagatgatctttccacattggcctcccaaagcgctgggattacaaatgtgagccactgtgcctggcctactctatgtcttttagttggagaatatagtacatttgctttcaatattattatggataaagacttaatattgccattttgttgcttgttttctgattgtaactcctctcttccttttttactgtcttccttcgcatgtggttaagagattttctctgttggtatgttttaatttgttgctttgtatttttagtctatgtattatatgtagtgtaccatcaggcttacaaaaagcattttatatttataacaagttatttagttattttagctgggcgtggtgctctgtgactgtaccctaggtactcaggaggctgagataggaggattgctggagcccaggagtttgaggctgcagtgagctatgatcgtgccatcgcacttcagcctgggtgacagagtgagacccctctcttaaaaaacaatcattttaaacacatgacaccttatctgtgatcacagaggaaagaatagaaacaaaggagaaactgaagaattctgtactttaactgcatctttcccccaaattttcacgttttcttatttcaatttatttttttttatattggctctctctttccaggttgctgtagttattatttttgatacatttttcttttagtcttcacactagagatgtgaatgaatgcacaccacattcacagtattattctgagtctgtgtgtttacttttgccagtgggttttatacttcacatgttttctttttgtacattagtgtctttttctttcagattgaagaacttttttttagcatttcttgaaagttgggtctgatgaattccctcagctttactctttcatgtttgaaggtgtgtcctcagttgacagttgcatttttttttccttcagcactttgaatatatcatcccattgcctcctggcctatatggatttcctggagaagtctgttgccagttacattggagctcttttataaatatatttgctgcttttctcttactacttgtactacttactgcttgtaggattctttctttgtccttgacttttgagagtttgattattatattctgtagggtagttttatttgggttaaatctgtttggtgatctctgacctccctgtacctggacatttatgtctttctgagggtttgaaaatttttctgtaattatttctttgaataaactttctgtgccttcctcttgctcggttccttcttgaaccccagtaattcctaggtttgctcctctgaggcagttttctgtatcttgcatgtgttcttcattccttttcattcttcttttttctctttcctcttctatatgttttcaaatagccagtcttcaggctcactgattttttcctctgcttggtccattctgctgttgagagcctctaatatatttttcagcaaatgtattttttacttccaggatttctgtttgattttttttttttaatttcaatctctgttaaatttgtctgacaaatttgtgagttgtttttctgtgttttattggagtttgctgagtttttttttaactgttaccttgaattcttgatttgagcgcttacacgttgccatctcattagggttggccactggctctttgctttgtctgtttgagaaggtcgcggttttccgttagctgttgtttcttgtgcacatatgtctgtggttttgcattgaaggatttgttatccaggctttcctgtctggctttttttttcttggatgtttgcttagaggttttttgcagcttactttctgcctggagtttttttcacttctctggtctcatcctcagatttgagttctggaatattgctggtgatattcttggcactggatgtttggttttggttttctttgagagggtgagggaagccagattgcttctacttctctatttggtgatgtcattccctctattaactcttcgctatttttgatactattgtaaatggtattgtttttatgttcacttttgatttttcattgctagtatacagaagtagaattgatttttgtatattgatcttgtatcttgtaaccctgctaaactcatttattcattctattagctctttgtagattccagttagattttttacctagacaattatgtcatttgcaaataaagatcatcttactttttcttttccagtccagatgccatattttgttttcttgctttattgcactggctacagtcttcaatacaattgacaggtttttttagtatttgagatgtggtgagaacagacatctttttttgttcctgatctaaggtaggaagcttttagtctcttaccattgagtgcagtattaggtatgggtgtttcttagatgccctttatcaggttgaagagaacagtctggctagaggcttattaattttattgatttttcccaaagaatcagcttctggtttcattgactttctgttgtctttgttttttatgtcattgatttccattcgatgtttatttttttatttctactttggtaattttctatttgtactaccaattattgtgagaggggcactgaaatttcccactgtaactgaatttctgtttcttcttgctgttcagtcagttttggcttcgtgtatttcgaagctctgctgttaggtacagaaacgctcaggagattgttatgtcctcttgatgatttgatgcctttatcattaggaaatgatctttttttatccttcagaatattctctgctctgaaatctttcttgtctgatattaatatagccaccacttttgtttttttgagacagagtctcactctgtttctcaggctggagtgcagaggtacaatgttgtctcactgcaacctccgcctcctgggttcaaatgattttcatgcctcagtctcctgagtagctgggattacaggcgcctgccaccatgcccagctaattgtttttgtatttttagtagagatggggtttcaccatgttggccaggctggtcttgaactcctaatctcaggtgatccacccatgtcggcctcccaaagtgctgggattacaggtgtgagccactgcgcctggctaatttttttgtgtgtttttagtagagatgggagtttcgccatgttggccaggctggtcttgaactcctgacctcaagtgatccacgtgcctcccaaagtgctgggatttcagatgtgagccaccgtgcccggcccatttgtctcaatttttgttttcttttttcctctctcttgcctctttaggattgaatatttttaaacgattctactgtatcttctttgttagcttattgtctacaacttttgggagaggttgctttagggtgtatagtatgtctttaagtgatgaccttacaataatgcatttctgtttttcttatcctgattcttgtgccatcatcatcatgatatattttacctttacatattttataacctccagatatactttctttccttcatacagttatcttttaaagaaatataaaataccagaaaaaaagttgtatatattttcccatcagtttaccatccacaccttctcatttctttgtgttttcttttcttttttttttttttttattgatcattcttgggtgtttctcgcagagggggatttggcagggtcacaggacaatagtggagggaaggtcagcagataaacaagtgaacgaaggtctctggttttcctaggcagaggaccctgcgaccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctttcccccttctctattccacaaaaccgccattgtcatcatggcctgttctcaatgagctgttgggtacaactcccagacggggtggtggccgggcagaggggctcctcacttcccagacggggtggctgctgggcggaggggctcctcacatcccagacggggtcgcggccgggcagaggcgctccccacatctcagacgatgggcggcggggcagagacactcctcacttcctagatgggatggcggccgggaagaggcgctcatcacttcccagactgggcagccaggcagaggggctcctcacatcccagacgatgggcggccaggcagaggggctcctcacatcccagacaatgggcggccaggcagagacgctcctcgcttcccagatggggtggcggccgggcagaggctgcaatctcggcactttgggaggccaaggcaggcggctgggaggtggaggttgtagcgagccgagatcacaccactgcactccagcctgggcaccattgagcactgagtgaacgagactccgtctgcaatccctgcacctcgggaggccgaggctggcggatcacttgtggttaggagctggagaccagcccggccaacacagcgaaaccccatctccaccaaaaaaatacgaaaaccagtcaggcgtggtggcgcgcgcctgcaattggaggcactcggcaggctgaggcaggagaatcaggcagggaggttgcagtgagcagagatggcggcagtacagtccagcttcggctcggcatcagagggagaccgtggaaagagagggagagggagaccgtggagagggagagggagcggagcgggagcgggagagggagcgggagcgggcgcccctgttttttcatagacgggtcctgcactcatttctttgtgtaggtccaggtttccttctggtgtgattttacttctgtctgaaggatttcctttaacatgtattgtaaggcaggtttgctagtgatgaattctttcagcttttggttgtctgaagatgtctttatttcacctttgttttgaaagatattttctctacgtgtagaattccagattgacggggttttttagtgcttgagaggggttggtctccctttctcacttgcgtggtgtctgatgagccgtctgcggtcatgtttgtttgttttagtgcttgagaggggttggtctccctttttcacctgcgtggtgtctgatgagccgtctgtggtcgtgtgtgtttgttcctctgctgcttccaggattttctctctcagtgcttttgagcaacttgattacgatggaccttggtatggttttctatgtgttccttgtgcttgtagttcattgagatttttggatctgggtctttgtagttttcatgaaatttgcatcattttgaaacttcatatctgcaggtgttttttctgtccctctactcctcaggacctcaggcatgcaggtatcaggcacgcgggtatcaggcaggtgggtatcaggcatgcagttatcaggcatgccggtatcaggcacgtgggcctcaggcacacaggtatcacgtgggtatcaggcacgcagttatcaggcacgcgggtgtcgggcaggcgggtgtcggcacgcgggtgtcgggcaggcgggtgtcgggcacgtgggtgtcgggcaggcgggcgtcgggcaggcgggcgtcaggctgcttggctttgccccaccgcagctcagtaaagctttgtgcctgttttgtggtttctgttgctgtgtcttcgggttcactcatcttttcttctgcaatgtataatctgctgttcatcccactcagtagttttcatagttttcacttccgcaagttgagtttggatcgttttaaaaaatatctttcgtgtttcagcttagatttaatgtcttgtctgctaattctaacattgggtcagtttgagttgactgatttttcttctcattagggggtctgtttttttgctttgtaggcctggcaatttttggatgatatatatatatatatatttttctttttattttattttattattattatactttaagttttagggtacatgtgcacaatgtgtaggttagttacatatgtacacatgtgccatgctggtgtactgcacccattaactcgtcatttagcattaggtatatctcctaatgctatccctcccccctccccccaccccacaacagtcccaggtgtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctattattgttggacatttgggttggttccaagtctttgctattgtgaataatgccgcaataaacacatgtgtgcatgtgtctttatagcagcatgatttatagtcctttgggtatatacccagtaatgggatagctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaaccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcagttaggcaggagaaggaaataaagggtattcaattaggaaaagaggaaatcaaattgtccctgtttgcagatgacatgattgtatatctagaaaaccccattgtctcagcccaaaatctccttaagctgataagcaacttcagcaaagtctcaggatacaaaatcaatgtacaaaaatcaccagcattcttatacaccaataacagacaaacagccaaatcatgagtgaactcccattcacaattgcttcaaagagaataaaatacctaggaatccaacttacaagggacgtgaaggacctcttcaaggagaactacaaaccactgctcaatgaaataaaagagaatacaaacaaatggaagaacattccatgctcattggtaggaagaatcaatattgtgaaaatggccatactgcccaaggtaatttatagattcaatgccatccccatcaagctaccaatgactttctttttttcttttttttgagatggcatctcactctgtcgcccagccaggctacagtgcagtggcacaatctcagcccactgcagcctccacctcctgggttcaagcgattctcccgccttagcctcccaagtagctgggattacaagcatgtgccaccacacctggctaatttttgtatttttagtagagacagggtttcaccatattggtgaacaggctggtgtcgaactcctgacctcaagtgatccgtccaccttggcctcccaaagttctgggattacaggcgtgagccaccatgcctggctggatgccatgtattttgagtttcaccttgttaggtgatggatatctacattcctgtaaaaattcttgagctttgttgtgggacagttagattattggaaacagtccggtcctttcaggagttcttcccattggcaggtctcgggggtggtccggggcgcctcctccaggcttgctcctctctcctgggacagcttttttggagcaccagggcacccttgaggctgctgattcagagctcatgcttggtgcctccgagaagttagatttagaacctgtgttactcagggttctgatgctcctatgggctctgagctcatgtcttgctttgctgggccttggggtgagtcctctgttaccggctcatgctgtgaccaggtccgagggcaccagcctcctcaaggttgagcctgccctcgtgggagccacgagacaggttcccctcacccctggctgtcaggaaggttgggagagtgttgggtctgggttagtcgggctcccaaggcttagggtggtgtttgtccctgtgagtggctgctctgtgctggcctttccctccaggcctctctgcccagagcctgcactgtgaggagtcagagtgcccgttacaatcactgggtgacgcttagcagcggtgggtgcctagtcagcccatgctggtccctgtgctaggaaaacaccgctcaaacacccagccgggtggagaggatgcaggtgtactggctgcctggaagttaccgagtgccatccttagcagcaaacagagtatgtttgcagatggtctgctgtgctcctcttttagtttccaggacctgggcctgcacagaggcctgcctgtcctaccccggatagagtggatgaagcctgtgtgtgtgaacagctgttactcctcccgctgcggcaagggctccggtggtgggagccgccccccatgctgctggccgtggccacacaggacgaagctcagggatgattcttagatagtggctctcccccggggcccagcaccggtcacctgcagtctcatcttggtcatccacagcgccgcagtcactgtcacccacaggaggtgcctggccgtggcctttgtggcattcaggaggaagggcccggcctggctggccgcgcggtgtcagtgctgggccccctggtgctgacctgcagcctatgtgcaggtacgtgcagcactacggcctgggcagtgcctgtgacaacgtagagcgcgtgctgaagagtgtggctgtgaagctggggaagacgcagaaggtgaaggtgctcacgggcacgggtgagtgaggtcgctgatgcgggcaccggagcctcaccccatcaccctgggggaccccggccatccctggaggaggcagggaggagaggaacgtgtcaaggagcatgcgccgggtcttctgggaatgggtttcagggcaggggagctacagaaagttctggagaggaagggcttgtagtccaggcttccgagggtgagaccagccctgccgcgtattgggcagtgctaggtggacacctgcaggcctcacatgcctggccttggaggctccgggcagcgtagctcaagctgttttctttctgagtgtgatcccgttccctgggcttccctgatgccatcatggagcctcttagggctggtccctcaggtgggtaagggctgggcctgtcctgctgtgaaggctccttcctcactgaaccctcccgtcccccaggtaacgtgaacattattcagcctaactatcctgcggcagcccgtgacttcctgcagactttccgccgtgggctgctgggttccgtgatgctggacctcgacgtcctgcggggccaccccccggctgagactttgccctgaacttgtccgggtagggagggccggaggcatgtggcctcccagacctcctgacctgggtggttgaggctcaagacagctcacccggtccagaagctccatgctggtcactagggtgctgtgctctctggcgccccacagcctggccagctccagggaccccagttgcagggcccaagcaggtgggagtggacaccaggcttcccagtggacgtccctgagcagctccgcatgcttggttctcccggagcttcctgctcaggcctcttgagaaatggatgctgtctcagaaggagttaaagctataacctgtaacctttaaaatctccagttaaagggcctgtttcttactggcctgtgaggtgcaccgtagtgccttgggcctgtgtgttaaagctgctctcaccagtgaaacctaagaaatgagcaggttggcagctagggtttgtgttggaggctttcggtccagtgtcttgcagtcctacaacaagtgagaggcttgctgccatcagagaggtttatttcacacttacaggcacacacagacacagaccagagactcccagcagcagagcccaagcactggcttcgcccctcagtgccctggggcatgttcagggcagggttgagggggacgccctgcacatggctttgctgtgcaatgactggaaggccgcccggcatgggcagtagagacccctggcctctgagcaccttctagctcacgggtagtgggattctgcattagtggggctgagagatgtgggggcccctccagccccattatagtgcacctgaaggggtccacagcctgtgtcctagaagagggaagaggaaggaaggtgggtggggctggtagtatggactaaggtgctgcaggacctggggccagggacatcctgtgcagaagctccggctgcctctttgcggtggtggcctgaccgtcccacagcagcctccaccagggccctggtgctcagtggcccctctttgctggctggctgcctctgctgccccataccccacacactcatcagcctgaagttagcccctgagtgccacctgcatcgtgccataaccctgaccgcctggggcaggaagtattcaggttggctgtgtcagatgctaatgtgctgaatcaacagtcattgcagatc

SEQ ID NO: 37787 - DNA, 21689 bp, Homo sapiens
agaaccgcctgatcccgaactccctgtgcagagaccagactcgcccgaatatggggagaaaaacgagccgcgtgcagcaggggccgcctcggtcccctgcctgctccgctcacggcgagcgttcctggggcctcgagtttccccccttccgctggctgctcggaatcgcgggacggacccacctggccgccctgcctcccttccaggtgggcaccacctggactccaagtgctggtttacaaagcacacaggagacccttacgggggtgagctggcccctcgccagcgtccgctcggcgcgccccggggacagtgaaggcttggggcgcctctgcagagtcgccagcgcggtgggcgcagccggatgcctctgggagaagagcgcagcgcccgagggtcccccggcctacgaaggctaagccggggtctcggattcgatgtgggcgcgtcgcgtgacgcccggcgaggggcggcccggaggcttcccggcggcggcgcgcgcagggtctcgggcccgggtcggtcccgggcgcggcgcgggcggcgggcgcctcctggcgggcgcggacggagcgcggcgcctttaagcgggggcgggcggggcgcgggcagagtcgctgtcgccgcggccgccggggcggagccagcgcggatcgggtcccggacgcccgagcgccccgcccccgcgcgggcgatgcccagcggcgcggcgggctgcggggcccggcggggcgcgcagaggagcgggccgcggcgctgaggcggcggagcgtggccccgccatgggcttcctgcaccagctgcagctgctgctctggaagaacgtgacgctcaaacgccggagcccggtgagcccaccccacgcgcccgccctcagcccgaggccgcgcgcaccgcggccagaggcgcgctccccgcgcgcacgtgcggacggccgggcgcgcgcagaccccggcgggcgctgggggcggcgcgggcccgagccccctccccgccgggccctgccctcgcctgccggcgctgcggcctccggggaggtggctcggtcgtgtccagtccggtcccgcgtccgctgacatcgcggtgctcggctgagtcacggcacccgcgccctctgcagcgcgctcgctggggccgctgtgggcggggggcaagcggcgctcaggactctggctcgagggaggccctggttcccaggacagaaggcaggcctggggggctccattcagctgcgaggctccatggtccttgggcccagcctccctggggtcccggaggagaccctgtcccttccctccgtccacccctcccctgcccttgggccgcggcctgccatagaggttggtcccaggcatctctccgcctcccctcctggcacatccgtgacccttgctcatgctctcgccactgggaatgtccttgtgccagccttggccagcctgaatctctgcacccatttgtcctttggggtcagttctccccgagcctgatccactctgttgcctcctggtccccccacctgctctgggggctgggtctactgtttggagctgtgaaccccggctttcccagcactgcctgggcagccagtggacctgagggtgcaggacacatggctgtcagggacagaagtccttcgtggagcgaggggcttggggatatgggtgtcctgccatacccccagctggccagcttggctccagcctgggaagggaagggacacctcccaggccacaggcctggaccagcttaggtttctgaaggcccttgggattgtccaggccagggctcagagcaggtgggggcctaaggcagacatcctcttgcccagccagggcccgggcgggaccccttgggctgcaccagtccgtgcctgtttatctttcaacatgcactgcaggaaacccaggctgcagtcagctggggtggccatcatcaccatggctggcagaattcccctgggcacctggccttggcggggagcctgggttaggtacatgccctggccaggcacctggagctggctgagtggggtcccatggatcaggcctgcagcccctggcattgagtcactggggacagcagagcagggccaagggaacagggatgtggcatgtggcatgcattagtattagtccccgggggtggttgtcaggaaggtccccactgggcttgggagcagaggctggaatggtggcccctgttccagtggggacaatgctcagggaagggagtgtggcctatgagggcagctggcaagcaggtgggaggtgtgcactgtcctgaccgcaagagtgactcccagctgctggtttgggctgccccccaggacctttttgggtccccaccctacagggctcccagaggcccactgggccacagtggaggtccttagcccatggctggagcaggtggggaactgtttcccccagggaggctgagtccttgccaggcttgtgatgtggggctggggctggctggacactgggcacactcctgctgggtccccactttcctgggaaggatcttggacatcagagctggactcttggggccaagcttggatgacagaggtttgccctgtgtgccatgcgccctgctggggcaggggtgcaccctgggcagagctccaccctgggcagagctcagggtctggagggtgggtgccaaggacctctgtgctgctagcaggctcctccaagctctttgcctcagtttccctgtctgtgagtgtggcctatctcctcttagttagctggacttgggtctacccttgggctacaggctgctcttggtgcagggacagggtcactgtcatgaagtcactgggatggcagatggcagcgccaccctcgggtctcacctgttctccccccgacacagtaggcgggagctacagggaggggtcatgcccagagaaggcatctaggcctccaggcgatgtgaaggcactgggctggtctcgagggacggaggttgggccacctggaggcacctgtgtggggcacccagggcgtgctagacctgtgctgccgcctgtaaccagatgctgctgtggcgcccgccgcctgccagccaggactctcctcctcctcccagtagctcgtgcgaggccgttgctatagcaatgggggaggcagccgggcctgttgctgcagttacagtgcccatagcaggccgggtgtgggcggggctggcgccccgtgctgtgacccctgcctctgacattgcctcactcctgcagccaccctcgccctggtgcctgttggtgcccacagtgccttggcgaaccctgggctccgtcctggctcagggagcgggtggaggctggcacgggctggggcgggcatgggacacccacagcatgatgttcctggccacaaagccctattgtccaagcacagtaaacacagcagccgcccccaccccagggaccggggactcggcccgggccacacagcacactgggggctctgaagggttttgggatggggatgaggacaaaggatgcctccgagctgggtgctcgccctcgggctagggagggcagggcccctctgtcctgtgggtctcagagagggctggtctgccgagggctctctggagggtagctggctcaagctcctcctcctccctgagctgggggctgggacacaagaaccggtaaagtccttggttttcaggtgaagtgagcaaagcacctctttctcactccacgcaggtcccactagggctcaccttggtgcccagcctgggttagcaggagccgacctggggaaactgagctccaaggcccaagactggctgccccgggtcaggagaggggacagggcagaaagaggtgcctttgggccaggtgtggtggctcacgcccaggtgggcggatcacgaggtcaggagatcgacaccatcctggctaacacggtgaaaccccgtctctactaaaaatacaaaaaattagctgggcatggtggcgggcgcctgtagtcccagctactcgagaggctgaggcaagagaatggtgtgaacttgggggacggagcttgcagtgagctgagatcgcaccactgtgctccagcctgggtgacagagtgagactccgtctcaaaaaaaaaaaaaaaaaaaggtgcctttgcttcagggactggggctgttagaccccttaccaggtcttctccgaggctcagggccctgggcgcaggccaagcctctcaaccaggcctcctcatctccccaggccccggtattggtggggaggaagtgggaggaaggtgaacccggggcagtgtgggaagtgtaggcggggctagtggctcagatggtccccaagattttgcccaggtagccctggaggtggggagggagaagatgagctgggatatacatgggtcagagtagaccacaagctggccgatttgtccctgtaggccctgaggctcctcagagggcacgtaggcccagtgtgggctggggacgggaaacctgatttgctgagccagacaatccttaccctcagtgccctggaaggggctcagaccttcagtggttccgaagggcctgtgcccaccttccctggccccagggagcacgtggtcctgtctgggctgggccagccctatgggaggctggggagggcctaggcgagcacaggtctgtcctatccctcactgggcccaccctttccagtgggtcctggccttcgagatcttcatccccctggtgctgttctttatcctgctggggctgcgacagaagaagcccaccatctccgtgaaggaaggtgagtgcggcaggaggccccaggcacagccgggggagcgcggcacctcgcacgcctgcgctgtgtgtgcacatctgcacacgggtgtcctgctcccggagtccctgaggtgcggtgcctgctcccctgtgtggtcctgggccgtgcctcctggctgggctgtggaggtcggggctggcctgtggccgcgaatgatgatgccaacgcctcttcctggtgatgtgggcactcactggtctcctctgttctgttttgatccccctccctccccgcatggtctcttgtcctcggctggcatgcagtctgtaagtgagcggccacctcctcctggctggcctgggcagcagctgcggggggcccatgggccgtcctggcttgagcgccctccccgcttgcattaacagccctcccgggccccctgccggcctcaggaacagctggctccagatggggggtggcaggcagtgaagtgggaggtggtagggagtgaaaggcccggccacctaaaggcacagctggtgcctgggtcaagctgaggcggcatctctctgcctggccttgccttctagggctggggtgcctcggcttctgggctgagtctgggctgaggctgggctggcctgggctggggctggagcggcctggctactctcccttcatactccttcaggctcttgcactcactctgctaaccagctggccagaggtcagaggtcactgcccagagggggtcctttgtcctcccctgggctctgtaggcagtgccacacctgaaacgttttcggggggagagtgccagggcatgtgggcctgcactggctgaaaggaaaggaatgctctgggagttatggcagaaggggtggtgagtggctctttgacctctgacctgctggagtcattcgccccagaacgcttggcctgtagcccagctggggccagggctctgtgccgccttctccctaacgctgcttctccttcctgactttctctaaatttctcctctcggcctctgtctccctccccttctggattcctctctctctctctcccctttcacccccgaccctgccctctcccgtgggtctgccagccttctacacagcggcgcccctgacgtctgccggcatcctgcctgtcatgcaatcgctgtgcccggacggccagcgagacgagttcggcttcctgcagtacgccaactccacgtgagtgcccacccgcccctcggagcacccacccctccccagcccatccagtgagtgacatccgccatggtgcagggtcacgcagctgcttgagcgcctggaccgcgtggtggaggaaggcaacctgtttgacccagcgcggcccagcctgggctcagagctcgaggccctacgccagcatctggaggccctcagtgcgggcccgggcacctcggggagccacctggacagatccacaggtgtgccctgtgcagggaagttggggggcagggctgcgggcaaagctctgctgtcactgggctgaagcccacatccactctgggcccctccacctgcactgagttcccagccacgcacaggctgcagtggcagagctgtggtgttgggctcggctccgagcgcatgtgggggcaccttgccaaggtgcagcggcctctcagcctcgccttcctgcctgtccagtgtcttccttctctctggactcggtggccagaaacccgcaggagctctggcgtttcctgacgcaaaacttgtcgctgcccaatagcacggcccaagcactcttggccgcccgtgtggacccgcccgaggtaaggcagggacagctcccagccctggccactcccttctgccccagccacgccccctggttgctgagccatcctcaggatgctcagcctgagtcacgcccagaccgtctgaaccttgcccccaccatctgagccacgcccccactctctgagccatgcccccaccatctgagccacgcccccacacctacatcggagccacgcccccaccatctgagccacgcccccactctctgagccacgcccccaccatctaagccacgcccccacacgtccatcggagccacgcccccaccatctgagccacgccccccacaccccatctgagccattcccccacacctcctaggtctaccacctgctctttggtccctcatctgccctggattcacagtctggcctccacaagggtcaggagccctggagccgcctagggggcaatcccctgttccggatggaggtgagggcatccatgtgtgggatgggcctggagtgctgcctgcctctgggggtgcttctgctccgtgggtgaggaaagggcccctttggtgacttggagctcctcctgggagagggggagggtcccaggggtctatggcaggcatgaggggtagaggcatgtcgtgggacccaggcagccccagagccagccagtgggtggggcagggtgaggcctgaggccctagtggttggggacaaagtccttgccgtggctccacggacccctgtgcccatcccaggagctgctgctggctcctgccctcctggagcagctcacctgcacgccgggctcgggggagctgggccggatcctcactgtgcctgagagtcagaagggagccctgcagggctaccgggatgctgtctgcagtgggcaggctgctgcgcgtgccaggcgcttctctgggctgtctgctgagctccggaaccagctggacgtggccaaggtctcccagcaggtgaggccctgcctgcccactgcccgctgcgctgcttgctgcctgagttgaaggaggggctgggaccgcttggagagctcagggctcctgggcccaggctgtgcgtgggatgctgcctgtgggtgggtatccaatggcaccatggctggtgccccactcctgctcaccatcccagctcctgtcctgggctcccgttacccaggctgcagactccctcccagcacccctagcttgtgtctccctgctgctgtctccctgctccactcctgacctatcacccacctgcagtccatctcaccccgcactgcccacgtgcctgtttcccctcagctgggcctggatgcccccaacggctcggactcctcgccacaggcgccacccccacggaggctgcaggcgcttctgggggacctgctggatgcccagaaggttctgcaggatgtggatgtcctgtcggccctggccctgctactgccccagggtgcctgcactggccggacccccggacccccagccagtggtgcgggtggggcggccaatggcactggggcaggggcagtcatgggccccaacgccaccgctgaggagggcgcaccctctgctgcagcactggccaccccggacacgctgcagggccagtgctcagccttcgtacagctctgggccggcctgcagcccatcttgtgtggcaacaaccggtaggtgggcggcaggggaatgggggtgaggaggacagccaggggcagggcgtgagccctgaatctaggctctggctctggaggtctcatttggcgccctgccctgtgccccgaagtcctgccccatcccgatgcccctcccactctcgcggccctgccccctaacggcctggcccggccccctgtcccctaccccagcaccattgaacccgaggcgctgcggcggggcaacatgagctccctgggcttcacgagcaaggagcagcggaacctgggcctcctcgtgcacctcatgaccagcaaccccaaaatcctgtacgcgcctgcgggctctgaggtcgaccgcgtcatcctcaaggtgcacgggtctgggacgctccatgtttgacaggcagagtgggagggggtctctgcaggcctgggacccctgggcagagggtgtcggcagaattgacacgggaggggtacggggtgcagcttcggatgggacacaggctctgcaggtgggggaccagggggtcgcttttcctttcgggagctccaggggctgctgtgggaaggcactggagagtctgctctggcagggtcctccggctgggggtggccggtccagggcagtgctggtggaggaggggtgtgtccagagaccttccagagtgtctcgtgggcgggcagctgggcagtttgggttctgggtgaggggtcctgtctggaacaagcagaggccagggctggacattggcctgggaggggagggcctgtggacgaggccaatcctgggtgtagagggggtccctaggatgagggtgggacagatgagggtggagcattgggtgcttaagggacacatggagacaggtccagcaaaggagctggtgggcacagctgggcagttgggggtccggaggccgtgctgccctgggagtggagggcaaagcaggtttcacctgagcgccgcagaaaggagtggagagcccgggcgtgggactcacgcttgaaatcccagcactttgggaagccatggtgggaggatcgcttgagctcaggagtttgagacaagcccgagcaacatagcggaagcccgtctctaccaaaaatacaaaattagccaggcgtggtggtgggcacctgtaatcccagctacttggagggctgaggcgggaggatcccttgagcctgggaggtggaggctgcagtgagctgggactgcaccactgcactccagcgtgggtgactgagaccctgtctcaggaaaaaaaaaaaaaaaaaggtggggagggttagttgttggcaatggaccagccactggggaggtgagtggggtgagagcccccaagtcggtgggggtccgtccagaaactccatgcccctgcctcaccccctgcaggccaacgagacttttgcttttgtgggcaacgtgactcactatgcccaggtctggctcaacatctcggcggagatccgcagcttcctggagcagggcaggctgcagcaacacctgcgctggctgcagcaggtgccaagggtgcccgcgagggaggcggctgtgggtggtgtggggagcccctctctgcccggctcggcaggcgcaggtccccctctgagccgcccctccaccccaagtatgtagcagagctgcggctgcaccccgaggcactgaacctgtcactggatgagctgccgccggccctgagacaggacaacttctcgctgcccagtggcatggccctcctgcagcagctggataccattgacaacgcggcctgcggctggatccagttcatgtccaaggtgagcggtggggcctccgagccaacccacgacaccccctgcctcgcacatgcccacggcgggctccagcgatgcccctcccgctaggtgagcgtggacatcttcaagggcttccacgacgaggagagcattgtcaactacaccctcaaccaggcctaccaggacaacgtcactgtttttgccagtgagctgccctccccgccccgccccagccccccacagacctcttcctccccagcccagccccacccgtccccctgtgccctcccactccttggccgcgccctggccttcccccctcacccgccacttcccctccccacccctgccccttccaaacggccccaacccacaacccgccccctccctgcacctccccacttctgcccacctttcccctggggcccccaccccagccctgtcccacctttccctggaccctcctgtccccgcccccacaccttggccccgcccccgtgccttgctttcccccccaccacgccttggtcccgcccctgcatcttggccccgccccaacctcccggccccaggtgtgatcttccagacccggaaggacggctcgctcccgcctcacgtgcactacaagatccgccagaactccagcttcaccgagaaaaccaacgagatccgccgcgcctactggcggcctgggcccaatactggcggccgcttctacttcctctacggcttcgtctggatccagggtgaggagcaggcccggaagaccggctggaggattcatgggggaggacaggtgtgaggacgagagggcctgcccggcacctgatggctgcccccacccacagacatgatggagcgcgccatcatcgacacttttgtggggcacgatgtggtggagccaggcagctacgtgcagatgttcccctacccctgctacacacgcgatgagtgagtgctgggcgcccggggctggggctggggctggggctgagtggcgcctgagcgcggcctccccgcagcttcctgtttgtcattgagcacatgatgccgctgtgcatggtgatctcctgggtctactccgtggccatgaccatccagcacatcgtggcggagaaggagcaccggctcaaggaggtgcgcgggccgggactctccctggaggcgcgggctggcagggaggggcggcgtcctccccggggcctgccccaagcccctggcccacccgcaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctggtgagcgcgggccatggtaggagggacctggggcaggcacttgcccagcaagctcaccccacatcctctcagagccccctggaccctggcacgggcctgcccaggaggccgggcgtgcgggtggatgacggtgcgcgtggcccctgcccacccagcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcggtgagggtcgcgggcaggcgggcggctggggtgccgggccaccccacgtgctgacaccactgccttctcagtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggtactggccagcccttggagggcaggggagaggcaggggtccccagccagggttggggaccagcagtctgtgtccactcctggatgcagcacgggtggctccctgggtgggcacgtggcccacgtggtggatggtcaccccaggccctaggtcagcctcccctcccctccccgacccccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttggtgaggctggcatcagaatggtggctggggtgggcgctgggttcagagtcctgggtggccttggcgccgcccccaccctgctgatccacagccctggtgcagaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtgagtgtcggaggggcagggcggtgggcatctgctgaccagagcaggagtcctagtcagggcagggtggggcccctgcagagggcgtggggtcatgaccccgcccacctacccaggtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagtgggtgggctgggcggggggcggggcaggtgggcggaggccctggggctctgcatagcagcagccccatgccccacctccctgtcccaggatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggtgagtggggtgccgtgtgggcaggggtgcgggcggcgcctcccctgccccctgaccctgggtctggccttgtcctaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaaggtctgtgttgaagctgcctgagctggcttcgggccaccttctccccgggacccccacctgagaatccacaatggagaggctgggccctcaccgtcacccgctgggcccaggatgcctgctggggcctggcccgccctctgcaacgcccgtatcttggagaggctgggtcctcagcgtcaccccctgggcccaggatacctgctggggcctggttcttcctctccaatgcccatatcttgacccagttgggttcccattgggggtccctcctcccagcccctgagtgaattccttcctgctcccacgtcccccacagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccaggtgtgagggcgcacgggtcggggggcagttgcaggtggtggaggtgggcgcactcctgcctgggcgtccctgccgcagcctccccctccaccgcccctgcagcacctggagcgcagcctggatgcactgcacctcagcagcttcgggctgatggacacgaccctggaggaagtgttcctcaaggtgtcggaggaggatcagtcgctggagaacagtgaggccggtgaggggcctggaccacttgctcagcccaccccacccacaaggccccagctcgggcctgcgctgtcactcctgcctggtgtctgggggcgccaccctggtcctgggtggaagccaggggacgccccggggttagcctgcggtcctaggtgggtggtcctggtggccagaggtcccggacaggtgtatgagcctgggaactggggtcaagaccggggatgggggtcctgggcaggcctaggggccagtagccctgagtgtcccctcggcccttccactgcggcagatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaaggtgggggtggcagggtgaggctgggacagcaagggagggggagcagggttgcgggggagcggcatgagggcagccagtagggagagggtagcgtgcaaccacctgctcagcctctacctctctgcacagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtaggccaccggctggacaggggtgctgggcttgcctccccccaccgcccgctgggagccctgatgatgcccactcctgagcttcctgactctgggcctcaccccacacctgaggctgggcacgcaccggggttcatccgggagtcctgtctcctcgggtcccagaccccaggcgtggatcccttggggttgggggaaggggaccgaggcttgggggccgctggccagagggcagaacctgctcaggcctccctgctcgccctgccaggtgatctgcccccgctggtcctgtcaccttcccagtaccacaactacacccagccccgtggcaatttcatcccctacgccaacgaggagcgccgcgagtaccggtgaggcctccagcgggggcagccttggtgggtggggcgagtgaaggggcggggacagccttggtgggccaggcgggcgagggggcggggctggcgaggggcggagactggcagccccacctcacactgtcggtgcccgcaggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccaggtagtggttcagggggcctgctgggggggcaggggcagtgaggggtccttctcaccgcaccatgctgtgcccacagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtgagctgggtggggaggctgtgggtgagggtggccggccaccagccacctagtctcaactcctgcccctctagcctcactgcctgcctagcctcaccgcccctcccacctgcctgcccaggtatggggccatcacctttggaaacgtcctgaagtccatcccagcctcatttggcaccagggccccacccatggtgcggaagatcgcggtgcgcagggctgcccaggtgagcgaggctgcgggcctgggccccgctgtgtgtagcgccgcccgaggtctgcagggacccaggtctgaggtcctggggcctttctgtgtcctcttccttctgcaggttttctacaacaacaagggctatcacagcatgcccacctacctcaacagcctcaacaacgccatcctgcgtgccaacctgcccaagagcaagggcaacccggcggcttacggtgagctgacataggcagggcggggcggggcggggaggagctggggccggggcggggaggagctggggcctgaagctgccgcccccgccccgccgtgtgcaggcatcaccgtcaccaaccaccccatgaataagaccagcgccagcctctccctggattacctgtaagtgtggccagtgggggatgaggtggggcaggtgggcactgcagccccggccgtgaggactgagggcttccttgccccaggctgcagggcacggatgtcgtcatcgccatcttcatcatcgtggccatgtccttcgtgccggccagcttcgttgtcttcctcgtggccgagaagtccaccaaggccaagcacctgcagtttgtcagcggctgcaaccccatcatctactggctggcgaactacgtgtgggacatggtgcgcccggcgtggccatggggtgccccggcccttctcatcccccatccccgccctgccccgggtctctcaccagccgcccccacccctgcagctcaactacctggtccccgctacctgctgtgtcatcatcctgtttgtgttcgacctgccggcctacacgtcgcccaccaacttccctgccgtcctctccctcttcctgctctatgggtaagcggaagcggaggggggagcggcctcaggtgggaccggggctgcctggtgaccactgcccgccacctgcccgcaggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggtggggcggtgacgacatggtgggggtggcggaccctgcggaggctgtgcccctcaccccggccacccctgtgcccctgaccccggccaccccgcaggacctgaaggttgtcaacagttacctgaaaagctgcttcctcattttccccaactacaacctgggccacgggctcatggagatggcctacaacgagtacatcaacgagtactacgccaagattggtgagggggcccgtggggcggggaaggcggtgggggccccgcaaggcccagagcacaggccctgagctgtctccccgcaggccagtttgacaagatgaagtccccgttcgagtgggacattgtcacccgcggactggtggccatggcggttgagggcgtcgtgggcttcctcctgaccatcatgtgccagtacaacttcctgcggcggccacagtgagtggggggcggggtggggcgggggcggggcgggagcagggatgggttcgggggtggggcagggtaggggcgggggtgggggcagggatggggcaggagggggtgaggcaggggacagcagaggggcctgcccacccttcttacatgccacagccagaggatgcgaggctggtggcagggaggggcagtgggggtggcgagctgctggacactgtccaccctgtcccccaaggcgcatgcctgtgtctaccaagcctgtggaggatgatgtggacgtggccagtgagcggcagcgagtgctccggggagacgccgacaatgacatggtcaagattgagaacctgaccaaggtgggctctgggcatgtagggtggggcctgggtggggtaggccagggccaggggggtggggccccagcagtggaggtggagcctgggtgggcagggccctgagctctgggggtggggcctgcatggggtggggctgtggggcacgtggccccctgggctctggaggtggggcagggtctgggtggggtggggccagaggggcagggtgggggcaggatgccccgctgagtgggcaggctcctggccaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacaggtggggcgggagccctgggtgggcggggccgccgcgtcctcacgcgctgacagctgccgtgtccccagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtgaggatctgtggggcggggcagggagtcagcacgctgggtggccctgcctccactgacacctgcgttccctggccaggtggtgaagtgggctctggagaagctggagctgaccaagtacgcagacaagccggctggcacctacagcggcggcaacaagcggaagctctccacggccatcgccctcattgggtacccagccttcatcttcctggtaagtcctgggtgggtggggggtggctgcctggcctttgacttcctggtgagcacgggcaggggcagcgttcaggctggggtgtgtgggcctggcagcagctgagcctgccacccatccccaggacgagcccaccacaggcatggaccccaaggcccggcgcttcctctggaacctcatccttgacctcatcaagacagggcgttcagtggtgctgacatcacacaggtgagggcgcccccaccccctctttgtgcccccaccccacagcaccccttccggtgccagcctgtgcatgtcccacagcatggaggagtgcgaggcgctgtgcacgcggctggccatcatggtgaacggtcgcctgcggtgcctgggcagcatccagcacctgaagaaccggtgagccggggcagggccaggggtgggctggggcgggcccggggggggcggccaggcagcggggccaggagtgggggtggctgcagggctgtgagggctgtggggccaggggggctgggggcactggggctggggggactggggcagtggggccaggggaggagcctggagggctgtgggggctgtggggttggggggctgtgggaggctatggggcttcctggggtgcctgtgggggctgtagggctgggaggctggggggctggggctctggctgggcggcgcagggctccgggccaccggcctgtcccaccaggtttggagatggctacatgatcacggtgcggaccaagagcagccagagtgtgaaggacgtggtgcggttcttcaaccgcaacttcccggaagccatgctcaaggtgcgccgtcccgggcagggttgtggagggggcgctacggggtgggggggcgctgccaggcctctgacctccccccctgcaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgagcgccccaagggcactgcgcaccacacctgcccctcccctcacccgccctgcccctcctcaccccagaccagccccctccccacacgcctgcgccacccaccaggtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggtgagcaggctgctctcatggctgtccagggctctgcccactggacccaggctgcctggtggctccagccgcgggtggggtcgggggagaactggccccaggatgcttgctgtccagaggtcaagggggcagagtgggcgagggacacttgcagataggcctggagagacgtaactgcatggtccagacttgctagagtctttgaggggcacagagcaagggtggggcagaggggaccagagccggggaacaggggaccgatgtagactcagtggcccccagactcggcagacggaggcccgggagagcccagacacagagggagctcgtggggagaccctgcgtccaggcccagcctgcaggagggccggggcgggccagcacaagtgtcctcagccccagcagggggtggcacaggatgccccataagcctgacctcccctgtgcacaggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgtggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcctgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 37788 - DNA, 19472 bp, Homo sapiens
ggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgtgagtgggtcctctctcccctggccaggcttgctgccttcggccgccgcccttcacaggaggggtcattgcctcccaccagcctgtgggccgcgcagggcgaccgcgtggtgcggccctcaataggcgatggcgctggctgcgccgctccgggggctctagtgccccgtaggaattccattttggaggaaggatttttcccgttttgttttccccagacactttagccgtgcaaatgcactcttgatttctgttgcaatctcgggtgtgtgtggcctggggaggaggttgtctctttttttgtcgttcatctttttaaacctctactcttaactaaaaagtcgtgcatttttgtcgcaaattttagtctgaggctaaatccgcatgctcagtgcagtatcattgttgcattcttttttttgagacggaatctcgctctgtcgcccaggctgtagtgcagtggcgcgatctcggctcactgcaacctccgcctcccgagttcaagcgcttctcctgcctcagtctccccagtagctgggattacagtcgggcgtcaccacgcccggtgattttttgtgtttagtagagacggggtttcaccgtgttggtcaggctagtctcgaactcctgacctcagatgatccgcctggctcattgctgcattcttaaaccctcttggtagcttcgttctaagtgcttccaagatatgagtgaatgctatagaaattgcaggggagtccaaagggctgcgcttctcccgtggctcagtcttatttcatacctgcgacatcttttaagagaggtctaccagaggggaatcgtgtcatgaaaaccgttgtgatccaccttgaattttcggagaatcttcattcgcatcattgaagagcaaatttgttgcaataagaaatattttttggcttatcttggttgttcagccaaattagtttttggaattaaaattgatacgtaagttactaaagcccaaggggtacaaagaagggattattgtttacttaagtaacagtggttacggtttaattcagctatactaagtcatttcaagtgttcagtagccctgtgtgagcagtgactgcagcgctgatcttactagcactaagaatcagacatctagttccagctttcttatgttttaggagggaagggatatagacataatttgatttatgactaggcagactaatagaatactgttttacattcagaccttgaatttctagggccaggttagcggcataatttggggtttctgaatcctaatttctgtagttgtaaaatcaggtaatgccacctacctcttgttgatcttgtgaaggttgagatgtttgaattgccttccacgttttctgacataggaaatgctcctccataaatgctggtggtcattctgccttcgggttattgtcctgtagttgccaaaatgggtgacagctgggggctttggtacaaatgcagagttataaagaatggattaaccctatcttccgttggaaaccctgaagtcctgttgcagaaacaagagctatcattttagacaaatggaggaatgttatttcaaaataacttctccatcattttcaatctaaaattgttttttctggatttagcggcaacctaatgattacagtgaattacttagctgcagcagtaactttaggcaagtaacttcaagctttagttttccctttttgtaaaatggtatagtgtagagttttagtcctgttcctcacacatggtaattgatgaatgctagagattttttgttgttgttgtttgtttgtttgagtctcgctctgtcgcccaggctcgagtgcagtggggtgatctcggatcattgcaacctccgcctcccgggttcaagcaattctgcctcagcctcctgagtagctgggattacaggcgcacaccaccatgccaggctaatttttgtatttttagtagagacagggtttcaccatattggccaggttggtctcgaactcctgacttcatgatctgcccgtctcagcctcccaaagtgctgggattacaggcgtgagccaccgcgtccggatgagatatttttatgagtagaaatattttgttgtttgatgtttttgtaaaatttatttagaataatcttgcagtctgttcacaggtaattgaggctgggtgtggtggctcaacgctagtaatctcagcactttgggaggccgaggtgggcggatcacctcatgtcaggagttcaagcagcctggccagcatggtgaaacccccactctgctaaaaatacaaaaattagccgggtgtggtggtgcacgccggtagtcccagctgcttgggaggctgaggcagaattgctggaatgtggaaggtggaggttgcagtgagcagagactgcaccactgcactccatcctggggggacagagcaagactctgtctccaaaatatacgtgtgtgtgtgtgtgtgtctttatatatatttatatctatatctatctatctttatctatctatctatctatctaatctaatctatcgaccaggcgcagtgactcacgcctgtaatcccagcactttgggaggccaaggtgggaagatcatgaggtcaggagatcgagaccagcctggtcaacatggtgaaaccccgtctctactaaaaatacaaaaaaaaaaaaattagctgggcgtggtggcacgcacctgtagtcccagctacttgggagactgaggtaggaagatcgcttgaacctgggatgctgaggttgcagtgagccgagatggcgccactgcactccagcctggggacagagcggggacagagcgagactcggtctcaaaaaaaaaaaaaaagtgcagttgcgtgactggctgattttaaaaagtttaggggtattttgcctttgtggaatgaaattctgttcagttaattttgagtttttaaaattaattttttttaaattttgagttcttctagtcttatttccaatagaatatttacatctgcaataaaagagcagtttttcacataaggcatgtagctcattggctttcttttttgttaagaagagagacttaggcggccgggcgtggtggctcaggcctgtaaacccagcactttgggaggccgaggcgggcggatcacaaggtcaggagatcgagaccatcctggctaacatggtgaaaccccgtctttactaaaaaatagaaaaacttagccgggcatggtggcgggtgcctgtagtcccacctactggggaggctgaggcaggagaatggcgtgaactcgggaggcggagcttacagtgagccgagatgacgctgctgcactcccgcctgggcgacaaagcgagactccgtctcaaaaagaaaaaaaataaaaaataaaagaagagagccttatattgtttaaaatgaggcttgaggttaaatttgggatcctaatttatttagactttttgtcacctgttagcaaaagcagagtatcaggatccttgaggtgtagtttttatcattctaaattatgagtaaatgaaatgtaatttgccaaattacaatgccagctgcaggtgcatttcacttatatgggacggataaaatgacacattaaaaatatattaagcatcttatttaaatgaataaatcttggaaacattgagtcaaggcttgattttgctcattgttaaatttcttcatggtttttcagttgattaccatctgtccctttatcacagaaatactgcattatactatatctgaaaatatgttaatgtaataagttaattgtattatgaaactaaagccagaattttaatcttattgctaaaaatgtaaagcaactaagtgatcttaaaatttggtagctgtatcagttaaatgtattcagtggcaatcacacactcctccccaccttattaaaaaaacttatgactcagtttcactttcctgggtttcattatcagttttgtcattttccctaaattctggtttagcaaattgtatgtctcacatacagttgatcccacaaacttggcatgttcatttctgaggtgccttttgttttgatggtaataacatctttacttctccacactattaactatagaggcagaagagagtcatgtttcaagtccaaaagcctgggtttgagttgccattccaccagtaagtaattgtgaccttggtacattttctcatctggaaaatggggatgataatagtacctggattttgttttttgtttttgtttgagacggagtctcactctgtggcccaggctggagcgcagtggcgctatctcagcttactgcaacctcaaactcccaggttcaagtgatcctcttgctacagcctctcgagtagctaggactacaggcgcctgccaccatacctggctaattttttgtattttagtaaagacggggtttcaccgtatcaaccaggctggtcttgaactcctgacctccagtgatccgcccgccttggcctcccaaagtgctgggattacaggcgtgagccactgtgcccagctgtaattcttttaatgttgttgtgaggattaaataagctaataaacatttagaacagtgtctcgcatgtagcatctaaaacttagtgctcacatccaagcgttccttgtcttcatgtccagatcctttgaagtcttccatttcttttctagttttgctacgctccctccagtacaggttccagtgtagaccacgatatttagcaattagatattgttgtctgttatcactcattattttctgccttaagagaacaaaaacccataagcaaatggagggttgaattatgttctttatcctttttccccacagttagttgtgcggtgatgaacacttaagtaaggtacttagaaaaattagcagccttcagattaatacataagatcaactttaatgcatactttttctgttgaaatggctagaattgtatttaagccttacagtggtagcactctattatgggagacgagtgggtatctgatgctggtgtgatgaaatccagtttatgagggttgactaagaaaaggtaccttgaccatagtaaatgaaccttctgtctacaggtagggagacctcttttttgagacagagtgtcgctctgttgcccaggctgaagtgcagtggcacagtctctgctcactgcaacctccgcctcccgggttcaagcaattctcctgcctcagcctcctgagtagctgggactacaggcgcccgccaccatgcccggctaatttttgtatttttagtagagatggggtttcactatgttggccaggctggtctcgaactcctgaccttgtgatctgcctggctcagcctcctaaagtgctgggattaaagcatgagccactgggcccggccctcagacctctttagtcatgcattgaagcttggatttgtagagtgctttaaggttttcagaggacatttgcttgtttcatggcttttgtttctcactgtagtcctgtaaggttagaccttatcttgggagagtgagagatttgcctaagatcacccagctaataagtattagctaataataagtattggagccttacattttcttaactatgtcagcagttactctctatgtcattggtagtttttagtgattatcactttaggtgtagtcctgcatcagtatccttgagtgactggttccaggcctcccctggataccaaattctgatgatgctcaagtacctttaagtggtatagtattttcatgtaaccatcatatgcctcctgtacactttagattttttctttcatttaagaatgccagtttgcaacattcagtaaagatataatctggcatatttcagtaataaaactccctaatactagtggcctaattcttgcccctgttacatatcctttgttggttggaaggggggacttgatctgcttattgtaattactttagaagtccagctattggagctatctccatcttgcaaattgctagatcttctgccccaaagggaaggagaacgctccagtgcagtgtcacatttcctacagctcattgaccagaacatgtcatatgctcttgacagatcacagggagggatagattcctagagttagaaatgttttgcaaatggaattaatgactgccacagcagttagaattcttttgattcccatttttataatgacaaaatgtaaatataactttgcatttcttgcaggaagaaagaaacagaagcttgccaaggagagagctgggctttccaaggtaatagtctggtttctgtttaaattatatattttgtagaaatattattttaaaatctgtaattggaaatgtaattaaaatgtaattggaaaaagctagttgatactggacattgcttttttattttaaaatacagcttatttttaggagtaggtgaataatgtagttccaatgacagttatcgagtccttcattatttcttttgctggccataacaacaaacagcttactgtatgaacaataattaaggagcaagatgagggcctcaagacatttgcaccaaaagatgaaaagttcctaatcagctgcttcaaaatgatacaatattacacttaagatttaatttctttactccaacttcctgtaaaagaaccatgggttattatttcaaaaattattcaagattattcaagcccactgatccagaatcccactgccctgacaaatttttgccttgttgcagtacatagttctggatataaaacttgtaatttattttttcttctcatagatcctgagttcttgattatttttaatgactatgtaggtttatctacttggtaaaaaaatgttctgtggcgtgtgtaagtaaattaagtaaatgttaatcattgtgcttgcagcttttcctttttattgagatgagttctattgtttgggttcttaggacttggattactggatcattagtggttctttttaaagcaagttgagacaaggaaaaattaagttaaccagtatattttgttattttgaaacagttgtgtaaacacagctagttgactggacatggtaatagtgaagtgaaaatgggaggaaactacttcgttctagtaggatcagactacctttctgaagtatgtaatatgtttattatgcttttggtaacttatatttctaagggcataggaaaacagattgagacatgcaccagtatgtatttttagattcaagaatagaattaaattattgctacatgctggggtagtgtgtgaaagatgtctccactttcagaaatttaaattgtttcacttgtgttggctaggttaataagagtacgtacagtgtaattcaaggaccaaaaacttgcactaatggaagtttaggttttctcttttttttttttttgagatggagtctcactctgtcaccaggctggagtgcagtggtgtgatcttggctcactgcaacctctgcctcccaggttcaagcgattctcctgcctcagcctcccgagcagctgggactacaggtgcatgtcaccatgcccagctaatttttgtattttagtagagatggcgtttcactgtgttggccagcatggcctcgatctcttgaccttgtgatctgcccgccttggactcccaatgtgctgggattacaggcatgagccaccgcacccagctactgaagttcaggttttcaaataaaaatggcctcttttttttttttttttgagacagggtctcaccctgtcacccaggctggggtgcagtagcggtgcagtcacagctcactgcagcctcgacctcgtgggttcaagcaatcctgccttagcctccctagtagctggactataggcatgcaccaccatgcctagctaatcttttattttttttatagagagaggctgaggtaggaggatcacttgatcctgagaggtgaaggcactgagctgtgatcacactactgcactacagcctgggcgacagagtgagaccctgtctcaaaaaacagtcttttagatgcatgtaaaatgtaggctgggtgcggtggctcatacctgtaatcctagcactttgggaggccgaggcgggtggatcatctgaggtcaggagtttgagaccagcctggccaacattgcgaaaccctatctctactaaaaatacaaaaattagctgggcatggtggcgggcacccagctactcgggaggctgaggcaggagaatcgcttgaatccgggaggtgggagttgcagtgagctgggattgtgccactgcactccagcctgggtgacagaatgagactctgtctcaaaaaacaaaaaaacaaaaacaacaaaatctgtataaaataatgttgaatcataaggacaaattgcttacagttgtataaaaatctacaataatggcatccgaaaatattgtaacgtgcgtagacggtatagattttgcactcttttctctttacattcgagttagagctttctaagaattattcaactacaaactcaagttttttcttttattcatttgaatgtagatgaactcttaattcctacaagtattcaggagtaaagttcttctatcagatttttttagaatgagtgatttggttttttgttgttttatttttattgatatctgtgtattggttatatcccctggcataattgtggtgtcatttattaaatattttatttccagttacctgaccttaaagatgctgaagctgttcagaagttcttccttgaagaaatacagcttggtgaagagttactagctcaaggtaatagtcattgaaaagctaaggaaatgggtagaatttttctcactgatagaaatttataatgataaggggctttgtttgtgtaatttggctgttagaaaaggtactccaagtatctcaagacaagtttttaggcacttaataattggaagattattttgtgtaagactggctctagaaagaaatattccttgtgggatattgttgtccataatatattttaagtgagttttaggttttcttgctatatcatatgatgtagaagatagtaagtttttacaaatgaggttctcttactctgaagtagtttctaatgtatagccatagtgcgatatgtaaatagtaactgaaggaatgtgagctaggaatatactcctcaactccttcatctaatcttcagatcttttccagtatttataggaaggaatggctaatgtaaggtcccagagaaggttaatttacctaatcaaggtcacacggtgagttcatgaccccttatttcagaaccaacttgttatctgatccagaatttagccttttcattacattgtacttcatttatttcatcaacagtgctaagaagtttctaaaaaatattctatctttaaagttcagctatgaaattgaaattatcaaattgacaaacgtgagaaccgtaatttactcaataatctcaaaagtagatttgaagtagttgctatcgttattaaaactgctatcaaatattttaaaattctgattgctgtatcaatagatttagatagaattgaactacatgatgtggggcatttgtgtgtgaatgagtttgttttgttgtttcttttatggggagagtttaattcatttaaaatggtggtaactaactttatcacgtctcccctttgccaagaaatacttttttgatatcaatagaattgctcaattaatttgacctaaagagtcacagtactcaaattgccaacagactgggaaggggtaaaaatcagtgagtagggacaggcatggtggctcatgcctgtattcccagcactttggggaactgaggcaggaggattgctggaagccaggagttcgagaccagcatcgataacaaagtgagaccctcatctctacagtaaatgagaaaataaaccaggtgcagtagtatgcacctgtagccagctactcagagactgaagtaggaggataccttgaacccaggagtttgaggctctagtgagctgtgatggtgccactgcatttcagtctgggcaacagaatgatatgctgtctcttaaaaactatatacataaaatctgtaactgcagaggagtacaagataggcaccagtcaggaaacatttccaagtctcctacaggcatcacactgcaatttctccatcaatctgagagagaggacccaggcattggggaaagggaaagcattccccctcagtgctaaagcagtgctgcatactgagttgctctgctccttgcatcgcataacactgggtttgatcttcctatgctgatagatagattttatgatattctccatgctgttgtattaacaaaagataccacttacgacgatctggctatccagtcagcaaaagttgtagcaacatccactttgcacaagaagggagctcaaaatgacaagatcactgcaactgaggttgtgtcagtgtatcttcagcattgttgctaaatctgcagatacagtaatcaacagtgctagttcagaagagatttaattatagtatgtattcagaagcaggaactgacttagccagtcttttgattactgtaattctaaagtgaccatcagtggatcagtgtgcagccctgggtcggatcccttgtgatgggtatcactacatcatcatttcaatacctgggaaaggaattggccaagatggtgcctgggaacccagatgacaatgacctacacaattggagtatcctgaaacattgtgtagatgggacaatcatagtcctcacattggcagtggagattcacctgtttctgctgatggtcaagaggttaagaaagctcttggaaacctttacttatactcaggtgccatcagataccccgcagtagtcaaaattttacccaaaatgtttctcagtctttccacagcagccaattggtagcacagaaaacatataccagatttaagagcctggaaagaacaccagtgactatcctgatacccaggcttgccgtcagctgacagggtcaagtgcatcgggtatgatggtagagatattccctaagacatacttaatatcctcagcttgctgggtaaaaattagtaagattgatctgaaactgttttctcctttttttttttttttgttttttttgaagtggagttttactctgtcacccagagtgcagtgggtggagtgcagtggtgtgatctcggctcactgcaacctctgcctcccgggttcaagcgattctcctgcctcagcctcatgagtagctgggattataggcatgcaccaccaagcccggctaattttttcctatttttggtagggggtgggtttcaccatgttggtcaggctagtcaaactccgacttcaagtgatccacctgccttggcttcccaaagtgctgggattacaggtgtgagccactgcacctggtctattcttactctttttttttttttttttttttttttttttttgagatggagtctcgctctgtcgcccaggctggagtgcagtggcgcgatctccgctcactgcaagctctgcctccctggttcatgtcatcctcctgcctcagcctcccgagtagctgggactacaggcgcccaccaccacgcccggctagttttttgtatttttagtagagacggggtttcaccatgttagccaggatggtctcgatctcctgaccttgtgatccgcccgccttggcctcccaaagtgctgggattacaggcttgagccagcgtgcccagccccattcttactctttaagatcaatttcctgtgaatttatatcgtgggaaattgtttggtaaataaaaagaatctagtaaaaaatgatcttaatggtattaagaactggaaaaggtctgaggtgttttgttttgttttgtttttgagatggcatctcattctgttgcccaggctggagtgcaatggtgcagtctcagctcactgcaacttccacctcccgggttcaagcgagggttcaagcaattcttgtgcctcagcctcccaagtagctgggattacaggcgtgtgccaccaggctcagctaatttttttttttttgagatggagtctcactctttcgccaggctggagtgcagtggcatgatcttgctcactgcaacttccgtcttccaggttcaagcgattctcttgcctcagcctcctgagtagctgggactacaggcacgtgctaccatgctcagctaatttttgtatttttagtagagaccgggtttcaccatgttggccaggatggtctcgatattttgacctcgtgatccacccacctcagcctcccaaagtgctgggattacaggcgtgaaccaccacaccccggcctaatttttgtatttttagtagagatggagtttcaccatgttggccaggctggtcttgaactgaccttaggtgatccacccacctcggcctccctaagtgctgggattacaggtgtgagccgccgttcccgttcatttctgagatttactttacttgcatgctaacatgttagtttgccccaatttcatggatgctggcaaaagacatgagaccactgggctagagacaaaggacagctcgttattcactgcaataatagtaacaagggtattggcatttgcactggtttcccgagccacagttcctatggcaatgcagaaaggggacacatgtacatgtagtgggttgcgtataggagaggagccctgaatttaaggatcctgaattttttataatgggcagtaaacatgtgtgtgcttttccctacacataggtaatgttgcaaacctgcctttgctcctgagggaggcagtttatattctgaggttgtttactgtacaaacatccttgaaaagacagtttggagcaaaggcagtaaatatctgctcagaagtacagaaatgtgacagacttgagaattgttcctctacttgtattgttattatttttttatttttatttatttctttttgagacagagtctcgctctgtcgcccaggctggagtgcagtggtgcgatcttggctcactgcaagcttcgcctcccgggttcaagcaattctcctgccttggcctcccaagtagctgggattacaggtgtgcaccaccacaccctgctaatttttgtatttttagtagcagtagggtttcaccatgtcagtcaggctggtctgaactcctgaccttgtgatccacccaccttggcctcccaaagtgctaggattacaggcatgagccactgctcccggccgtattattttttaaaagtatatctaatggagttatttttatgtaaggcacattaaaatattttaatgggaacctcctatacagaacagtgcttaatttaaaatatttaatagcatagttttgctcaaatattttgggacagtttttggagtttgatttaaagtgggattagggccgagtgcagtggctcatgcctgtaatctcagcacattgggaggtggaggcaggaggattacttgagtccaggagtttgagaccaggctgagcaacatagtgagaccccgtttctacaaaaaaaaaaaattagcaaaattagcccggtgtggtggtgcacacctatggtcctagctacttgggaggttgaggtgggaggattgcttgagcccaggaggttgaggctgcagtcagccaagattgtaccattgtactccagcctgggtggcagagggagattgtgtctcaaaaaataaataaaatggagttaactaaggacaaggagcacatagcagatacttattatttattgaattaagtgaactttgaaaaactgtaagccttaagtatttttttcaaacataatatgtctattgaaggatatttatagataaaataggctgggcgtggtggctcacacctgtaatcccagcactttgggaggccgaggtgggcggatcatgtggtcaggagatggagaccatcttggctaacacggtgaaacctcgtctctactaaaaatacaaaaaattagccgggcgtggtggtgggcgcctgtagtcccagctgcgcgggaggctgaggcaggagaatggcgtgaaccctggggagcagagcctgcagtgagccgagatcgtgccactgcactccagcctgggtgacagcgagactctgtctcaaaaaaaaaaaaaaaaagaaaaaataagccctcccactcagagttaatcatggctttatttctcctgtcatatttcattagtatgaccatttttcctgctagtatcacttaaaatttttttttcttcccatgcgataccattcaaatagtacaaagatttggcttaatgtgaaattgggtcttctttctaccccagtccccagtcttttagttctgtgttacagaaaagtactatgcgattgttagcaattgtctcatgtagtctttcagaaatattccaagtatataaatagtaatatactttgacatttttatacattgatttcccccttacatatgtttgaaacacttccatatcagtacatgtaatctgactcattcttgttagtagcttcataatagttatatgaatgcattataggtcatttccagtattttacttgcttagtgtttttggtcagcatcatttggagatagtgtgtaaagttaattttgacaaaggccaaggcttttcaggttacatgtaattttatgtaaatcttacaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcaggtaaggaattggaatgttatgacataaaagtgagtgggatttagaatcgaatgattagggacattttaaaatgagcctagtgaacatgatgaaataaacttatctgtataatgaaaacaatatgggagatatcagcgcttgacattttcctctctggtgggaaacatccagatgactgcccagatctagtgattgtgccctggaggtggatcaggaagtgtgtgtcttagtgataagtctcaggtcttagtagtcaactgtccaaattcaggtcactcttggctactttctacaagtagctttctgcctactcttccaggagaccatgccttcagttaggtgatctgacagaggagcctagatagctatagcctacacattcgggcctaaacgtcggttctagacattcaagagcatggattccctctgactcacttgtgtaaaggctcatgcctctgctgctgctgaggtgcactttgagtttggagctatttgacgacatccccaaatccctactcaaaaatgcaaaatagcattaatatactgtaaaagattaacttatgtgtaaattaggagttaatgaaaatgctttctcttcattttgagttcttttcaaggagcccaaatgaatcttgctttttggaatagcgtgtctgttacaagtgttgatttcccaagttggtgtgattaaaacagtgaatgatgataggaagtatttacagaactttatagttagtaactgactggttaatttttcaaactgatttttactcaactgaattagaaaaggactggaaagaaagtaaagatcccaacgacttgagggaacaagttggacaaccaaggactttgtctaaattgtttttatttagactaatgtggttctagttctagaggattcatactggaatcatcggtttaatattacgctatttgaaaggcagcatagtatagtacttttggaaaattggcctgagggtgatgtcttttggaatatttgtgaattcactatgaagcctaattccttaaaaatgacctccttcactcaattatcagtgttcttggtttgcctgggagtgaaaagagatcttaaaatctttttggttttagttacataattgactgatgtaatattatgtaatgatggctgtacacagtgtctcatgccctataatcctagcactcatttgagctcaggagttcaaggccagcctgggcaacatggtaaaaccctgtctgcaccaaaaataaaaaaaaaattagccgggcatggtggcatgagtctgtggttccagctactcaggaggctgaggtgggggaggatcgcttgagcccaggagtcagaggttgcagtgagctgagattgtgctactgcactccagcctgggttacagagaccccatctgaattaaaaacatatataatgtaatgatctgcctcctttgttaacttgacttttgaaatgggattgtcagtagtatgatcattgttttcttggatgccgactgtgtgtaaagtgttacattttgaattaaatgtcagaatgggtgaactttactaagattcaattctttgaatacaaagagcattttattttgaagttagaatcctaattaaatgcttatgacactttaaaaaattattttttttttctttcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatctcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggag

SEQ ID NO: 37789 - DNA, 6192 bp, Homo sapiens
agtgtgtgcggatctgtggtggagaaggtatctcattcctctctaacatcatctccactttgcatctgtctctcttagtctgctttttttccaccgatgtaacagacctggagccagcaggactcagaggaaaggacttaatcaggtttatgtgtcctaaaggtaggagtagcaagagattagattgagcatatttctgttttggtgttttgtttatttaattttaaaaatcacattacttttctaacccagtttaggaataatatatgaaattgagtattaaatgaacatcttactggagttgaaagtcttgagcttgtttagttttaattttttatcccttttacttgagcgagtaaataactttaatacacaaatatttcaagttttgaaatgttaagaaaggctttaaaatgctgcttttggaaatcacgttggattaaaatgcttttttgttgttcactgctatttagatttgattggggtggtggtggtggggaaatagtaaactggaatccagcattcaaacttatatgagaagattattctagttaagcagctagattgttgtataattaattcctctgtgaaactttattcttcaaaacattgagcagcactactgaaacatacagctgtagtgctgttgaaactgcaggtttttaagaagaagaaaaaaaaaccaaacttttgtccccaggagaatagtttgactggtttcctcatttctctttcaaatatatatttaagagatcttttatttcagcataacaataattatttgcaggagtttttgtgttagcgactaatttagaacttgtagatttgagctgcctgaattggccagacagctgtaatcgcactcctctattcttaatctctttatctgggcagcagctgccatatggccacagtcagctggatcagatgtttataagcttccttcttcgtccctctctgtcctctcagcctcctaatttgatcacggctaccttgtgagctgccctccaatctttatttttagccttctcaaggattaggattgatgttagctgtggggcacttaaagtgattgtattgtaaatcttagtttattctagcagtggcatcttgcagaatgtgtctggggttaggataaagttttagtctgtcttgggcaaagtgtagaagaacaagaagaaaggaagtaatttctgaatattaaattaagtgtatctattcccaaaatgcacttgctgagatgggtggtgtggaggcttgcttctggtcacaggaaaggggaagtcgggtcttctttatttttcaggagtttacccactgcagttgaattctgaccctttgtacatctttgcctttctcctccctccatttcactttccctcatcacaaaacaagggcaatgatgaatatttgcaagaatagaagctagtgggaaaacagaaatatatcaaattatattgaaacaaagtattttctgttggctgaggtaaggcagaaccaggaaaaaaaaaaaggttctctttttctaaaaaggcttaaaaaaaaacgttgaacctgtaaagcttttgagttttatttaagcgctgtatgcctttatttttaaaagtttgaattaatttcaatatgaaactcattttgccttgcaacggatcaaagtttagatgagaattttcggagttcagtaaagcccctctggttcctaatattctgaaagtacagtttctacaaagaaatgtaactacttttttctcagttcgttttgaaaaatctttggatttgttcatagtaaagatgatcttttccatctgttggtgcagctccttctgatctcgtacatgtgtgctatacctgcaaatctgaaggcattaacatctgtttttatacacagggcttttgttgtaacaccctgactttaaaagtaagttgtttgctaatttctggactaattatgcaatttcatttttttttcttgattcagccaaatgtgtgtgtgtgtgtttaaactgtgctttctaagcacagtcaggtagcaaaagtaataaaaaggatggttgaacaagttttcttgtatgttccaggatatgtttgggacttttctttgtttattatatgagttgttccctttgaaattaaagctattttgtaggttttgtgggacataatttgataagtagagttaattaaatttcttctggaagagatctaaattcttattcttagtgagagactgtagttaaaggaaggcttttagaacttgggttcaaggaagatggagatgcgtcggaagctctttggcgggggtgaggaagttcagaaagtgtgcattttccttctggcatttaggtcttgtccgtgtgatttggtggtgcttgggtcataagcctgattaaaattcagggacatgtaccacggcggccaaagcggaattaatttttttatatggggactggagcgctgaaaagttgttcctgaccaggctctaatgagaaattcctctctccccaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggtctgtcacctccgtgagggattcggcagatgttgactgtgtgctggacctgtctgtcaagtccagcctttcaggagttgaaaatctgaacagctcttatttctcttcacaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaataacaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgag

SEQ ID NO: 37790 - DNA, 5455 bp, Homo sapiens
ggtggcggcggcggcggacccttggggtctggacgcaacggcggcgggagcatgaacgcccctccagccttcgagtcgttcttgctcttcgagggcgagaagaagtaagtgacgccggctgcggcgggccgaggtgcgcgggcctgcggctgtcgcattctggggtgtctcctgcccatctcttgccccgggagggaaacagcttttgcttgatcgtctgctcggcctgtgtcagccaaatttaaggccgttccgcgaggcagtcgcgagtgtgtccatgttgcagatgaggacactgaggcttggaggcgagcaagttgccccggacacaggaagtggcggcgcttgtattcgaacccagagtgtctggttctccatagcccttttcctctgggatctggcagcttcctcttttgtctctcgcccgccacctccatccttcatcccctccgatctgtcagcggcctgcgtaaaagccgcagtggctcctcgctgcctgcgggttgaaggagtccaggggagagagcttgggctcactctgtatctgtgggcgagtggcttgatctgtcggaggccctgtttcctcatctggaaaatgagtttattactgtacttaaacgtgggattcaggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggtgagcggagatcacgccattgcactccagcctgagcaacaagagcgaaactccgtttcaaaaaacaaaaaaagggatctggccaggtgcgctggttcacgcttttaatcccggcactttgggaggctcaggtgggaggattgcttgagcacaggagttccaggctgcagtgagctttgatcgcatcactgcactccagcctgggcgactgagcgcaatcctgtgtcaaaataaaaagaattggatgaggtaatttgtgtaaaactcttggtccaaagctcagcccctggaaaacctcgtaaccattggctcttattgttcccaggttggcgtgcagaggtcttggtctggcccttgccagccacttcggcctcctttagagcagactctcaactggggaccatttggccccacaagggacatgtggcaataacagaacattattggttgtcaaagggggttatgactggaatctactgggtagaggtcagggatgctgctgatgtcctacaatgtccacaagacagcaccccacaggaaagaatgatgcaccctaaaatgtgtgtggtgtcagcctggagaaaccaccttagaaaaaaggatattcaacttgatacctctcacctgtgtgagattttactgtcagcatagttgccctcaaattgagtgtgcattagaatcacctgaagggcttcttaaaccatagatccctgtgccccacctccagagttctgggtccagtaagtgggaggtgggagactcttaacaagttcccaggggattctgatgctgcttatctgggaactgcactctgaaaaccccttgtcttggaaaatccaatggaagtttcctgtctttgtccatctaagcgttcactaaaatcatagtaaatgccagagcatgacttgttttggggaatggatggaaggactgcacactccagccagggggatggttgctttcggaactcacagggtcaggaccagcctcaccgtgtaacttcagggcctctcttcttcaccttttggttgtttcattatgttggcgtaagaaaaaaggaacaggccaggcatgatgacgtgcgcctgtggtcccagctactcaggaggctaaggcgggaggatcactttagccgaggagttggaggctacagtgagctatgatcacaccactgcactccagcctgggcagcaggagagatcatttgaggcgaggagttcaagaccagcgaggacaacaaggcaaaaccccatctctaccggaaaaaaaaaaggaggaattcagaaaaggccaaggttccatagacctggggtagcaggaagtaggggaccgggttggcgaggcctttatgggatgaagagattgagaaaggccttcaggaagaggcagagcttatttttcctttttatttttatatttttgatacagagttccactctgttgcccaggctggagtgcagtggcatgatctcggctcactgcaactccacctcccaggttcaagtgattctcctgcctcagtctcccaagtagctaggactacaggcatggatcaccacactcagctaattttttttttctttgtatttttagtacaggcagggttttgccatgttgggcaggctggtcttgaacttctgacctcaggtcatccatccacctcagcctcccaaagtgttgggattacaggcacgagccaccacacctggccgggaggagacagggtttagactcagggtgggaggaggggagcccctgctcctcatctgtggcctctgtgtcttcctaggatcaccattaacaaggacaccaaggtacccaatgcctgtttattcaccatcaacaaagaagaccacacactgggaaacatcattaaatcgtaagtttcccgtcacaggctctcaggggctgtgtttaatgggcccccctgggcaaagcacaagttccaagtcttcctcagtctctctgagctacaggaagtccttctgggggcttgctctgggcattttataatcttggtacctttttatcaaaatgacaccgacctccatgtcttcacataagccacacttctgtagtggcttattctgtagatgaacatgtgcatttacattcactgtttgtttgtttgtttttgagatggaattttctctctttgttgcccaggctggagtgcaatggcacgatcttgctcactgcaacctccgcctcccgggttcaagtgattctcctgcttcagccttcctagtagctgggactacaggcccacgccacgatgcccggctaatttttgtgtttttagtagagatggggattcactgtgttggccaggctggtctcgaactcctgacctcaggtgatccacctgccggcttcccaaagtgctgggattagagacgtgagctactgcgcccggccttacattcaccattaagtgcacattctgtaaatgaacgagcagcagattccagcacagtaggcctgtgtgttattcatgctgaggggcattgaaaagcagtcaagattagctcccctcatgccacccgtttgtgacctcagtgccacctgggcctctaagatgtatgtggcagagactagaacttctatttaacaagagaaagaagtaggagttctgtggctatccagtgcccctaatgggcaccctgcattggttggtgggtgtttgtttataccagtgaggtcctagccaggtggttggtcagggatgtgtctgccattctggcccagggacttgtcattttactgtagacttggctcttccctctggtgccaccagcgaagccaggcttttccccgtctgtgagtggggtctgcccagtctcctggtgtgggcaggcgcagggatggaggactcctgcccggagcccagccagtggggcacccaagctctcctggggccctgctgctcccctgctcttgagctcagtgttgccacctatgcacgggtcccccttgtggtgctcacgccactctgagccgctctagaggagacccctgcgtgcccagggcacagtacgcgacgcagccccatggcacaaggcccagtgtgcgtggccagccgctggcagctgtgctgctcggagggcagagttccatttgcattccactcactgccggcagctggccctcctctcctgctgcctttatttgctgcgtggaggctctttgtgggctttttgggtctgagtcactgaacactggctggacattcactgcctgggagatctctttgccagcactgcggtgcccggtgggaagaggttgctggaatctgtttccagctcgggtccttcaacctcatggatgcagagtgtgtgtgtgtggcggggatagggtgtccccacatgaggtatcttcctaaaagtgttactttccttgaagactttttgggaaaaaagttgggggggatttttggctagaaagtctgttcttctgctctgagctggctgctacccagcttgggcatgaggctagaccctcacactgtctgtccctgacctcagacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtgagggcggggcctggaggggcagacggggtgggctggacactggcccgtgtgcccaggcctgggacagccctggcctgtttcttcggaggtcctgggggagaggcggcagtgatggaagagcagggacttccaccacaggctccaggacatgtggactgaggggctgtggagtctgggcctgtggctcccgtctgccccatgggacttctgtagtgctgcagggtccctcgggtgctgtgggccagatcggggcggggacctactgtcctttgggggtgctcttctacgtcccttgttggtgattggcaaggcctggtccttccaggtctctgggaggcagctcacccccgggtggcccacacctgttcctggcagggcgcatgggaatctagaacagtttagaggggaaagagccacagcttgggggatttcaacgtctgagtcgtctgctcaccaggaagcctctggggcctctgactcctgccggggctgccatagagaatggctggattgggccagctgggagggccctttggctgctccactgtcctggggagtgtggcccatggctgccctccaggaagggcctggcgggggggatgctgggcatgtgtttccagcgtccttgccccagctgttccagctcagtctccaccaccttcttctctcccaggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcgggagaga

SEQ ID NO: 37791 - DNA, 4699 bp, Homo sapiens; identical to SEQ ID NO: 35648
